United States Patent 9,976,157 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 3

SEQ ID NO: 3670 - DNA, 1026 bp, Sarracenia psittacina
ggtagatttcagttttcaatttgatttctactccgagacgattcacggcgatctgtaacagcaagtaaccgtatctcaaaagctttcttccaatggctccggttgctcctagatctggagacgccattttcgctagcgttgagcgcgtgaacgccgagctcttcaccctaacttatggagccatcgtgcgtcaattactaaccgatctggaggaggttgaggaagtcaacaaacagcttgatcaaatgggttataatattggagttcgactagttgatgagttcttggcaaaatctaacgtctcaagatgtgttgacttcaaggaaacaagtgaagttattgcaaaggttggtttcaaaatgttcttaggggtcactgcttctgtgacgaattgggatgctgatggaacgtgtttcagtcttattttggaggataacccactggtagactttgttgagcttcctgatacatgtcaaggtctatattactgcaacattttaagtggagttgtcagaggagctctggagatggtgtcgatgaaaactgaagtcacatggatccgagatatgcttagaggagatgatgtgtttgagttgcaggtgaaactactcaaacaagttcctgaggagtatccatacaaggatgatgaataacacgcttaccaatacccctggtacatgcattttacggtttttgtatcttccttgtgccctctaagaacaagtttttaaccttgcattccctctaattttatagcttactttcgcttctcattttggaattttgatgatattgttttatcaaatgcattttcaacttgatttaaatgatgatattgttttatttaatgcattttcaacttgatttaatttaagtttacattgttactcacccctccccacttgtcattttgtaatatgattggggctttttgtaagggaaatgctgttaattggtgtttgttcattttgtgaacgaattcagaatttgagtaagctttggttctattttgagagttctagtctc

SEQ ID NO: 3671 - DNA, 885 bp, Helianthus annuus
aacccacgggcaagcaaacaacaaaaacaaccgactgcagttcttcttctttgcactccttcctgcaaaaccaatcctccgatctgatctgagatccaccaccgtccagacgttcgttcaatggctcccgctgttcctagatccggtgacgctatattcgccaacgttgagcgtgtgaacgctgagttgtttactttgacctatggagcgatagtgcgacagttgcttacagatctggaagaggttgaggaagttaataagcagctcgatcaaatgggttacaatattggaatccggctaattgatgagtttcttgcgaaatctaatgtgactagatgtgttgattttagggaaaccgctgaagtcattgccaaggttggcttcaaaatgtttttaggggtaactgcatccgtgagtaactgggatacagagggaacttgttgcagtctcattctggaggataacccgcttgtagactttgtcgagcttccagacacctgtcaaggcttatattactgcaacattttaagtggagttgtcaggggagctctagagatggtgtcgatgaagactgaggtcacatgggtcagggatatgcttagaggagatgatgcatttgagttacaggtgaagcttcttaaacaagttccagaggagtatccatacaaagatgacgagtaacgtgttatctttaatcttgattaatgtatatacattatgatttttgcatttcctttttggtttgtaataaattgataacatgtctttagtactttgacttatgttttgttatgctagaacatgttttgtttccttcatctgggagcattgctgtattgaggatttggatagtattattattgttataagattgttgatgttggc

SEQ ID NO: 3672 - DNA, 629 bp, Acacia harpophylla
gaagcagttcatcgattttgagccgtagctgccatactcctccaagcaagcgaagtgaggtccgacaatggctcccgttggtcctagatccggtgaagcgatttttgcgagtgttgagcgtgtgaatgcagagctatttaccttaacgtatggggcgatcgtgcgtcaattgcttacagatctggaagaagttgaggaggttaacaaacagcttgaccaaatgggttataatattggaatccgtttgattgatgaatttttggctaaatctaatgtttcaagatgtgttgacttcaaggaaactgctgaagtaatagcaaaggtcggttttaaaatgttccttggtgttactgcttctgtgaccaattgggatgctgaaggtacgtgttgcaacattgttttggaggataatcctttggtggactttgttgagcttcctgatacctgtcaaggtctttactattgcaacatattgagtggagttattagaggtgccatggagatggtgtccatgaagactgaggttacatgggtccgtgatatgcttcgaggtgacgacgtgtttgagttacaagtaaaactcctcaagcaagttcctgaagagtacccatacaaggatgacgagtaaa

SEQ ID NO: 3673 - DNA, 937 bp, Malus domestica
tgtaattgcaatctgtcgctgaaaagaaaccttcaaacttctcagtctcagctcagatcaccatgcctccagccggccctcgatctggtgacgcaatctttgccaacgttgaacgcgtgaatgcggagttatttacgttgacgtatggtgcaattgtgcgccagctgctcacggatcttgaggaggttgaagaggttaacaagcagcttgatcaaatgggctataatattggcattcgattaattgatgagtttctagcaaaatctaatgtatctagatgtgttgacttcaaggagacagctgaagtgattgcaaaggttggtttcaaaatgttcttgggggtcaccgcatctgttacaaattgggatgctgatggaacatgttgcagtattgttctggaggacaatcctctggtagactttgttgagcttccagatacttgccaaggtctttactattgcaatatcttaagtggagttgtaagaggggccttagaaatggtatcgatgaagactgaaatcagttggatccgtgatatgcttcgaggagatgatgcattcgagttgcaagttaagctcctcaagcaaattccagaagagtacccgtacaaagatgatgagtaaaatgcttgcacagcgtaacctgagatgtaaactgttttattccttgaaatcaaatgttatgtatttagtatgcattcgcgggcacattgaatagataaccgtgtgtttctttaccctccgttaggttttaccattccgatgaaccatggaaacgactaaatgtgcaatttacatgttttgtgactctcaaccatatttttctttcatgtaatgggttgtaagaaaaacatgtatgttttcaggaaagtgtattgtaacgtgaactaacaatgcattattttactgaaccagaaagtttgtcatcaaaaaaaaaa

SEQ ID NO: 3674 - DNA, 785 bp, Ricinus communis
attgatagatagagcaatcaaagggcacaaaaatctgcttttcaaatttctcagtttagatctctaaaaaagaaaatggctcctgttggtccccgatccggtgacgctatcttcgctagtgttgagcgtgtgaacgcggagctctttacattaacatacggtgcgattgtgcgtcaattgcttacggatttagaggaggttgaggaagttaacaaacagctagatcagatgggttataatattggaattcgactagttgatgagttcttagccaaatctaatgtcaatagatgtgttgactttagggagactgctgaagtcattgcaaaggtgggtttcaaaatgtttctcggggtgagtgcatctgtaaccaattgggatgctgatgggacgtgttgcagtatcattttggaggataatccattggtggactttgttgagcttcccgatacatgtcaaggcttatactactgcaatatcttaagtggagtcattagaggggccctagagatggtgtcgatgaagactgaagtgacatgggctcgtgatatgcttcgaggtgatgacgcatatgagttgcaagtgaagcttctaaagcaagtgccagaagagtacccatacaaggatgatgagtaactcctttcatgtgttctgtataaagttgaacgacttctgatttttctaccctttaatatttctgtccaaatgatataattttaataccttgccttaatcgaatatctgttctcaagaagctacaaatagagttttctcaatgatagtta

SEQ ID NO: 3675 - DNA, 1142 bp, Ricinus communis
aggagacagctagtacaaaaatcaagattcaattgtcttgataaaagagcgtatgtataaatgtaaaggagaaagataaaattgtaaagataaaaaagtgaaagtaaaaatgtactgggtgtaatttcctcttttcaaaacccatatataatggccctgggcctttattttggtttgagctggcataaaatttgggcttgaaattcatttgggcctaatataagaaaattccggcccatattaattcctcttaacaatagtagcgagccagcgagttcattgatagatagagcaatcaaagggcacaaaaatctgcttttcaaatttctcagtttagatctctaaaaaagaaaatggctcctgttggtccccgatccggtgacgctatcttcgctagtgttgagcgtgtgaacgcggagctctttacattaacatacggtgcgattgtgcgtcaattgcttacggatttagaggaggttgaggaagttaacaaacagctagatcagatgggttataatattggaattcgactagttgatgagttcttagccaaatctaatgtcaatagatgtgttgactttagggagactgctgaagtcattgcaaaggtgggtttcaaaatgtttctcggggtgagtgcatctgtaaccaattgggatgctgatgggacgtgttgcagtatcattttggaggataatccattggtggactttgttgagcttcccgatacatgtcaaggcttatactactgcaatatcttaagtggagtcattagaggggccctagagatggtgtcgatgaagactgaagtgacatgggctcgtgatatgcttcgaggtgatgacgcatatgagttgcaagtgaagcttctaaagcaagtgccagaagagtacccatacaaggatgatgagtaactcctttcatgtgttctgtataaagttgaacgacttctgatttttctaccctttaatatttctgtccaaatgatataattttaataccttgccttaatcgaatatctgttctcaagaagctacaaatagagttttctcaatgatagttacaaaatcttatgagcatgattgagtgcagttagtagaatacttaagacagttgtgttgcttggctgaatttatgttttg

SEQ ID NO: 3676 - DNA, 812 bp, Centaurea maculosa
  misc_feature (258)..(258): n is a, c, g, or t
  misc_feature (299)..(299): n is a, c, g, or t
  misc_feature (309)..(309): n is a, c, g, or t
  misc_feature (351)..(351): n is a, c, g, or t
  misc_feature (360)..(360): n is a, c, g, or t
  misc_feature (555)..(555): n is a, c, g, or t
  misc_feature (697)..(697): n is a, c, g, or t
aacggcgcaaatcccttgacgatcttggctgccggcatccagattaatcaataccagtgaagaagacgacgaaattaggagtactgtcttactactacacaactaaccttaatggctcctgctgttcctagatccggagacgccatttttgctaacgtcgagcgcgtcaactctgagctcttcactcttacatatggagccatcgtccgacaattgcttacggatctggaagaggttgaggaagtcaataagcagctngatcaaatgggttataatatcgggattcgtctaattgatgngttccttgcnaaatctaacgtcaccagatgtgttgattttagggagaccgcngaagtcatngcaaaggttggcttcaaaatgtttcttggggtcactgcgtctgtgactaattgggatgtggagggaacgtcttgtagcctcattttggaggataatccacttgtagacttcgttgagcttccagacacttgtcaaggtttatattactgcaacatactaagcggagttgtcaggggagctcttgaaatggtgtcnatgaagaccgaagtcacttgggtgcgtgatatgcttagaggagatgatgcatttgagttgcaggtaaagcttctgaagcaagttccagaggagtacccatacaaagatgatgagtaagttacatacatctatgtatttcttnctcttcaataatatatatacaaagatatatattggttatggatttggttataatgatggatatgttagaatttgttcgtattattgatatggaatttgatgcttcatttcttagt

SEQ ID NO: 3677 - DNA, 898 bp, Mimulus guttatus
ggaggaagatctaagccctgtactattattatctcatggctcccgtcgctccgaagtccggcgatgcgattttcgccagcgttgatcgcgtgaatgcggagctattcacactgacgtatggtgctatcgtgcgccagttactcaccgatctggaggaggtggacgaggtcaacaagcagctcgatcaaatgggttacaatatcggaatccggctggttgatgaatttctcgcaaaatctaatgtttccagatgcgtagattttagagaaactgctgaagtcattgccaaggttggattcaaaatgttccttggtgtcactgcatctgtgacgaactgggactcggagggaacaacctgcagtataattctggaggataaccctctggtagactttgttgagcttcccgataactgtcaaggactatactattgcaacattttaagtggaattatcagaggcgctcttgagatggtgtcgatgaaaactgaggtgacatggctgcgtgatatgctgagaggcgatgatgtgttcgagatgcaggtgaaacttctgaaagcagtccccgaagagtacccgtataaagatgatgagtaacatgcttaatatatatatatatctttctggttttctgtacctcagcaaagtagttcaggtttgtagtacttctcccagaaaaagtttttggcaaaaagcacttatttggttctcgtgctgattttgctgtatggatatttgtagtttgtgttgaatttaagagacttgagctcgaattaagagtaaccactaaccagacctattttacataaattcattgtaccaaaatgtaggcaaagttaaatttagggttgagtttttttaaatattactttcacaattttattttattttcctacgga

SEQ ID NO: 3678 - DNA, 921 bp, Petunia hybrida
atccagtgagaattggagtaaccgatcgcagtagcaaagcaactgaaatagcatggctccagtggcacccagatccggtgacgccattttcgccaacgtcgaacgagtgaacgcagagctgttcactctaacatatggagcaattgtgcgccaattgctcactgatcttgaggaggttgacgaggtcaacaaacagcttgatcaaatgggttataatataggaataaggctaattgatgagttcctagcaaagtctaatgtctcaaggtgtgttgatttcaaggagtctgctgatgtcattgccaaggttggtctcaaaatgttcctaggagtcactgcaacggtgacaaattgggacgttgagggaacaacgtgcagtcttattttggaggacaaccccttggtagactttgttgagctccctgacacctgtcaaggtctatactattgtaacatcttaagtggagtaatcaggggagcattggagatggtgtccatgaaaacagaggtcacatggcttcgtgatatgcttagaggggatgatgcatttgagttgcagctcaagcttctgaagcaagttcctgaggagtacccttacaaagatgacgagtaacgtgctttcttgatgcttcacatgtccaacagcaatataagaactaagaagattccttgccatgcttatcttaaagttttttctattgctttagtgtctcttccaaatttctgctgtggtaaaacaatttacttaagtaaaatctccaactttgacttgactatcccaaggttctcaccatatccctcttatgtgcgtgttaatgggttgagtagctttactgtcatctccattcatctcccaaacgtgtacatggacgtgaaggtctcagtttgaatgttcatcataatctcttggttgaactatag

SEQ ID NO: 3679 - DNA, 951 bp, Prunus persica
tcgaaggcctagctccgacttctgaaaactcgatcgacaactaaaaattgggttgataatccattttgtgtgatttacacagaaacctctgaagttgtcactctcagctcagatcgccatgcctcctgttggccctcgatccggtgacgcaatcttcgctaacgttgaacgcgtgaatgcggagctgtttacgttgacgtatggtgcaatcgtgcgccagctgctcacggaccttgaggaggttgaagaggttaacaagcagctcgaccaaatgggctataatattggaattcgattaatcgatgagtttctcgcaaaatctaatgtatctagatgtgttgacttcaaagaaaccgctgaagtgattgcaaagattggtttcaaaatgttcttgggggtcactgcatctgttacgaattgggatgctgatggaacatgttgcagcattgttctggaggacaatcctctggtagactttgttgagcttccagatacttgtcagggtctgtactattgcaacatcttgagtggagttgtaagaggtgccttagaaatggtatccatgaagactgaaatcagttggatccgtgatatgcttcgaggtgatgatgcatttgaattgcaagttaaactactcaagcaagttccagaagagtacccatacaaagatgatgagtaaaatgccggcgctacgtaacatgatatgtacacagttgtgatttttggttgcacctttccttgaaatcaaatactagcagcttgttttctctgtagtacacattcgcagggcacattgaatggataactgtattttcatttactcgccattttatttttacggtgctatgaacataggctagcatggcaaaccactgaatgctgcatgttttgttcctgtttggttgtaagaacagtcatcgaatgaatctatggactactagagttattcta

SEQ ID NO: 3680 - DNA, 793 bp, Rosa hybrid cultivar
gccagtggaagtccccaacaaagcttggctctaaatttcttctctcccaatcttttccatttccgatttctttctccgactggatctccgaaaaacctttgaagttgtcactgtcgagctcagatcgccatgcctcccgttggtccccgatccggtgatgcaatcttcgctaacgtcgaacgcgtgaatgcggagctgtttactttgacctatggtgccattgtgcgccagctgctcactgatcttgaggaggttgaagaggtcaacaagcagcttgatcaaatgggctataatattgggattcgtctgatcgatgagtttctagcaaaatctaatgtttctagatgcgttgacttcaaagagacagctgaagtaattgcaaagattggcttcaaaatgttcttgggggtcacagcatctgttacaaattgggatgctgatggaacatgctgcagtattgttctggaggacaatcctctggttgattttgttgagcttccagatacttgtcaaggactgtactaccgtaacatcttaagtggagtcgtacgaggtgccttagaaatggtatcaatgaaaactgaaatcacctggatccgggatatgcttagaggtgatgatgcattcgagttgcaagttaaactcctgaagcaagttccggaggagtacccgtacaaagatgatgagtaatatgtttgctatatgtacacagttatgatatttggtcctcttctctccctgaaaatcaaatgttacagttgtttcctctttttcgtacacatccatgtagaac

SEQ ID NO: 3681 - DNA, 865 bp, Salvia sclarea
ctactagaccttggctgtcactcaaaaaagggggaaaacacagttcccgtagaagatctcttcacaatttcttcgaagatctgagctttggagaatcattccacaaatcgctttcgggatctcccctcttctctctcgccctcatggctcccgccgctcccaagtccggtgatgtcatcttcgccagtgtcgatcgcgttaacgcggagctctttactctgacatacggtgctatcgtgcgccagctgattaccgatctggaggaggtggaggaggttaacaagcagctcgatcaaatgggttataatatcggtgtccgtctggttgatgaatttcttgccaaatcaagcgtgtcgaggtgtgtcgatttcagggaaacagctgaagtcattgctaaggttggaatcaaaatgttcctaggagtcactgcatctgtcactaactgggatgcagaagggacagcctgcagtctcattttggaagacaatcctttggtagactttgttgagctgcctgatacctgtcaaggtctccattactgcaatatattaagtggagttgtcagaggggctcttgagatggtctcaatgaaaactgaggtcacatggctgcgtgacatgcttagaggagatgatgtattcgagttgcaagtcaaacttctgaagcaagttcctgaggagtacccatacaaagatgacgagtaatttgcatcttttgctcttaagtggatatagtctatattatccttgtaacttgactcttcatttggatattttgcacctccttttggtctagctacatttccttgctagtaatattacgcggaacgatatcgcccatagttaaaaaagaaaagaatattcac

SEQ ID NO: 3682 - DNA, 877 bp, Helianthus annuus
tcataggcctacctaaatctggacgaaacccacgggcaagcaaacaaccagaacaaccgactgcagcttcttcttctttgcactcctgcaaaaccaatcctccgatccgatctgagatccaccaccgtccagacgttcgttcaatggctcccgctgttcctagatccggtgacgctatcttcgccaacgttgagcgtgtgaacgctgagttgtttactttgacctatggagcgatagtgcgacagttgcttacagatctggaagaggtcgaggaagttaataagcagctcgatcaaatgggttacaatattggaatccggctaattgatgagtttcttgcgaaatctaatgtgactagatgtgttgattttagggaaaccgctgaagtcattgccaaggttggcttcaaaatgtttttaggggtaactgcatccgtgagtaactgggatacagagggaacttgttgcagtctcattctggaggataacccgcttgtagactttgtcgagcttccagacacctgtcaaggcttatattactgcaacattttaagtggagttgtcaggggagctctagagatggtgtcgatgaagactgaggtcacatgggtcagggatatgcttagaggagatgatgcatttgagttacaggtgaagcttcttaaacaagttccagaggagtatccatacaaagacgacgagtaacgtgttatctttaatcttgattaatgtatatacattatgatttttgcatttcctttttggtttgtaataaactgataacatgtctttagtactttgacttatgttttgttatgctagaacatgttttgtttccttcatctgggagcgttgctgtattgaggatttggatagta

SEQ ID NO: 3683 - DNA, 933 bp, Heritiera littoralis
ggctttccttcatagtcaccgcattcactctttcacctgccactgccgtagtgacaacggttgttcttgccgcctcttccggccaccctaacctcccctggcgttcttcttcgcggcttctctctccatttgagcacttccagacctcaagaaaaatagcctcccccggcctcctcgatccggtgacgcgatcttcgccagcgtcgaacgcgtgaatgcagaactgttcactttgacctatggagcaatcgtgcgtcaattgcttactgatttggaggaggttgaggaggtcaacaaacagcttaatcaaatgggctataatatgggaattagactaattgacgagtttctggcaaaatcttatgtgtccagatgtgttgacttcaaggagacagcagaagtgattgcaaaggtgggtttcaaaatgttccttggggtcactgcatctgttaccaactgggatgttgatgggacctgttgcagcattgttttggaggataatccccttgttgactttgtagagcttcctgatacgtgtcaaggtctctactattgcaacatcttaagtggagtcataagaggagccctagagatggtgtcaatgaagactgaagtcacctggatccgcgatatgcttagaggagatgatgcatatgagttgcaggtgaagctcttgaagcaagttcctgaagagtatccgtacaaggacgatgagtaatatgcaaacatagagctagacttaatattttatttttcctttttaacttgtcttcttcatggagagtaggaattcaacaagatttcccctgataaatgttaggcatgccatcatgtaagccgaatggatcttccatttagggcttacattatctatgttctgaattcataaatgttataacgcctgcgctgcattcataaatttcttatctccgt

SEQ ID NO: 3684 - DNA, 685 bp, Fagus grandifolia
aaagctcgattcagatctcacatggctcccgttgctcctcgaaccggtgatgcaatattcgccaacgtcgaacgcgtgaatgcggagctgtttaccttgacgtacggtgcaattgtgcgtcagttgcttacggatctggaggaggttgaggaagtcaacaaacagcttgaccaaatgggttataatattggaataagactgattgatgagtttctagcaaaatctaatgtctccagatgtgttgacttcaaggagacagctgaagtaattgcaaaggttggttttaaaatgttcttaggggtcactgcatctgtaagcaattgggatgctgatggaacatgttgcagtattcttctagaagataatccactggtagactttgttgagcttcctgacacatgtcaaggtctatactattgcaacattttaagtggagttatcagaggggcattagagatggtgtccatgaagactgaagtcacatggcttcgtgacatgcttcgaggtgatgatgcattcgagttgcaggtgaaacttctgaaacaagttccggaggagtatccatacaaagatgatgagtaacatgttaacaaggcttttatgtgatatgtatacaatatatgattcttgtttgttctttcgatcccaaagaatagaatgttggtagcttatcttctcctctaat

SEQ ID NO: 3685 - DNA, 905 bp, Cucurbita pepo
ctttccttcgagctcagttcagaattcggatcaatcatgcctcctgctggtcctcgatctggtgatgcaatcttcgctagcgttgagcgagtgaatgccgagctgtttaccttgacttatggagcgactgttcgtcagttgctcacagatctggaggacgttgaagaagtcaacaaacagctcgatcagatgggctataatattggaatccggttgattgacgagtttcttgcaaaatccaatatctctagatgtgtggacttcaaagagacagctgatgtgattgcaaaggtcggtttaaaaatgtttttgggggtgaatgcatcggtgaccaactgggatgctgaaggcacatgctgcagtattgttctggaggacaatccattagtagactttgttgagcttcctgatgcttgccaaggtcttcattattgcaacatcttaagtggagtcatcagaggagcacttgagatggtgtccatgaaaacagaagtaacatggctacgagacatgctgagaggagacgacatgttcgaattacaagtaaaattgctgaagcaaattcctgaggagtacccatacaaagacgacgagtagcatatctcaaccaggaaaaaggaactcttttatttcatgtcatctgccagtgtgttcatttgatctaaaaacaataggtacattttttgacttctcgaactaatgttactttatcaaagttatattataaatagtcttatgcgacagtgatcaattaagttcaatgtatatagtgaaggacttgaaaaggattcacgttttggttgaggtgcttaggattttgtactgcggtagctgagttgcttgtgtggtgtttaactctttggccatttatggttcatttcttatggattcagttgtctagaact

SEQ ID NO: 3686 - DNA, 765 bp, Euonymus alatus
gcatccgacagagcagaattaggcatcagatcccactcaaagcttagcaccgtccaaagatctctgtgatgcctcctgttgctcctagatccggtgatgcaatcttcgccagcgttgaacgcgtgaatgcggagctgtttacgttgacttatggggcaattgtccgtcagttgcttacggatctggaggaagtcgaagaggtcaacaagcagcttgatcaaatgggctacaatattggaattaggatgatagatgagtttttggcaaagtctggtgtttcacggtgtgttgactttaaggagactgcagaagtgatagcaaaggtgggtttcaaaatgttcttaggggtcactgcttctgttaccaattggaatgctgatgggacatgctgcagtatcgtttttgaggataaccccctggtagagtttgttgagcttcccgacacatgtcaaggtttaaactattgcaacatcttaagtggagtcgttaggggagccctagaaatggtatcaatgaaaacagaagtaacatggacccgtgatatgcttagaggggatgatgcatttgagttacaggtgaaacttgtaaaacaagttccggaagaatatccatacaaggacgatgagtgaacatttaacgctccattcctcttgatctttaaatactatatattttgttaatttctgtgttattttggtcgaaaaacaaaaggaattcacttttcttcctttaatgtagaatattgaggaacatttcatagattac

SEQ ID NO: 3687 - DNA, 893 bp, Sarracenia psittacina
ccgtagcagtgacacacttctgcatgctaagcccgacgggttgctggtgtgagtttctcattcctgtggtagatttcagttttcaatttgatttctactccgagacgattcacggcgatctgtaacagcaaagtaaccgtatctcaaaagctttcttccaatggctccggttgctcctagatctggagacgccattttcgctagcgttgagcgcgtgaacgccgagctcttcaccctaacttatggagccatcgtgcgtcaattactaaccgatctggaggaggttgaggaagtcaacaaacagcttgatcaaatgggttataatatcggagttcgactagttgatgagttcttggcaaaatctaacgtctcaagatgtgttgacttcaaggaaacaagtgaagttattgcaaaggttggtttcaaaatgttcttaggggtcactgcttctgtgacgaattgggatgctgatggaacgtgtttcagtcttattttggaggataacccactggtagactttgttgagcttcctgatacatgtcaaggtctatattactgcaacattttaagtggagttgtcagaggagctctggagatggtgtcgatgaaaactgaagtcacatggatccgagatatgcttagaggagatgatgtgtttgagttgcaggtgaaaccactcaaacaagttcctgaggagtatccatacaaggatgatgaataacacgcttaccaataccctggtacatgctatttttacggttttgtattcttccttgtcgccctctaagaactaagtttttaacctgcattccctcttaattttatagtcttactttcgcttctctattttggaatttgatgattattgtttatcaaatgctattttcaacttg

SEQ ID NO: 3688 - DNA, 866 bp, Helianthus annuus
aacaaccagaacaaccgactgcagcttcttcttctttgcactcctgcaaaaccaatcctccgatctgatctgagatccaccaccgtccagacgttcgttcaatggctcccgctgttcctagatccggtgacgctatattcgccaacgttgagcgtgtgaacgctgagttgtttactttgacctatggagcgatagtgcgacagttgcttacagatctggaagaggttgaggaagttaataagcagctcgatcaaatgggttacaatattggaatccggctaattgatgagtttcttgcgaaatctaatgtgactagatgtgttgattttagggaaaccgccgaagccattgccaaggttggcttcaaaatgtttttaggggtaactgcatccgtgagtaactgggatacagagggaacttgttgcagtctcattctggaggataacccgcttgtagactttgtcgaacttccagacacctgtcaaggcttatattactgcaacattttaagcggagttgtcaggggagctctagagatggtgtcgatgaagactgaggtcacatgggtcagggatatgcttagaggagatgatgcatttgagttacaggtgaagcttcttaaacaagttccagaagagtatccatacaaagacgatgagtaacgtgttatctttaatctcgattaatgtatatacattatgatttttgcatttcgtttttggtttgtaataaattgataacatgtctttagtactttgacttatgttttgttatgctagaacatgttttgtttccttcatctgggagcgttgctgtactgaggatttggatagtattattattgttataagattgttgatgttggc

SEQ ID NO: 3689 - DNA, 727 bp, Malus domestica
ccgtgtcatacccccccccctcctctctctctctctctctctctgatctcaccctcctctccttcctcacgcgggaattgtggactctcactgtaattgcaatttgtcgtttaaaagagaaaccttcaaacctctcgctcttatcttagatcaccatgcctccagttggccctcgatctggtgatgcaatcttcgccaacgtggaacgtgtgaatgcggagttgtttacattgacgtacggtgcgattgtgcgccagctgcttacggatcttgaggaagttgaagaggttaacaagcagcttgatcaaatgggctataatattggcattcgattaattgatgagtttctagcaaagtctaatgtatctagatgtgttgacttcaaagagacagctgaagtaattgcaaaggttggtttcaaaatgttcttgggggtcactgcatctgttacaaattgggatgctgatggaacatgttgcagtattgttctggaggacaatcctctggtagactttgttgagcttccagatacgtgccaaggtctttactattgcaatatcttaagtggagttgtaagaggcgccttagaaatggtatcaatgaagactgaaattagttggatccgtgatatgcttcgaggtgatgatgcattcgagttgcaagttaaactcctgaagcaaattccagaagagtacccgtacaaagatgatgagtaaaatgcttgcac

SEQ ID NO: 3690 - DNA, 941 bp, Taraxacum officinale
cgtatcgtctgtttttcatctggcttttgtccactgcagtgattcctctactcctactcgcaaagatttcctctttggctctctcgctcagcaataccaatccatcacaaccggaggttcgccggtggaagtcgttgaatatctccgacattttcaaggctccaagagtgaatctacagagacctgcttccagtgttcaatagcacgacgagtcgacgactgtagttctccacctaaccaactctaatggctcctgccgttcctagatccggtgacgctatttttgccaacgtcgagcgagtgaacgctgagctgttcactctgacatatggagcgatcgtgcgacaattgcttacagatctggaggaagttgaggaagtcaacaagcagctcgatcaaatgggctacaacattggaatccgtctaatcgatgagtttctcgcaaaatcgaatgtcacaaggtgcgttgattttagagagacagctgaagtcattgcaaaggttggattcaaaatgtttttaggggtcaccgcatctgtaacaaactgggataacgaaggaacttgttgcagtctcatattggaagataatccacttgtggacttcgttgagcttccagatacctgtcaagggttatactactgtaacatcttgagtggagttgttaggggagctctagagatggtgtcgatgaagactgaaatcacatggattagggatatgcttagaggagatgatgcgtttgagttacaggtgaagcttcttaaacaagttccagaggagtatccttacaaagatgacgagtaagatggtttattggatctttatttatgtatatacgatggatatgttgcatttcagtttttgttttgtgagaatatgattttggaaactgtttttgtatttttattttgctagaccttgttttatttgaggggatg

SEQ ID NO: 3691 - DNA, 822 bp, Lotus japonicus
actgcacacagtcacaccatctctcccaaacccatctttctctgccatccgcgcccagccacggtgctcctccgccagcagctgccacgcacggttcctctgggctacgcaaagcaaagctgagtgatctccatcaatggctcctgtagcacctcgatctggcgatgcgatatttgctaacattgaacgcgttaatgcagagctttttactttgacatatggggccattgtgcgtcaattgctcacggatctggaagaggttgaggaggttaacaagcagctagatcaaatgggttataacattggaatccgtttggttgatgagtttttagctaaatctaatgtctcgaggtgcgttgatttcagagagactaccgatgtgattgcaaaggttggttttaaaatgttcctcggtgttactgcatctgtcaccaattgggatgctgaaggcacatgttgcagtattgttttggaggataatcctttggtagactttgttgagcttcctgatacctgccaaggtctgtactactgcaacatcctgagtggagtcattagaggagccttagatatggtttcaatgaagactgaggtcacttggttacgtgacgtgcttcgaggtgatgatgtgtttgagttgcaggtaaaacttctcaagcaagttccagaagagtatccttacaaggatgatgagtagtattctgttttgtaatgttgttctcatctttttcccaaatagattattatctttctgccttttgctgtgtgcattttgatgaaacttcatatacagtagaaaatcttttattaaatcatgatatg

SEQ ID NO: 3692 - DNA, 803 bp, Nicotiana benthamiana
gcacgaggcaggcataaatcgatcggaaaataagcaaatctcagaggcccatggctcccgttgctcctagatccggcgatgccattttcgctaacgttgaacgcgtgaacgccgaacttttcaccctaacgtacggtgcgatcgtgaggcaattgcttaccgatctggaggaggttgaggaggtcaacaaacaacttgatcaaatgggttataacattggaattcggctcattgatgagtttctggcaaaatctaacgtctctaggtgtatcgatttcaaggaaacagctgaagtcattgccaaggttggtctcaaaatgttccttggtgtcacagcaaccgtgggcaactgggatgctgagggaacaacgtgcagtttgattttggaggacaaccccttggtagactttgttgagcttcccgatacttgtcaaggtctatattactgtaacatcttaagtggagtaatcagaggagcattagagacggtgtcaatgaaaacagaagtcacatggatccgtgatatgcttagaggggatgatgcattcgagttgcagctgaaacttctgaagcaagttcctgaggagtatccatacaaagatgacgagtaacagctgaaacgtacaaattttgtattgcttcttttatttggtcttaaagcattttgtgcttcctccctatgtgatctagaaatattaagctccctaaaccctacattggataaaacatttcttggtagtatcactctgtttacatatgatgtattgatgttaatgattacctatccagaatttctttattca

SEQ ID NO: 3693 - DNA, 731 bp, Solanum tuberosum
gaaatcagcagcaaattctcagagcactgataatggctcccgtagctcccagatccggcgacgccattttcgccaacgttgaacgagtgaatgctgaacttttcaccctaacgtacggtgcgatcgtgcgacaactgcttactgatctggaggaggttgaggaagtcaacaaacagcttgatcaaatgggttataacattggaattcggctcattgatgagtttctggcaaaatctaacgtttctaggtgtattgatttcaaggaaacagctgaagtcattgccaaggttggcctcaaaatgttcctaggtgtcacagcaacagtgggaaattggaatgctgagggaacaacgtgcagtttaattctggaggacaaccctttggtagactttgttgagctccctgatacatgtcaaggtctatattattgtaacatcttaagtggagtaatcagaggggcattagagatggtgtcaatgaagactgaagtcacatggatccgtgatatgcttagaggcgatgatgcattcgagctgcagttgaaacttgtgaaacaggttcctgaggagtatccttacaaagacgacgagtaaagctgaaacttatgaattttgtattgcttcttctcgttcgatcttaaagcactgtgttgtgtgatctgaaaatattaagctccctttactctcctccattgtgataaaacatttatttctagtgtttacttacaatgt

SEQ ID NO: 3694 - DNA, 806 bp, Carthamus tinctorius
  misc_feature (125)..(125): n is a, c, g, or t
  misc_feature (649)..(649): n is a, c, g, or t
ggcggggggacatcccttccgatcttcgctgccggcggcatccagatcgactaataccagtgaggaggaaaggaaaccaggaccgtgttactacacaactaacctcacacgaccgccatggctcntgctgttcctagatctggtgatgccattttcgctaacgtcgagcgcgtcaactctgagttgttcacccttacatatggagcgatcgtacgacaattgcttacggatctggaggaggttgaggaagtcaataagcagctcgatcaaatgggttataatatcgggattcgtctaattgatgagttccttgcaaaatctaacgtcaccagatgtgttgattttagggagacagctgaagtcattgcaaaggttggcttcaaaatgtttctaggggtcactgcgtctgtgactaattgggatgtggagggaacgtcttgtagcctcattttggaggataatccacttgtagactttgttgagcttccagacacttgtcaaggtttatactactgcaacatactaagcggagttgtcaggggagctctagaaatggtatcgatgaagactgaagtgacttgggtgcgtgatatgcttagaggagatgatgcatttgagttgcaggtaaagcttctgaagcaagttccanaggagtacccatacaaagatgatgagtaagttacatacatctatgtatttctccctcttcataatatatacatatatatgtatatgctttttatcggttatggatttggttataatgatttatatgttagatttctcgtattattgatatgaaaatg

SEQ ID NO: 3695 - DNA, 816 bp, Solanum phureja
actcataattgatcggaaaaaatcagcagcaaattctcagagcactgataatggctcccgtagctcccagatccggcgacgccattttcgccaacgttgaacgagtgaatgctgaacttttcaccctaacgtacggtgcgatcgtgcgacaactgcttactgatctggaggaggttgaggaagtcaacaaacagcttgatcaaatgggttataacattggaattcggctcattgatgagtttctggcaaaatctaacgtttctaggtgtattgatttcaaggaaacagctgaagtcattgccaaggttggcctcaaaatgttcctaggtgtcacagcaactgtgggaaattggaatgctgagggaacaacgtgcagtttaattctggaggacaaccccttggtagactttgttgagctccctgatacatgtcaaggtctatattattgtaacatcttaagtggagtaatcagaggggcattagagatggtgtcaatgaagactgaagtcacatggatccgtgatatgcttagaggcgatgatgcattcgagctgcagttgaaacttctgaaacaggttcctgaggagtatccttacaaagacgacgagtaacagctgaaactcatgaattttgtattgcttcttctcgttcgatcttaaagcactgtgttgtgtgatctgaaaatattaagctccctttactctcctccattgtgataaaacatttatttctagtgcttacttacaatgttaatgattagctgctaccttgaattattttgccatctcttgcatgtgttctaagttcttctttttc

SEQ ID NO: 3696 - DNA, 789 bp, Nicotiana tabacum
agacataaatcgatcggaaaataagcaaatctcaaagctcacatggctcccgttgctcccagatccggcgatgccattttcgctaacgttgaacgcgtgaacgctgaacttttcaccctaacgtacggtgcgatcgtgcggcaattgcttaccgatctggaggaggtcgaagaggtcaacaaacagcttgatcaaatgggttataacattggaattcggctcattgatgagtttctggcaaaatctaacgtctctaggtgtatcgatttcaaggaaacagctgaagtcattgccaaggttggtctcaaaatgttccttggtgtcacagcaactgtgggcaactgggatgctgagggaacaacgtgcagtttgattttggaggacaaccccttggtagactttgttgagcttcccgatacttgtcaaggtctatattacggtaacatcttaagtggagtaatcagaggagcattagagatggtgtcaatgaaaacagaagtcacatggatccgtgatatgcttagaggggatgatgcattcgaattgcagctgaaacttctgaagcaagttcctgaggagtatccatacaaagatgacgagtaacagctgaaacgtacgaattttatattgcttcttttatttggtcttaaagcattttgtgcttcctctctatgtgatctagaaatattaagctccctaaacaccctacattggagaaaacatttctttgtagtattacactgttatgatgttaatgattagctatccagaatttctttatccaaaaaa

SEQ ID NO: 3697 - DNA, 821 bp, Solanum lycopersicum
actcatagttgatcggaaaaaatcagcaccaaattctcagagctctgataatggctcccgtagctcccagatccggcgacgccattttcgccaacgttgaacgagtgaatgctgaacttttcaccctaacgtacggtgcgatcgtgcgacaactgcttactgatctggaggaggttgaggaagtcaacaaacagcttgatcaaatgggttataacattggaattcggctcattgatgagtttctggcaaagtctaacgtatctaggtgtattgatttcaaggaaacagctgaagtcattgctaaggttggcctcaaaatgttcctaggtgtcacagcaactgtgggaaattggaatgctgagggaacaacgtgcagtttaattctggaggacaaccccttggtagactttgttgagctccctgatacatgtcaaggtctatattattgtaacatcttaagtggagtaatcagaggggcattagagatggtgtcgatgaagactgaagtcacatggatccgtgacatgcttagaggcgatgatgcattcgagctgcagttgaaacttctgaagcaagttcctgaggaatatccttacaaagacgacgagtaacagctgaaacttatgaattttgtattacttcttctcgttcgattttaaagcatcgtgttgtgttatctgggaatattaagctccctttactctcctccattgtgataaaacagttatttttagtgtttacttacaatgttaatgattagcagctaccttgaatttattttgcatctcttgcaggtgttctaagtttctttttttttcttc

SEQ ID NO: 3698 - DNA, 829 bp, Solanum lycopersicum
tagctcactcatagttgatcggaaaaaatcagcaccaaattctcagagctctgataatggctcccgtagctcccagatccggcgacgccattttcgccaacgttgaacgagtgaatgctgaacttttcaccctaacgtacggtgcgatcgtgcgacaactgcttactgatctggaggaggttgaggaagtcaacaaacagcttgatcaaatgggttataacattggaattcggctcattgatgagtttctggcaaagtctaacgtatctaggtgtattgatttcaaggaaacagctgaagtcattgctaaggttggcctcaaaatgttcctaggtgtcacagcaactgtgggaaattggaatgctgagggaacaacgtgcagtttaattctggaggacaaccccttggtagactttgttgagctccctgatacatgtcaaggtctatattattgtaacatcttaagtggagtaatcagaggggcattagagatggtgtcgatgaagactgaagtcacatggatccgtgacatgcttagaggcgatgatgcattcgagctgcagttgaaacttctgaagcaagttcctgaggaatatccttacaaagacgacgagtaacagctgaaacttatgaattttgtattacttcttctcgttcgattttaaagcatcgtgttgtgttatctgggaatattaagctccctttactctcctccattgtgataaaacagttatttttagtgtttacttacaatgttaatgattagcagctaccttgaatttattttgcatctcttgcaggtgttctaagtttcttttttttcttcttc

SEQ ID NO: 3699 - DNA, 927 bp, Flaveria ramosissima
tatatatgaaaccctaattccatactcagacgcttggatcttataattctggtgtagtaccggagttcgattatatctgcgacgaattaagatagattctagagaagacatactatttgtgttcggttgaatcgtgtattgctagctaactaaccaaccgtagaccttcaatggctcctactgttccaagatctggtgatgctatatttgccaacgttgagcgtgtgaatgctgagttgtttactctgacttatggggcaatagtgcgacaattgcttacggatctggaagaggttgaggaagttaataagcagctcgatcaaatgggctataacattggaatccggctaatcgacgagtttcttgcaaaatctaatgtcacaagatgtgttgagtttagggaaaccgctgaagtcattgccaaggttggcttcaagatgtttttaggggtaactgcatctgtgactaactgggatacagaaggaacttcttgcagtctcattttggaggataacccgcttgtcgattttgttgagcttccagacacatgccagggtttatattactgcaacattctaagtggagttgttaggggagctctagagatggtgtcgatgaagactgaagtcacttggggtcagagatatgctaagaagagatgatgccttcgagttacaggtgaagcttcttaaacaagttccagaggagtatccttacaaagatgacgagtaacgtgttttctttcatctttatgatgtatatacaatatgattttcgcatttttgttttggtttgtaataaattaataatgtcttcactactttgtcctacgttttatcatgctagaacatgttttgcttcctctacctgggagtgtgttgctgtaattcaagaatttaatgtcttttgaaagtaccacctttttta

SEQ ID NO: 3700 - DNA, 793 bp, Primula obconica
tcagtactgtagtagtaaaacagatggctcctccgatggtagcgccgagatccggtgatgccattttcgcctccgttgatcgtgttaacgcggagctgttcacactaacctatggtgcgatagtgcgacaactccttactgatctcgaagaggtcgacgaggttaacaaacagcttgatctcatgggttataatattggaattcgattgattgacgaattcttggcaaaatccaatgtctctagatgcgttgattttaaagaaactgctgaagtaattgcaaaggtgggactcaaaatgtttcttggggttactgcttctgtgtccaactgggatgctgatggaacttgttgcagtcttattttggaggataacccccttgtagactttgttgaacttcccgatacatgtcaaggtctatattattgcaatatcttaagtggtgtaatcagaggtgccctagagatggtgtcgatgaagacggaagtcacatggattcgtgatatgcttcgtggggatgatgcttttgagctgcaggttaaacttctgaagcaaattcccgaggaatatccttataaagatgatgagtaatttgttgcacaaactttcttacattgtgtatacaatgaccttcgggtttttgtatatattggtacaattagtagttgctgatattacatttcctgccttttcccttaccgaatttcaacttcattttgtaatgatttttaagctgcaatgtctttccacctgaaatttatttaatttatagtgttttattacactgactttca

SEQ ID NO: 3701 - DNA, 897 bp, Ambrosia trifida
atatttccctcattttgctctgcaaaacccaaccgtcagtcacgatccgttaccgccgttaaatatctccgtcgccgtcagatattattcaatggctcctgctgttcctagatccggtgacgctatattcgccaacgtggagcgtgtgaacgctgagctgtttactttgacgtatggagcgatagtgcggcagttgcttacagatctggaagaggttgatgaagttaataagcagcttgatcaaatgggttacaatattgggatccggctaatcgatgagtttcttgcaaagtctaatgtgactagatgtgttgattttagggaaaccgctgaagtcattgccaaggttggcttcaaaatgtttttaggggtaactgcatctgtgagtaactgggatacagagggaacttgttgcagtcttattttggaggataacccgcttgtagattttgttgagcttccagacacctgccaaggtttatattactgcaacattttaagtggagttgttaggggagctctagagatggtgtcgatgaagactgaagtcacatggatcagggatatgcttagaggagatgatgcattcgagttacaggtgaagcttcttaaacaagttccagaggagtatccatacaaagatgacgagtaacgtgtttcctctaatcttcattaatgtatatacattatgatttctgcatttctgttttggtttgtaataaattgataacatgtctttagtactttgtcctatgttttatcatgctagaacatgttttgtttcctccacctgggagtgttgctgtattgaggatttggatagaacttttagtattattattgtataagattgttaatgtttgctgtggacaaaaaaaagaaaaaagtaccgaactg

SEQ ID NO: 3702 - DNA, 1015 bp, Ambrosia trifida
ctactttttactacgtatttcccttcttttcgtctctctcgcaaaccccaaccgtcgacgatccgttaccacccgttaaactatctccatcaccttcaggtcgggtatcttatcacaacacgatctcatcttttcattccaatacaaatctccacactcatacaaaattaggtctcactttataataactaaataatattaatatcaaactttgtaattatcatccaatccaatcctagacattcaatggctcctgctcttcctagatccggtgacaccatattcgccaacgtggagcgtgtgaatgctgagttgtttactttgacgtatggagcgatagtgcgacagttgcttacagatctggaagaggttgaggaggttaataagcagcttgatcaaatgggttataatattgggatccggctaattgacgagtttcttgccaagtctaatgtcactaggtgtgttgattttagggaaactgctgaagttattgctaaggttggcttcaaaatgtttttaggagtaactgcatctgtgagtaactgggatacagagggaacttgttgcagcctcattttggaggataacccgcttgtagactttgttgagcttccagacacctgccaaggtttatattactgcaacattttaagtggagttgttaggggagctctagagatggtgtcgatgaagactgaagtcacatggatcagggatatgcttagaggagatgatgcatccgagttacaggtgaagcttcttaaacaagttccagaggagtatccatacaaagatgacgagtaacgtgtttcctctaatcttcattaatgtatatacattatgatttttgcatttctgttttggtttgtaataaattgataagatgtctttagtacttggtacctatgttttatcatgctagcctagaacattgttttgttcctccacctaggaatgttgctgtattgagtatttggatagaactttttgtatttattattgttaataaagt

SEQ ID NO: 3703 - DNA, 1169 bp, Phaseolus coccineus
tgaaagaaatatgaatgaaggttgtgaaaaccactgggcttgttgtgggcactgatccaaagtcgcatctttgctcaactcgtcatcgccaagcaaatcgcagcaaagcagagtctgagactgaactccgacgatgcctcccgtcgctcctcgatccggcgatgccatattcgccaacgtcgaacgcgttaatgcggagctgtttactttgacttacggtgcaattgtgcgtcaattgctcacggatctggaagaggttgaggaggttaacaagcagcttgatcaaatgggttataatattggaatccgtttgattgatgagtttttagctaagtctaatgtctcaagatgcaacgatttcaaagagacaactgatgtaattgcaaaggttggttttaaaatgttccttggtgttactgcatctgtgaccaattgggatgctgatgggacatgttgtagtattgttttggaggataatcctttggtagattttgttgagcttcctgacaactgccaaggtctgtactattgcaacatcttaagtggagtcattagaggagccttagatatggtgtcaatgaagactgaggtaacttggctccgtgatgtgcttcgaggtgacgatctgtttgagttgcaggtaaaacttctcaagcatgttccagaagagtatccatacaaagatgatgagtgaatttgtttttgtagtactgtatacccgaggtttttattcattgctgcagtattagattatcatattctgacttgtcctgtgtgtattttgatgaaacactaaaaacagcagaaaatatttaattaaatcattatcatattttgatagtgagctacgatctatatgatttctaggggacctctagattttttcagttcttattacattcctcattatatgttattatagacatgatataaatgttctaactattttattataattaaaaaaaaaacatgtttcatgattaaaaaatatttcagtttggagtccctgtattatcagtaattgtatattcgaattccctgatgcttttttggattgtaattttcctcgggatttaaaaccacttgttaatataaacttcaggcatctgttttgtactctgagatttctcagaggtgccatttgtcgtgcactgatttttctcttctaa

SEQ ID NO: 3704 - DNA, 1044 bp, Cicer arietinum
gcagtacagattgatagaaacagaatcgcgaaaacctttggaaatacttcacagagatcttctcagtcccggccaccgtcaccggtccattttcctacctccgtcttcaccatcaaagatcgctgctcgcttcttcttgcaaatcgtaaccttaatctgcttctctgatctcaatttttcagctctcttgcacagttgaagtaaaacaaagctgagtgagctctaacaatggcccctgttgctcctcgatctggcgatgcgatatttgctaacatcgaacgcgttaatgcagaactgtttactctgacatatggggcaattgtgcgtcaattgcttacagatctggaagaggttgaggaagtcaacaagcaactagatcaaatgggttataacattggaatccgtttgattgatgagtttttggctaaatctaatgtctcaaggtgtgtcgatttcagagagacggctgaggtgattgcaaaggttggttttaaaatgttccttggtgttactgcatccgtgaccaattgggatgctgaagggacgtgttgtagcattgttttggaggataatcctttggtagactttgttgagcttcctgacaactgtcaaggtctgtactactgcaacatattgagtggagtcatcagaggagccttagatatggtgtcaatgaaggctgaggtcacttggctacgtgacgcgcttcgaggagatgatgtgtttgagttgcaagtaaaacttctcaagcaagttccagaagagtatccatataaggatgacgagtaatattctgttgtcatattgtacttcatcatttccgaagtattagtttattatatttctgcctggtgtgcattttgatgaaattaaaagtacaatagaaaatcttcaattaaatcattatgatattggctttgacagcggactaggatctatccttacttctgagagctctttagattcttaaaactgatcttatgggcctgagggagatgttaaatatcagcatactatcagttcacatatatatttgaatcccct

SEQ ID NO: 3705 - DNA, 1094 bp, Eucalyptus grandis
gccaaccgaagcatcgctctccgcacgagggaaatgaacatccatctgtacaagttacgctcgatcaactcgtgcggatcatctctttcggtttggattcgcgggtactgaactgtttggcagaggatacaaacgaatctggtttaagtgacgcatcatccgaccagagctagtttccggttaatagatctctgacgctcacagttgacctctcttcatcactcaatgcccaccgtcggtcctcgatctggtgatgcaatcttcgcaaatgttgagcgagtgaatgcagagctgtttactttaacctatggagcaattgtgcgtcaattgcttacagatctggaggaggttgaggaagtcaacaaacaactcgatcaaatgggttataatataggcactagattgattgatgaatttctagcaaaggctaatatctccagatgtgttgacttcaaggagacagctgaaatgattgctaaggtgggtttcaagatgttcttaggagtcactgcatcagtgaccaattgggacatcgagggaacctgttgcagtgtagttttggaggagaatcccttggtagactttgtggagcttcctgatacatgccaaggcctatattactgcaacgtcttatgtggggtcatcagaggggccttagaaatggtgtcgatgaagactgaagtcacatgggtccgagatgtgctccgaggggatgattcgtatgagttgcaggtgaaacttctgaagcaagtcccggaagagtacccgtacaaagacgatgaataaactcgtctgtttgcagttcatcacgaccttttttctgccttgtgtccgggagggaagtgtcaaatagctaatccgttcccttctgaatgatgtgtttttcttttcagtattggagggatcatcgatgccgatggcttttaggtttcagtcgttatatgcagttactctttgccaaaccgaacccaacatgactgcaaactgactcttgattcttcttcttcttcttcttcttctttcctttgttgacttaattttagaacaaataagatagttaaaagaaatggataatgaactgtagaaggtactga

SEQ ID NO: 3706 - DNA, 806 bp, Linum usitatissimum
gaagctctgtctttactcaccgccgatctatccttctccgtccgaaacaatggctccagctggtccccgatccggcgacgcagtcttcgcttccgtcgagcgcgtgaatgcagagctgttcacgctaacttacggagcgatcgtgaggcagttgctcactgatttggaggaggttgatgaggttaacaagcaacttgatcaaatgggatataacattgggattcggctgatcgacgagttcctagcgaaatcgaatgtctctagatgtgtggactttaaggagacgactgaaaccattgccaaggtggggttcaagatgtttctcggagtcggtgcttctgtgaccaactgggatgctgaggggacttgctgcagcatcgtttttgacgacaatcctcttgtggactttgtcgagcttcctgatacttgtcaggggctttactactgcaacgttctgagcggagtcatcagaggagcccttgaaatggtgtcgatgaaaaccgaagtctcctgggttcgggatgtgctgagaggcgacgacgtgttcgagttgcaggttaagctcataaagcaagttccggaagagtatccatacaaggatgacgagtaaaccatcagttgttgtttttactactgccgctgccttttttatctcctgaggctaacttcttggacctggaatagacaatactccgatgactaaatatgttttgttcaacaattgacaagcttttcattcgattttctcgaccccattctcgtgtgcgatctaagtggcgaaataaagtagatggtaaactttgata

SEQ ID NO: 3707 - DNA, 826 bp, Trigonella foenum-graecum
ccaaattagttttgtccaagtaccccattatcatcctgagtgaaacgcaggaatcacgaaggcagcagtagtcatcaactctgaaccaaagaagcattaagcaaaacaaatctgagtgagctctaacgatggctcctgttgctcctcgatctggcgatgcgatatttgccaacattgaacgcgttaatgcggagctgtttactctgacatatggggcaattgtgcgtcaattgcttacagatctggaagaggttgaggaagtcaacaagcagctagatcaaatgggttataatattggaatccgtttgattgatgagtttttggctaaatctaatgtctcaaggtgtgttgatttcagagagacggctgatgtgattgcaaaggttggttttaaaatgttcctcggtgttaccgcatccgtgactaattgggatgctgaagggacttgttgtagtattgttttagaggataatcctttggtagattttgttgagctccctgacaactatcaaggtctgtactactgcaacatattaagtggagtcattagaggagccttagatatggtgtcgatgaaggctgaggtcacttggctacgcgatgcgcttcgaggtgatgatgtgtttgagttgcaagtaaaacttctcaagcaagttccagaagagtatccatataaggatgatgagtaatatgttatgtaatgttgtacttcataatttcccaagtattagattgttatcttagtactttgagtgcattttgatgaatgaaactataaatacaatagaaaatctttaattaaatcattatgatattggctttgaca

SEQ ID NO: 3708 - DNA, 895 bp, Artemisia annua
gattcctactgatatttccacttttatcactccgtcaaccggaaaatcaaaatctaagatcgccgttgtcacccttcagatctgtaataatggctccagctgtaccgagatctggcgatgccattttcgcaaacgtcgaacgcgtgaatgctgagttgtttacgttgacgtacggtgcgattgtgcgccaattgcttacggatttagaagaggttgaggaagttaataagcagctcgatcaaatgggttacaatattggaattcggctgattgacgagtttcttgctaagtcgaatgtgacgaggtgtgttgattttagggagactgctgaagttattgctaaggttggcttcaaaatgtttctaggggtcactgcatctgtgactaactgggatagtgagggtacttgttgcagtctcattttggaggataatccgcttgtcgactttgttgagcttccagatacctgtcaaggtttatattactgcaacatcttaagtggagtcgtcaggggagctctagagatggtgtcaatgaagactgaaatcacatggatcagggatatgcttagaggagatgatgcattcgagttacaggtgaagcttcttaaacaaattccagaggaatatccatacaaagatgacgagtagcatcctgattgatgtatatacaatataatttttgcatttcccttttggtttgtaataattgatcctcagtactgttctagatttttgttatgctacaacttatttcatctccaacgtttgcgagattgttattgtaattcgagtactgagatagaactattattatcagtttatcacaatgattggtgacatttgtttagccaaaaaaaaaaaaaaaacatgtcggatctagaatctcgcgatat

SEQ ID NO: 3709 - DNA, 814 bp, Cichorium intybus
gcggatttcctctttggctctctcgccctgcaaaccaatccgtccaggctccaagataaaatctagagagacctgctatctgtgttcaatagcacgagtttagtactacctaaccaaccaatcctacacctccaatggctcccgccgttccaagatccggagacgctatttttgctaacgtcgagcgcgtgaacgctgagttgttcactctgacgtatggagcgatcgtgcgacaattgctcacggatctggaggaggttgaggaagtcaataagcagctcgatcaaatgggttacaatattggaatcaggctaatcgatgagtttcttgcaaaatctaatgtcacaagatgcgttaattttagagagacagctgaagtcattgcaaaggttggattcaaaatgtttttaggggtcactgcatctgtgacaaactgggatcaagagggaacttgttgcagtctaattttggaggataatccacttgtagactttgttgagcttccagacacctgtcaaggtttatattactgcaacatcttaagtggagttgtgaggggagctctagagatggtgtcaatgaagactgaaatcacatggattagggatatgcttagaggagatgatgcatttgagttacaagtgaagcttcttaaacaagttccagaagagtatccatacaaagatgacgagtaatgtgctttcttgaactatatttatgtatatacaatatgatttttgcattcccattttcgtttgtgataataggatcttagtactcgtttctatattttataatgctagaacttgctctg

SEQ ID NO: 3710 - DNA, 877 bp, Solanum melongena
aaacaaattaccagtacatacagagagaattccagtgcgttttctttttcttcttaagttagctcaagatatcagttaaccgatcgcaatagtaaaggaactctcatgactccagtggtacccagatccggagacgccattttcgcaaatgtcgaacgagtgaacgcagagcttttcactctaacgtatggagcaatcgtgcgccaactgctgactgatctagaggaggtcgatgaggtcaataaacagcttgatcaaatgggttataatataggaatcaggctcattgacgagtttctagcgaagtctaatgtttcaaggtgtgttgatttcaaggagacagctgaagtcattgccaaggtcggtctcaaaatgttcctaggaatcactgcaacagtgacaaattgggatgttgagggaacaacgtgcagtctgattttggaagataacccattggtagacttcgttgagctccctgatacctgtcaaggcctatattattgtaacatcttaagtggagtaatcaggggagcattggagatggtgtcaatgaaaacagaggtcacatggctacgtgatatgctcagaggggatgacgcatttgagttgcaactgaagcttctgaagcaagttcctgaggagtacccttacaaagatgacgagtaacatgcttttttgatacttctgaatgcctaattctacacatacagatctgtctatcaagtatgtgatctaagtacgagttatgcttaagttctaccattgagttgagtattctgaaggattctagttcaattttcaactgataatttgtgttctgtaattttgagatttttatctgtatctaccatattggaagatctcctctcattcttgc

SEQ ID NO: 3711 - DNA, 873 bp, Lactuca sativa
gtcgtatcgcttttcatctggcttttgtccgactgcagtgattactcaactcctactcggagactttcctctttggctctctcgtcctgcaatagcaattcgtcacaaccagagatcggcggtggaagtggttgaagttgaatatctccggcgctatccaatccaggctccaagattgaatatagggtgacctgctatccgtgttcaatagctaaccaacaaatcgtatacctccgatggctcccgccgttccaagatccggtgacgctattttcgccaacgtcgagcgcgtgaacgccgagctgttcactctgacatatggagcgatcgtgcgacaattgcttacagatctggaggaggttgaggaagtcaataagcagctcgatcaaatgggttacaatattggaatccggctaattgatgagtttcttgcaaaatctaatgtcacaagatgtgttgattttagggagacagctgaagtcatagcaaaggttggcttcaaaatgttcttaggggtcactgcatctgtgacaaactgggataatgaaggaacttgttgcagtctcattttggaagataatccacttgtggattttgttgagcttccagataattgtcaaggtttatattactgcaacatcttaagtggagttgtcaggggagccctagagatggtgtcaatgaagactgaaatcacatggattagggatatgcttagaggagatgatgcatttgagttacaagtgaagcttcttaaacaagttccagaggagtatccatacaaagatgatgagtagtgtgtttttcttgaatctttatttatgtatatacagtatgatttttgcattcttgttttcgtctgtgataatagaa

SEQ ID NO: 3712 - DNA, 852 bp, Mimulus guttatus
attgttaattcgaagatccaagctctctcttcccatctgcaatggctcccgccgctcccaagtccggcgatgcgattttcgccagcgtcgatcgcgtgaatgcagagctgtttactttgacgtacggcgctatcgtgcgccagctgctcaccgatctcgaggaggtggaggaggtcaacaaacagctcgatcaaatgggttataacatgggtgttcgtcttgttgatgaatttctggcaaaatcgaatgtgacgagatgtgtcgatttcagagaaacaactgaagtcattgctaaggttggattcaaaatgtttctaggggtaactgcatctgtcaccaactgggacagtgaagggacaacctgcagtctgattttggaggataatcctttggtcgactttgttgagcttcccgataattgtcaaggtcttcactattgcaacattttaagtggagttgttagaggagctcttgagatggtgtcgatgaaaactgaggtggcatggctgcgtgacatgcttagaggggacgatgtatttgagttgcaagtgaaacttctgaagcaagtacctgaggagtacccctataaagatgatgagtagcgtgctttctttgcttttaagtccataaaatctattgtcgttgtgatttctctctcctctggtttagttacctctagccagtaatttgatgtggaacatttttcgagaaaaattactactgcgtagcttgttgcagacttgtaaaaattgaaccttccggcctaggtcctcttataattttcttctcattaatttgcgcagtttttataataagtaagattttctcagtttttactactcttttaaatac

SEQ ID NO: 3713 - DNA, 868 bp, Pisum sativum
acgcagttacgaaaatagcctcaaatcagtttctccaagtcccctccgtgaaacgcaggaatcgcgtaaggcagcagtgagcaatcatcagtcatcactcatcaccgactaccgagatttgcacaacgccaaagctaaacaaatctgagtgagctttaaggatggctccggttgctcctcgatctggcgatgcgatatttgctaacatcgaacgcgttaatgcggagctgtttactctgacatatggggcaattgtgcggcaattgcttacagatctggaagaggttgaggaagtcaacaaacagctagatcaaatgggttataatattggaatccgtttgattgatgagtttttggctaaatctaatgtctcaaggtgtgttgatttcagagagaccgctgatgtgattgcaaaggttggttttaaaatgtttctcggtgttactgcatccgtgaccaattgggatgctgaaggaacttgttgtagtattgttttggaagataatcctttggtggactttgttgagcttcctgacaactaccaaggtctgtactactgcaacatattaagcggagttattcgaggagccttggatatggtatcaatgaaggctgaggtcacttggctacgtgatgcgcttcgaggtgatgatgtgtttgagttgcaagtaaaacttctcaagcaagttccagaagagtatccatataaggatgatgagtagtaatgttctgttttgtattgttgtacttcatcatcccaggtattagattattattatctttctgccttgtgtgcattttgacaaaactaaaaatacgatagaaaatatttaattaaatcattatgataattgggattttatagatt

SEQ ID NO: 3714 - DNA, 856 bp, Solanum tuberosum
gcaatagcagaggaactctcatggctcctgtggcacccagatccggagacgccattttcgccaacgtcgaacgagtgaacgcagagcttttcactctaacgtatggagcaatcgtgcgccaactgctgactgatctagaggaggttgatgaggtcaataaacagcttgatcaaatgggttataatataggaatcaggctcatagacgagtttctggcaaagtctaatgtttcaaggtgtgttgatttcaaggagacagctgaagtcattgccaaggtcggtctcaaaatgttcctaggaatcactgcaacagtgacaaattgggatgttgagggaacaacatgcagtctaattttggaggataaccccttggtagacttcgttgagctccctgatacctgtcaaggtctatattattgtaacatcttaagtggagtagtcaggggagcattggaaatggtgtcaatgaaaacagaggtcacgtggcttcgtgatatgctcagaggggatgacgcatttgagttgcaactgaagcttctgaagcaagttcctgaggagtacccttacaaagatgacgagtaacatgcctcctttttaatgcttgccatttggagttctacgacaatctatagaaaatgcctgaaatctacacacacagatctctgtctattattgagtatgtaattaagtacgagttaagtttaagttctactactgagttcagttttctgaaggattcttgttcaattttcaactgatgatctgtgctctgtaattttgagatttatctgtatctatcagattggaagatctcctatcattcatggattttataggtcattattttttgctcttgt

SEQ ID NO: 3715 - DNA, 937 bp, Solanum phureja
aattactatgtgtgctttaaaagtggtacaagtgtatacgtgcttatatacttgtactttctctacaaaataaaccagtaaaatcaccagcacgtatgtgttctcttcttagttagctcaacatagcaattaaccgatcgcaatagcagaggaactctcatggctcctgtggcacccagatccggagacgccattttcgccaacgtcgaacgagtgaacgcagagcttttcactctaacgtatggagcaatcgtgcgccaactgctgactgatctagaggaggttgatgaggtcaataaacagcttgatcaaatgggttataatataggaatcaggctcatagacgagtttctggcaaagtctaatgtttcaaggtgtgttgatttcaaggagacagctgaagtcattgccaaggttggtctcaaaatgttcctaggaatcactgcaacagtgacaaattgggatgttgagggaacaacatgcagtctaattttggaggataaccccttggtagacttcgttgagctccctgatacctgtcaaggtctatattattgtaacatcttaagtggagtagtcaggggagcattggaaatggtgtcaatgaaaacagaggtcacgtggcttcgtgatatgctcagaggggatgacgcatttgagttgcaactgaagcttctgaagcaagttcctgaggagtacccttacaaagatgacgagtaacatgcctcctttttaatgcttgccatttggagttctacgacaatctatagaaaatgcacacacagatctctgtctattattgagtatgtaattaagattcttgttcaattttcaactgatgatctgtgctctgtaattttgagatttatctgtatctatcagattggaagatctcctatcattcatggattttataggtcattattttttgctcttg

SEQ ID NO: 3716 - DNA, 874 bp, Tragopogon dubius
tagcagattttccctctttgcctctctcgccctgcaaaccaaatctgtcacgacctgagatcgtcggtggaaggccgtgaatatttgcgtgatcgtccaggctccgagattgaatctagagagaccttctgtctgtgttcaattgcgcgactgtattaccaactaatcaaccaatcgtagacctccaatggctcccgcggttccaagatccggtgatgctattttcgccaacgtcgagcgcgtgaacgctgagttgttcactctgacatatggagcgatcgtgcgacaattgcttacggatctggaggaggttgaggaagtcaataagcagctcgatcaaatgggttacaatattggaatccgactaatcgatgagtttcttgccaaatctaatgtcacaagatgtgttgattttagggagacagcagaagtcattgcaaaggttggcttcaaaatgtttctaggggtcactgcatctgtgacaaactgggacatggatggaacttgttgcagtctcattttggaagataatccattagtagactttgttgagcttccagatacctgtcaaggtttatattactgcaacatattaagtggggttgttagaggagctttagagatggtgtcaatgaagactgaaatcacatggattagggatatgcttagaggagatgatgcatttgagttacaagtgaagcttttgaaacaagttccagaggagtatccatacaaagatgatgagtaatgtgctttcttgaatctctttaatgaatgtatatacaatatgattttatgcattcccatttccatttgtaataataggattttagtacttggtttattttgttttatgctagaacttggttctatg

SEQ ID NO: 3717 - DNA, 674 bp, Ambrosia trifida
gatttatttccctcttttgctctcttgacctgacctgacctgcaaaacccaaccgtcattcgcaatccattaattacccccccttgtccgtcgtcaccgtccagatatttaatggctcccgctgttcctagatccggtgacgctatttcgccaacgttgagcgcgtcaatgctgagttgtttacgttgacgtatggagcgatagtgcgtcagttgcttacagatctggaagaggttgaggaggttaataagcagcttgatcaaatgggttataatattgggatccggctaatcgacgagtttcttgccaagtctaatgtcactagatgtgttgattttagggaaactgctgaagtcattgccaaggttggcttcaaaatgtttttaggggtaacggcatctgtgagtaactgggatacagagggaacttgttgcagtcttattttggaggataacccgcttgtagactttgttgagcttccagacacctgccaaggtttatattactgcaatattttaagtggagttgttaggggagctctagagatggtgtcgatgaagactgaagtcacatggatcagggatatgcttagaggagatgatgcattcgagttacaggtgaagcttcttaaacaagttccagaggagtatccatacaaagatgacgagtaacag

SEQ ID NO: 3718 - DNA, 758 bp, Flaveria ramosissima
tctggtgtagtaccggagttcgattatgcctgcgacgaattaagatagattctcgagacgacatacaatttgtgttcggttgcatcgtttattgctagctaactaactaactgtagaccttcaatggctccttctgttccaagatctggtgatgctatatttgccaacgttgagcgtgtgaatgctgagttgttcgctctgacttatggggcaatagtgcgacaattgcttacagatctggaagaggttgaggaagtcaataagcagctcgatcaaatgggctataacattggaatccgactaatcgacgagtttcttgcaaaatctaatgtgacaaggtgtgttgagtttagggaaaccgctgaagtcattgccaaggttggcttcaagatgtttttaggggtaactgcatctgtgactaactgggatacagaaggaacctcttgcagtctcattttggaggataacccacttgttgactttgtcgagcttccagacacatgccaaggtttatattactgcaacattctaaatggagttgttaggggagctctagagatggtgtcgatgaagactgaagtcacttgggtcagggatatgctaagaggagatgatgccttcgagttacagtgaagcttcttaaacaagttccagaggagtatccttacaaagatgacgagtaacgtgttttctttcatctttatgatgtatatacaatatgattttcgcatttttgttttggtttgtaataaattaat

SEQ ID NO: 3719 - DNA, 797 bp, Papaver somniferum
tccaagatctggagatgcaattttcgctaatgttgaacgtgtgaatgcagagttgtttagcttaacatatggagcaatggtaagacaattgcttaccgatttagaagaggtagaggaagttaacaagcagcttgatcagatgggttataatattggaattcgactaattgacgagtttcttgcaaaatccaatgtttctagctgtgctgacttcaaggatctgctgatgtaattgcaaaggttggttcaagatgttcttaggggtcactgcactgtagccaattgggatgctgatggaaccagttgcagtctcatcctggaggataacccccttgtagactttgttgagcttcctgacacatgccaaggtctatattattgcaatgtccttagcggagtcatcagaggagctctagagatggtgtcaatgaagactgaagtcacatgggttcgtgatatgttgcgtggagatgatgcatacgagttaagagtgaagcttctgaagcaagttcctgaagagtacccgtacaaagacgacgagtaagttctgacagtctgcattagtaatttcagttttttggtgcaatgttaaaaaaaaatcgtctccaaatcatcagaagtttttatacttctgctctttgctcgtaatgatttctacacaaacaagctctcttagaaaccttgctagaatggtaatttttgggtgtttaactttctactttagtagtaaacatcaattgtttccgtgtctttaaagtccatttgtttcactaaatttaccgtgtaggattgaacca

SEQ ID NO: 3720 - DNA, 1353 bp, Eucalyptus grandis
cgccgcgtcggtttcagggctcctcctgcgccatcagaaagtttcagatcgccaccagtagccagtgcggaggtgccttgcagcagtcgaagctctctctctctctctccagctatgtcgcgtgcttcaggtcctcgatcaggcgacgcgatcttcgccagcgtcgagcgagtgaatgcggaactgtttacgttgacgtatggagcgatcgtgcgccagttgctcacggatctggaggaggtagaggaagtcaacaaacagctcgatcaaatgggttataacattggaatacgactcattgacgaatttctagctaaatcaaatgtcggcagatgtgttgactttaaggagacagcagaaatgattgcaaaggtgggttttaaaatgttcctaggagttactgcctctgtgaccaattgggatgcggatggtacctgttgcagtatagttttggaggataatcccttggttgactttgtcgaacttccagatacatgtcaaggtctatattattgcaacatcttgagtggggtcataagaggagctttggagatggtttcaatgaagacggaagtaacatggattcgtgatgtgcttcgaggggatgatgcgtttgagttacaagtgaaactcctgaagcaagttcccgaagagtacccatacaaagatgatgagtgacatggatgatactcctccgcccgacccttgtccaattgctttgtttatagataggagcatgctagaaccgttttcctcttgggagtatgcattactttctttccttcgtggctttcttctcttttctgttggggtgaactttgctgcgctgtactcaaagggggatgacgcccatctagtcactgggagacagggtagtaacggtgaaaaagcaaataaatagatttcaaagttttattcagaggatcgaagtaatgatacagtttaacgatgaaggagcagccttgaattgtgtgccatacctttaattgattatcaaactttaggccctctccgctagctgctatcgaacgaagaatgttaaccaggcggtagcctggcattgtcacgacccggaccagaccaagcagcttgtgaaatgacacagagaggtgcaaagggaaagggctgttacaaatttgtaatttacccaaccggcaataacagctcgagcttagaagcattacatttaaatgcgaataactccatgtccgaggcccaagggatcgggactggaagcataaggaccgagtccttacatgttgaatgttggtagtttgtttataaaacaaatgaagaggtgccttgtcccacatcaaaaagatgtgagtgtgcatgtggatgagatttggcact

SEQ ID NO: 3721 - DNA, 903 bp, Eucalyptus grandis
aggcctcctcctgcgccatcagaaagtttcagatcgccaccagtagccagtgcggaggtgccttgcagcagtcgaagctctctctctctctctccagctatgtcgcgtgcttcaggtcctcgatcaggcgacgcgatcttcgccagcgtcgagcgagtgaatgcggaactgtttacgttgacgtatggagcgatcgtgcgccagttgctcacggatctggaggaggtagaggaagtcaacaaacagctcgatcaaatgggttataacattggaatacgactcattgacgaatttctagctaaatcaaatgtcggcagatgtgttgactttaaggagacagcagaaatgattgcaaaggtgggttttaaaatgttcctaggagttactgcctctgtgaccaattgggatgcggatggtacctgttgcagtatagttttggaggataatcccttggttgactttgtcgaacttccagatacatgtcaaggtctatattattgcaacatcttgagtggggtcataagaggagctttggagatggtttcaatgaagacggaagtaacatggattcgtgatgtgcttcgaggggatgatgcgtttgagttacaagtgaaactcctgaagcaagttcccgaagagtacccatacaaagatgatgagtgacatggatgatactcctccgcccgacccttgtccaattgctttgtttatagataggagcatgctagaaccgttttcctcttgggagtatgcattactttctttccttcgtggctttcttctcttttctgttggggtgaactttgctgcgctgtactcaaagggggatgacgcccatctagtcactgggagacagggtagtaacggtgaaaaagcaaataaatagatttcaaagttttattc

SEQ ID NO: 3722 - DNA, 700 bp, Euonymus alatus
cggccggggctatttgtttatcaactaactcagtaacttccatttgtgcatccgagagagcagaattaggcatcagatcccactcaaagcttagtaaagtccaaagatctctgtgatgcctcatgttgctcctcgatccggtgatgcaatcttcgccagcgttgaacgagtgaatgcggagctatttacgttgacttatggggcaattgtccgtcagttgcttacggatctggaggaagtcgaagaggtcaacaagcagcttgatcaaatgggctacaatattggaattaggatgatagatgagtttctggcaaagtctggtgtttcacggtgtgttgactttaaggagactgcagaagtgatagcaaaggtgggtttcaaaatgttcttaggggtcactgcatctgttaccaattggaatgctgatgggacatgctgcagtatcgtttttgaggataatcccctggtagagtttgttgagcttcccgacacatgtcaaggtttaaactattgcaacatcttaagtggagtcgttaggggagccctagaaatggtatcaatgaaaacggaagtaacatggacccgtgatatgcttcgaggggatgatgcatttgagttacaggtgaaacttataaacaagttccggagaatatccatacaaggatgatgagtaaacatttaacgctccttgccttttgta

SEQ ID NO: 3723 - DNA, 764 bp, Linum usitatissimum
ccaaaaagctcgaagctctgttctttactcaccgcagttcccaactcaccgccgatctatccttctccgtccgaaacaatggctccagctggtccccgatccggcgacgcaatcttcgcttccgtcgagcgtgtgaatgctgagctgttcacgctaacttacggagcgatcgtgaggcagttgctcactgatttggaggaggttgatgaggtgaacaagcaacttgatcaaatggggtacaacattgggattcggctgatcgacgagttcctagcgaagtcgaatgtctctagatgcgtggactttaaggagacgactgaaaccattgccaaggtggggttcaagatgtttctcggagtcggtgcttctgtgaccaactgggatgctgaggggacttgctgcagcatcgttttcgacgacaatcctctggtggactttgtcgagcttcctgatacttgtcaaggcctttactactgcaacgttctgagcggagtcatcagaggagcccttgaaatggtgtcgatgaaaaccgaagtctcctggcttcgggatgtgctgagaggcgacgatgtgttcgagttgcaggttaagctcataaagcaagttccggaagagtatccatacaaggatgacgaataaaccatcatttgttgtttttttactcgtcccactgccttgtttatctgctgaggctaacttcttggacctggaatagacaatactcagatgactaagtatgttttggttcaacagttgacgagctt

SEQ ID NO: 3724 - DNA, 808 bp, Carpinus betulus
agtctctcgaaccaaaactcgaagtaccaaagcaaacctctgcagctagactcagatccacaatggctcctgttggtcctcgaactggtgacgcaatcttctccaacgttgagcgtgtgaatgctgagctgtttaccttgacgtacggggcgattgtgcgccaattgcttacggatctggaagaggttgaggaagtaaacaaacagcttgaccaaatgggttataatattggaattcgactgattgatgagtttctagcaaaatctaatgtctctagatgcatcgacttcaaagagacagctgaaacaattgcaaaggttggttttaaaatgttcttaggggtcactgcatctgtcaccaattgggatgctgatgggacatgttgcagtatcgttttggaggataatcctctggtagactttgttgagctccctgatacatgtcaaggtctatactattgcaacattttaagtggagtcatcagaggagccttggagatggtgtcaatgaagactgaagtcacatgggtccgtgacacgctgcgaggagatgatgcatttgagttgcaggtgaagcttttgaagcaagttcccgaagagtacccgtacaaagatgatgagtgacatgccaaaaggcctcgtatgtgatatgtacacaatacatgattcttgtctcttctctgtctcccaaagagtagaatgttggtagcctggcttctcgtctaatacacgtttcttacttttaagtcaattttaattccttttatctatatgccattgttagaagggattatgagtgagcatgacaa

SEQ ID NO: 3725 - DNA, 968 bp, Beta vulgaris
gttttatatgagtataacaaagaattagacctctggttcttcgtttgtgactctagaaaaacagtttgtgaagggcaggcagtgagatcagaaacaacaaaatgccggctgttcctccacgttccggggaagccatcttcgccagtgctgaacgagttaatgcggagttgtttacattaacttatggagctatagttcgtcaactcattacggatctggaagaggttgatgaagttaacaagcagcttgatcaaatgggttataatattggtgtgcgactgattgatgaattcctagcaaagtccaatgtcactagatgtgtggactttaaagagactgctgaagtaattgcgaaggtgggcttcaaaatgtttctgggggtgagtgcaacagtcaccaattgggatgcagaaggaacaacttgcagctttgtcttggaggacaatcctttggtagattttgttgagcttcctgacacgtgccaaggacttcactattgtaatgttctaaatggtgttatcagaggagccctggagatggtatcaatgaagactgaagtaacgtggatccgtgatatgctacgtggggatgatacttatgaattacaagttaaacttctgaagcaaattccagaagaatacccatacaaggatgatgagtgatgtcgaacttctcgaagctgttatgtacattcacttccaacttttgggtgcctacttttccatcaccatccatttagttctggaacattcaattgaatccgttcactcctcattctgaacttagctagcatgtggtacctgttgggtacttgctatagttattacttttatgtggcagtaatgccgtttgtaatagaattgcgcaagaactaaagaactttatggatcctgcttgcgtttgatgcagttgcttttatccaacttgttgcggggtctatgttggttttcgtttgatcatctctctca

SEQ ID NO: 3726 - DNA, 906 bp, Beta vulgaris
tctggttcttcgtttgtgactctagaaaaacagtttgtgaagggcaggcagtgagatcagaaacaacaaaatgccggctgttcctccacgttccggggaagccatcttcgccagtgctgaacgagttaatgcggagttgtttacattaacttatggagctatagttcgtcaactcattacggatctggaagaggttgatgaagttaacaagcagcttgatcaaatgggttataatattggtgtgcgactgattgatgaattcctagcaaagtccaatgtcactagatgtgtggactttaaagagactgctgaagtaattgcgaaggtgggcttcaaaatgtttctgggggtgagtgcaacagtcaccaattgggatgcagaaggaacaacttgcagctttgtcttggaggacaatcctttggtagattttgttgagcttcctgacacgtgccaaggacttcactattgtaatgttctaaatggtgttatcagaggagccctggagatggtatcaatgaagactgaagtaacgtggatccgtgatatgctacgtggggatgatacttatgaattacaagttaaacttctgaagcaaattccagaagaatacccatacaaggatgatgagtgatgtccaacttctcgaagctgttatgtacattcacttccaacttttgggtgcctacttttccatcaccatccatttagttctggaacattcaattgaatccgttcactcctcattctgaacttagctagcatgtggtacctgttgggtacttgctatagttattacttttatgtggcagtaatgccgtttgtaatagaattgcgcaagaactaaagaactttatggatcctgcttgcgtttgatgcagttgcttttatccaacttgttgcggggtc

SEQ ID NO: 3727 - DNA, 959 bp, Cicer arietinum
attctggaaatattcacagagatcttctcagtcccggccaccgtcaccggtccattttcctacctccgtcttcaccatcaaagatcgctgctcgcttcttcttgcaaatcgtaaccttaatctgcttctctgatctcaatttttcagctctcttgcacagttgaaggaaaaagtggttgttctcacagtttcccaataactgcaacaaagttccaacgaataaccaggaatcggaaattggcgatattgtaaaacaaagctgagtgagctctaacaatggcccctgttgctcctcgatctggcgatgcgatatttgctaacatcgaacgcgttaatgcagaactgtttactctgacatatggggcaattgtgcgtcaattgcttacagatctggaagaggttgaggaagtcaacaagcaactagatcaaatgggttataacattggaatccgtttgattgatgagtatttggctaaatctaatgtctcaaggtgtgtcgatttcagagagacggctgaggtgattgcaaaggttggttttaaaatgttccttggtgttactgcatccgtgaccaattgggatgctgaagggacgtgttgtagcattgttttggaggataatcctttggtagactttgttgagcttcctgacaactgtcaaggtctgtactactgcaacatattgagtggagtcatcagaggagccttagatatggtgtcaatgaaggctgaggtcacttggctacgtgacgcgcttcgaggagatgatgtgtttgagttgcaagtaaaacttctcaagcaagttccagaagagtatccatataaggatgacgagtaatattctgttgtcatattgtacttcatcatttccgaagtattagtttattatatttctgcctggtgtgcattttgatgaaattaaaagtacaatagaaaatcttcaatcaaaagaattcgaat

SEQ ID NO: 3728 - DNA, 818 bp, Cichorium intybus
cattggcgggggatggaaacgattaatgaaccacttcctcctccccagtcccctgccgtttaatcaaaagccccccgctcccttaatttgtaaactctccgagagagtgaacggcgaacaatccggtcaaattcgccgcttccggctgccgtcgtccggaatatacagaagaaatccataagcaattaagtacgactgtattacgaaagatctaaccgtagacttcgatggctcccgctgttcctagatctggagatgccattttcgctaacgtcgagcgcgtgaactctgagctgttcactctgacgtatggagcgatcgtgcgacaattgcttacggatctggaggaggttgaggaagtcaataagcagctggatcaaatgggttataatatcgggatccgtctaattgatgagttccttgcaaaatccaatgtgactagatgtgttaattttagggagactgctgaagtcatcgcaaaggtcggcttcaagatgtttttaggggtgactgcaactgtgactaactgggattcagagggaacttcgtgtagcctcattttggaggataatccacttgtagattttgttgagcttccagagacttgtcaaggtttatattactgcaacattctaagtggagtagtcagaagagctctagaaatggtgtcaatgaagactgaaatcacatgggtgcgtgatatgcttagaggagacgatgcatttgagttgcaagtaaaactcctgaagcaagttcctgaggagtatccctatgaagatgatgagtaaaaatgttttcttgatttatgttccctgttc

SEQ ID NO: 3729 - DNA, 1069 bp, Citrus sinensis
ggggcggtcgagtcattggtattgcactgggacattgaggcgagctaaggaggaagaagataaaaaacctataaattctggtgatcaaatttagttatcgctttgcagagatctcataatggctcccgttggtcctcgatccggtgacgcaatcttcgccaacgtggaacgcgtgaatgctgagctgtttacattaacttacggcgccactgtgcgtcagctgctcacggatctggaggaggttgaggaagttaacaaacagcttgatcaaatgggctataatattgggattcgactgattgatgagtttctagcaaaatctaatgtcactaggtgtgtagacttcagggagactgctgaagtgattgcaaaggtgggtttcaaaatgtttttaggggttactgcaaccgtgagcaactgggatgctgatgggacatgttgcagtataattttggaagataatcctctggtggattttgttgagcttcctgatacttgtcaaggcctttattattgcaacatcttgagtggagtcattagaggggccctagagatggtttcaatgaaaactgaagtcacttggatccgcgatgtgcttcgaggggatgatgcatatgagctgcaggtgaaacttctgaaacaagtcccagaagaatatccatacaaggatgatgagtaatatcctgtcttggtgcctgatgcggacataccgagtttacattcttgcacttcattttccctaaagaatatcagttttaacagcttgttctctgtataaatattcacttgggagaaactttgaataggttttccgttttcaaatgcatggtaatgctttcagattaaaaaaaaaaaaaaaaaaaaaaaaaacccatctttcgttggcaaaattgggcaaataaaaaaggattgcttattaattttgttgccacgaatgaggtcaaaataaggtataaataaaacaataaattggctccccaccaatacccccctatagttaaataacaattgtaagagactaaacgttatccacggaaacccccacaacaaaaactataaaaattatcca

SEQ ID NO: 3730 - DNA, 1037 bp, Citrus clementina
agatactttcggtcgagtcattggtattgcactgggacattgaggcgagctaaggaggaagaagaaaaaaaacctataaattctggtgatcaaatttagatatcgctttgcagagatctcataatggctcccgttggtcctcgatccggtgacgcaatcttcgccaacgtggaacgcgtgaatgctgagctgtttacattaacttacggcgccactgtgcgtcagctgctcacggatctggaggaggttgaggaagttaacaaacagcttgatcaaatgggctataatattgggattcgactgattgatgagtttctagcaaaatctaatgtcactaggtgtgtagacttcagggagactgctgaagtgattgcaaaggtgggtttcaaaatgtttttaggggttactgcaaccgtgagcaactgggatgctgatgggacatgttgcagtataattttggaagataatcctctggtggattttgttgagcttcctgatacttgtcaaggcctttattattgcaacatcttgagtggagtcattagaggggccctagagatggtttcaatgaaaactgaagtcacttggatccgcgatgtgcttcgaggggatgatgcatatgagctgcaggtgaaacttctgaaacaagtcccagaagaatatccatacaaggatgatgagtaatatcctgtcttggtgcctgatgcggacatacggagtttacattcttgcacttcattttccctaaagaatatcagttttaacagcttgttctctgtatgaatattcacttgggagaaactttgaataggttttccgttttcaaatgcatggtaatgctttcagatttatcagctttctgaacaaagccccgcaaacattaaaatcacgcatgagaaattagaagttccaccgggagaaacattgatgcattttcccccaattctttcccatcaaagttgcagtcaagctcgtggtggttgaatagtaggcaatttccacatcatcaattggtccacatggcaccattttctgag

SEQ ID NO: 3731 - DNA, 833 bp, Solanum melongena
accttatgcaatatttactcatttctctctaattctacaaaattcaacttcgtaaactagctaactcataatcggtcggaaagaaaatcagcagcaaattctcagagctttcataatggctcccgttgctcctagatccggcgacgccatttttgccaacgttgaacgagtgaatgctgaacttttcactctaacgtatggtgcgattgtgcgacaactgcttactgatctggaggaggttgaggaagtcaacaaacagcttgatcaaatgggttataatattggaattcggctcattgatgagtttctggcaaaatctaacgtttctaggtgtattgatttcaaggaaacagctgaagtcattgccaaggttggcctcaaaatgttcctaggtgtcacagcaaatgtgggaaattggaatgttgagggcacgatgtgcagtttaattctggaggacaaccccttggtcgactttgttgagctccctgatacatgtcaaggtctatattattgtaacatcttaagcggagtaatcagaggggcattagagatggtgtcgatgaagactgaagtcacatggattcgtgatatgcttagaggggacgatgcattcgagctgcagctgaaactactgaagcaagttcccgaggagtatccttacaaagacgacgagtaacagctgaaacttctgaattttttattgcttcttagtttgatcttaaagcacattgtgttaatgtgatcttgaaatattaagctcccataaccctctgtgataaaacatttctttctagagttcacttacaatatttatggttagtagctgcctagaa

SEQ ID NO: 3732 - DNA, 1062 bp, Eucalyptus grandis
acgagggaaatgaacatccatctgtacaagttacgctcgatcaactcgtgcggatcatctctttcggtttggattcgcgggtactgactgtttggcagaggatacaaacgaatctggtttaagtgacgcatcatccgaccagagctagtttccggttaatagatctctgacgctcacagttgacctctcttcatcactcaatgcccaccgtcggtcctcgatctggtgatgcaatcttcgcaaatgttgagcgagtgaatgcagagctgtttactttaacctatggagcaattgtgcgtcaattgcttacagatctggaggaggttgaggaagtcaacaaacaactcgatcaaatgggttataatataggcaccagattgattgatgaatttctagcaaaggctaatatctccagatgtgttgacttcaaggagacagccgaaatgattgctaaggtgggtttcaagatgttcttaggagtcactgcatcagtgaccaattgggacatcgagggaacctgttgcaatatggttttggaggagaatcccttggtagactttgtggagcttcctgatacatgccaaggcctatattactgcaacgtcttatgcggggtcatcagaggggccttagaaatggtgtcgatgaagactgaagtcacatgggtccgagatgtgctccgaggggatgattcgtatgagttgcaggtgaaacttctgaagcaagtcccagaagagtacccgtacaaagacgatgaataaactcgtctgtttgcagttcatcacggcctttcttctgccttgtgtccgggaggggagtgtcaaatagctaatctgttcccttcttaatgatgtgtttttcttttcagtatcggagggatcatcgatgccgatggcttttcggtttcagtcgttatatgcagttactctttgccaaaccgaacccaacatgactgcaaactgactcttgattcttcttcttcttcttttcttttcttttgttgacttaattttggaacaaataagataattaaaagaaatggataatgaattgtagaaggta

SEQ ID NO: 3733 - DNA, 1007 bp, Tropaeolum majus
attcggccattacggccgggggtagcaaacagttggttacccagcgaaaacgtccacatttgtcgaacagaaacaatcatcgagctttcgagttttgagatcttaagcggatatgcctagcgttggtcctcgatccggtgatgcaatcttcgcaaacgttgaacacgtgaatgccgagttgtttaccctgacttatggggcgattgtgcgccaattgctgacggatttggaggaggtggaggaagtcaacaaacagcttgatcaaatgggatataatattggaattcgtctgattgatgagtttttggcgaagtcaaacgtctccagatgcgtggacttcaaagagactgctgaaatgattgcaaaggtgggtttcaaaatgttcttgggagtcacagcatccgtgacccattgggataccgatgggacttgttgcagtattgttttggaggataatccactcgtagatttcgtagagctgcctgatacatgtcaaggtctgtattattgcaacatcttaagtggagtcattaaaggagccctagagatggtatctatgaagacggaggtaacatggctgcgggatttacttagaggggatgatgcatatgagctacaggtgaaacttgtgaagcaagttccagaggaatacccttacaaggatgatgagtgatatcctatcttggcatttaatgatataccaccaccttacgacactgctctaaaaatccccgtctggttccgttcatgcctcgcctaagtgctacaaggtacttataccctcttagatccgcttaacaaatttaaaactattgttttaaaaatccccgtttaattccgtttacccttcaacactctaagatccgcttagaacagtgccttactgtgcttattttcttttatcgttctaattttataaatttgtaatatgcatataggaacactcgaaggacttgttgaccaataaattttgggtttctttacggttaatgaatgtgtgttttgat

SEQ ID NO: 3734 - DNA, 999 bp, Tropaeolum majus
ttactctgtacttgtgtagcaaacagttggttacccagcgaaaacgtccacatttgtcgaacagaaacaatcatcgagctttcgagttttgagatcttaagcggatatgcctagcgttggtcctcgatccggtgatgcaatcttcgcaaacgttgaacacgtgaatgccgagttgtttaccctgacttatggggcgattgtgcgccaattgctgacggatttggaggaggtggaggaagtcaacaaacagcttgatcaaatgggatataatattggaattcgtctgattgatgagtttttggcgaagtcaaacgtctccagatgcgtggacttcaaagagactgctgaaatgattgcaaaggtgggtttcaaaatgttcttgggagtcacagcatccgtgacccattgggataccgatgggacttgttgcagtattgttttggaggataatccactcgtagatttcgtagagctgcctgatacatgtcaaggtctgtattattgcaacatcttaagtggagtcattaaaggagccctagagatggtatctatgaagacggaggtaacatggctgcgggatttacttagaggggatgatgcatatgagctacaggtgaaacttgtgaagcaagttccagaggaatacccttacaaggatgatgagtgatatcctatcttggcatttaatgatataccaccaccttacgacactgctctaaaaatccccgtctggttccgttcatgcctcgcctaagtgctacaaggtacttataccctcttagatccgcttaacaaatttaaaactattgtttaaaaatcccgcttaattccgtttacacttcaacactctaagatccgcttagaacagtgccttactgtgcttattttcttttatcgttctaattttataaatttgtaatatgcatataggaacactcgaaggacttgttgaccaataaattttgggtttctttacggttaatgaatgtgtgttttgat

SEQ ID NO: 3735 - DNA, 1037 bp, Citrus sinensis
agatactttcggtcgagtcattggtattgcactgggacattgaggcgagctaaggaggaagaagataaaaaacctataaattctggtgatcaaatttagttatcgctttgcagagatctcataatggctcccgttggtcctcgatccggtgacgcaatcttcgccaacgtggaacgcgtgaatgctgagctgtttacattaacttacggcgccactgtgcgtcagctgctcacggatctggaggaggttgaggaagttaacaaacagcttgatcaaatgggctataatattgggattcgactgattgatgagtttctagcaaaatctaatgtcactaggtgtgtagacttcagggagactgctgaagtgattgcaaaggtgggtttcaaaatgtttttaggggttactgcaaccgtgagcaactgggatgctgatgggacatgttgcagtataattttggaagataatcctctggtggattttgttgagcttcctgatacttgtcaaggcctttattattgcaacatcttgagtggagtcattagaggggccctagagatggtttcaatgaaaactgaagtcacttggatccgcgatgtgcttcgaggggatgatgcatatgagctgcaggtgaaacttctgaaacaagtcccagaagaatatccatacaaggatgatgagtaatatcctgtcttggtgcctgatgcggacataccgagtttacattcttgcacttcattttccctaaagaatatcagttttaacagcttgttctctgtataaatattcacttgggagaaactttgaataggttttccgttttcaaatgcatggtaatgctttcagatttatcagctttctgaacaaagccccgcaaacattaaaatcacgcatgagaaattagaagttccaccgggagaaacattgatgcattttcccccaattctttcccatcaaagttgcagtcaagctcgtggtggttgaatagtaggcaatttccacatcatcaattggtccacatggcaccattttctgag

SEQ ID NO: 3736 - DNA, 904 bp, Arachis hypogaea
ggcccgaaaggcttaacgggccagcgtagaactgaagaggcatctttgttcctagtgctgtccttgactgttgtgtagtgggtttccgtctttgcagctcagatcgcagcaaaagcttactcagttccgtcaatggctccagtggctcctcgttccggcgacgccatcttcgctaacatcgagcgtgttaatgcggagctttttactctaacgtatggcgcgattgtgcgtcaattgctcacggatctggaagaggttgaagaggtgaacaagcagcttgaacaaatgggttataacattggaatccgtttgattgacgaatttttagcaaaatccaatgtctcaaggtgcgttgatttcagagagactgctgatgtaattgcaaaggttggttttaagatgttccttggtgttactgcatctgtgagcaactgggatgctgaaggtacatgttgtagtatcattttggaggataatcctttggtagactttgttgagcttcctgacacctgtcaaggtctttactattgcaacatgttaagtggtgtcattagaggagccttagagatggtgtcaatgaagactgaggtcacttggatccgcgatgtgcttcgaggtgatgatgtgtttgagttgcaggtaaaacttctcaagcaggtccccgaggagtatccatacaaggatgatgagtgacatttgttctgtaatgttgtatactcaaggtttttgtttcatattttcccaagttagattatcatctatctatccacctaatgctgtgtgtattattgtattttgatgaaactttacaaatacaatagaaaatatgactgattagattaactgaaattgacattgacagagtactgcaatctatccttaattacttatatctgagagatcc

SEQ ID NO: 3737 - DNA, 625 bp, Capsicum annuum
gcacgaggcattttcttcttcagtatagcaattaagcgatcgcaatagcaaaggaagtgtaatggctccagtggcacccagatccggagacgtcattttcgccaacgtcgaacgagtgaacgcagagcttttcactctaacatatggagcgatcgtgcgccaactgctcactgatctagaggaagttgacgaggtcaataaacagcttgatcaaatgggttataatataggagtcaggctcattgacgaatttctagcaaagtctaatgtttcgaggtgtgttgatttcaaggaaacagctgaagtcattgccaaggtcggcctcaaaatgttcctaggaatcactgcaacggtgacaaattgggatgttgagggaacaacgtgcagtctaattttggaggataatcccttggtagacttcgttgaactccctgatacctgtcaaggcctaaattattgtaacatcttaagtggagtagtcaggggagcactggagatggtgtcgatgaaaacagaggtcacatggcttcgtgatatgctcagaggggatgatgcatttgagttgcagctgaagcttctgaagcaagttcctgaggagtacccttacaaagatgatgagtgacat

SEQ ID NO: 3738 - DNA, 943 bp, Helianthus annuus
cgagttcatgaactagtgacgtcttgaactaggcccaaagtaagttcatgatatcaagtcataggcctacctaaatctggacgaaacccacgggcaagcaaacaaccagaacaaccgactgcagcttcttcttctttgcactcctgcaaaaccaatcctccgatccgatctgagatccaccaccgtccagacgttcgttcaatggctcccgctgttcctagatccggtgacgctatcttcgccaacgttgagcgtgtgaacgctgagttgtttactttgacctatggagcgatagtgcgacagttgcttatggaagaggtcgaggaagttaataagcagctcgatcaaatgggttacaatattggaatccggctaattgatgagtttcttgcgaaatctaatgtgactagatgtgttgattttagggaaaccgctgaagtcattgccaaggttggcttcaaaatgtttttaggggtaactgcatccgtgagtaactgggatacagagggaacttgttgcagtctcattctggaggataacccgcttgtagactttgtcgagcttccagacacctgtcaaggcttatattactgcaacattttaagtggagttgtcaggggagctctagagatggtgtcgatgaagactgaggtcacatgggtcagggatatgcttagaggagatgatgcatttgagttacaggtgaagcttcttaaacaagttccagaggagtatccatacaaagacgacgagtaacgtgttatctttaatcttgattaatgtatatacattatgatttttgcatttcctttttggtttgtaataaactgataacatgtctttagtactttgacttatgttttgttatgctagaacatgttttgtttccttcatctgggagcgttgctgtattgaggatttggatagtattattattgttata

SEQ ID NO: 3739 - DNA, 861 bp, Nicotiana tabacum
  misc_feature (784)..(784): n is a, c, g, or t
  misc_feature (804)..(804): n is a, c, g, or t
  misc_feature (822)..(822): n is a, c, g, or t
cggggagaatcacccagcacccagttctatagggagagaattctcgctctaagataacaacattaaccgatcacagtaacaaaggaactcccatggctcctgtggcacccagatctggagacgctattttcgccaatgttgaacgagtgaacgcagagcttttcactctaacatacggagcaatcgtgcgccaactgctgactgatctagaggaggttggggaggtcaacaaacaacttgatcaaatgggttataatataggaattaggctgattgacgagtttctagcaaagtctaatgtttcaaggtgtgttgatttcaaggagactgctgaaatcattgccaaggttggtctcaaaatgttcctaggagtgactgcatcagtaacaaactgggatgttgagggaacaacgtgcagtctaattttggaggacaaccccttggtagactttgttgagcttcctgatacctgtcaaggtctatattattgtaacatcttaagtggagtcgtcaggggagcattggagatggtgtcaatgaaaacagaggtcacatggcttcgtgatatgcttagaggggatgatgcatttgagttgcagctgaagcttctgaagcaagttcctgaggagtacccttacaaggatgacgagtaacatgtttttttgatgcttgatattatgcacatgcaatataagaagaatcctttccaggcatgcgttaaaagtattttgtgttgctttagtgtctcttccaaattttccattgcggtaaaacaacttatttnagtaaaatctccaactttgncttggttcacctaagttnttgccatattcctcttatgccttgttaacgggttgaata

SEQ ID NO: 3740 - DNA, 618 bp, Bupleurum chinense
ccagtcggtcatggctcccgtggctcccaaatctggtgatgcaatattcgctaatgtcgatcgagttaacgcggagcttttcactttaacatacggtgctatagtaaggcaactgcttacagatctcgaagaggttgatgaagtgaacaaacagcttgatcaattgggttataatattggaattcgtttaattgatgagtttctagcaaaatcaaatgtttcaacgtgtgtggattttaaggagactgctgaagtgattgctaaggttggcttcaaaatgtttttaggggtcactgcatctgtgagtaactgggatcctgagggaacaacttgcagtattatactgaggatatccattggtagactttgttgagctccctgatacttttcaaggtctctactactgcaacatcctaagcggagttctccgaggagctctagagatggtgtcaatgaagactgaagtcacttgggctcgggatatgcttagaggagacgatgcttatgaattacgcttaaagctttttaaaacaagttcctgaggagtatccatataaagatgatgagtagcaactgttacttcaaaaagcacctattgcaattcactttgaatctgca

SEQ ID NO: 3741 - DNA, 751 bp, Guizotia abyssinica
acgcacatacgcatttctcatttctcacgacctgagagatttcccctgtgctcactctgccggcgaaaccaattcctcacggctgagatcggcgtttgaagccgttaaatatctccggcgtcactagctaatcaactgtagatcttcaatggctcccgccgttcctagatctggtgatgctatattcgccaacgtcgagcgcgtgaacgctgagttgttcactctgacttatggagcaatagtgcgacaattgcttacagatctggaagaggttgaggaagttaacaaacaactggatcaaatgggttacaatattggaatccggctaattgacgagtttcttgcaaaatctaatgtcacaagatgtgttgattttagggaaactgctgaagttattgccaaggttggcttcaaaatgtttttaggggtaactgcatctgtgactaactgggatacagagggaacttgttgcagtctcattttggatgataacccacttgtagactttgttgagcttccagacacctgccaaggtttatattactgcaacattttaagtggagttgttaggggtgctctagagatggtgtcgatgaagactgaagtcacatgggtcagggatatgcttagaggagatgatgcatttgagttacaggtgaagcttctttaacaagttccagaagagtatccttacaagatgacgagtaacgtggtttctttaacccttatggatgtatatacatacgatttt

SEQ ID NO: 3742 - DNA, 754 bp, Allium cepa
ctgaaaaacccgaataactaaaaatggcccctctagctccgagatccggcgatgcaatcttcgccaacgtcgaacgaatcaatgcggagctgtttacactgacatatggcgcgatggtaaggcagctacttacagatctcgaagaagttgatgaagttaacaaacagcttgatcagatggggtataatattggaattcggctgatagatgagtttctagccaaatcaaacggtgtctagatgttctgattttagggagacagcagacatgattgcaaaggttggatttaaaatgttcttaggagtgacagcaaatgtgatgaactgggactcagaaggtacaagctgcagcattgtacttgaagataaccctcttgttgattttgtggagcttccagatacatgccaaggtcttcattactgcaacgttttgagtggagtcatccgaggagcgctagagatggtgtcgatgaaaacggaagtgacatgggtaagagacatgctggcatggagatgatggctacgaattacgaatcaaattactaaagcaagttgcagaagagtacccttacaaagatgatgagtgataaaaactattgttatcccaatcatcacaactcttttttctttccttcccttcttccctttagtttacacctctcgttttttttacttgatggtacttttcttttgcgtgctagtttttcactaaaaaaattgattggtaatctaatggaaagaatttgacttcattt

SEQ ID NO: 3743 - DNA, 759 bp, Cenchrus ciliaris
ccagcgtcgatcgcgtcaatgcggagctgttcacgctcacgtatggcgccatcgtccggcagctgctcacggatctggaggaggtcgaggaagtcaacaagcagctagatcagatgggttacaacattggaacacgattggtcgatgagttcttagccaagtcaaatgtatcaaggtgtgttgacttcaaggagactgctgatgtcatcgcaaagcttggattcaagatgttcttgggtgtgactgcaactgtaaccagttgggatgctgagggtacaagctgcagctttgtattggaccccctttttttttttgattttgttgagctcccggggggggggcaaaaaaaaaaatattgcaatgtgttaagtggagtaatcaggggagcattggagatggtgtcaatgaagacagaggtgacatgggtccgtgacatgctccgtggggatgatgcctatgagatgcgggtgaagctcatcaagcaagtccccgaggaatacccctacaaggacgacgactaggttgatttcatgtttggatgctcatttgctgtagtttgtggatccagttctggtattacatgatgtcacatgagtaaactgttgattgtatttgcacttgccgtgtgtattgctgatgtatcgtagaaacgctacgtatcctacattcctgggggctttgaattgagggcatttgcggtgctcgcgatagatcttgctgtgttatccggaaataaagttttttttttcgggctggtta

SEQ ID NO: 3744 - DNA, 939 bp, Ambrosia trifida
agatttccctcttttgctctctgcaaaccccaaccgtcacgatccgttaccacccgttaaatatctccatcaccttcaggtcgggtatcttatcacaacacgatctcatcttttcattccaatacaaatctccacactcatacaaaattaggtctcactttatataaataatattaatatcaaactttgtaattatcaaccaaaccaatcctagacattcaatggctcctgctcttcctagatccggtgacaccatatttgccaacgtggagcgtgtgaatgctgagttgtttactttgacgtatggagcgatagtgcgacagttgcttacagatctggaagaggttgaggaggttaataagcagcttgatcaaatgggttataatattgggatccggctaattgacgagtttcttgccaagtctagtgtgactaggtgtgttgattttagggaaactgctgaagttattgctaaggttggcttcaaaatgtttttaggagtaactgcatctgtgagtaactgggatacagagggaacttgttgcagtctcattttggaggataacccgcttgtagactttgttgagcttccagacacctgccaaggtttatattactgcaacattttaagtggagttgttaggggagctctagagatggtgtcaatgaagactgaagtcacatggatcaaggatatgcttagaggagatgatgcattcgagttacaggtgaagcttcttaaacaagttccagaggagtatccatacaaagatgacgagtaacgtgtttcctctaatcttcattaatgtatatacattatgatttttgctatttctgttttggtttgtaataaattgaataagatgtctttagtacatggtcctaatgttttatcatgctagcctagaacatgttttgttcctctacctatgaatgttg

SEQ ID NO: 3745 - DNA, 1033 bp, Eucalyptus grandis
gatcaactcgtgcggatcatctccttcggtttggattcgcgggtactgaactgtttggcagaggatacaaacagatctggtttaagtgacgcatcatccgaccagagctagtttccggttaatagatctctgacactcacagttgacctctcttcatcactcaatgcccaccgtcggtcctcgatctggggatgcaatctttgcaaaggttgagcgagtgaatgcagagctgtttactttaacctatggagcaattgtgcgtcaattgcttacagacctggaggacgttgaggaagtcaacaaacaacttgatcaaatgggttataatataggcaccagattgattgatgaatttctagcaaaggctaatatctccagatgtgttgacttcaaggagacagccgaaatgattgctaaggtgggtttcaagatgttcttaggagtcactgcatcagtgaccaattgggacatcgagggaacctgttgcaatatggttttggaggagaatcccttggtagactttgtggagcttcctgatacatgccaaggcctatattactgcaacgtcttatgcggggtcatcagaggggccttagaaatggtgtcgatgaagactgaagtcacatgggtccgagatgtgctccgaggggatgattcgtatgagttgcaggtgaaacttctgaagcaagtcccagaagagtacccgtacaaagacgatgaataaactcgtctgtttgcagttcatcacggcctttcttctgccttgtgtccgggaggggagtgtcaaatagctaatctgttcccttcttaatgatgtgtttttcttttcagtatcggagggatcatcgatgccgatggcttttcggtttcagtcgttatatgcagttactctttgccaaaccgaacccaacatgactgcaaactgactcttgattcttcttcttcttcttttcttttcttttgttgacttaattttggaacaaataagataattaaaagaaatggataatgaattgtagaaggtacagacaaa

SEQ ID NO: 3746 - DNA, 884 bp, Valeriana officinalis
ttctcaatctcattagtctcgacaactcgtactcccccttcttctccaaatccccccatttgctggattagcgcagactctcgaagccctaatcctgataaggacaaaggacataactagaatttccaaccatggctcctatagctcctcgatctggagatgcgatttttgctaacattgagcgcgtgaacgcggagcttttcaccctcacgtatggcgcgattgtacgacagttgcttacagatctggaggatgttgaggaagtcaacaagcagcttgaccaaatgggatataatattggaattagactaattgatgaatttcttgcgaaatcctatatctctagatgtgttgactttaaggaaacggctgaagtcatagcaaaggttggtttcaagatgttcttgggagtaactgcatcggtgtcgaattgggatagtgaaggaacatgttgcagtctgattctagaggataacccacttgttgactttgttgagctacctgatacgtatcaaggcctctactactgcaacatcttgagtggtgttgtcagaggagctctcgagatggtgtctatgaaaacggaagtgacgtggattagagatatgcttagaggggatgacgcattcgagatgcagcttaaactcattaagcaagttcccgaggaatatccatacaaggatgacgagtgaccttttgcttttcaaatgcatgtcttgctatatgtatgcatatgtagcccgcctgcctgcccgccattaattgcgtgtgtgtttgctgcaaaatggtggtttatgtagaaagaaagaaagaaagaacatgttcaatacaatgactcagctaaatggtgttttttttctttcggaagtgattctcgaaaaaaa

SEQ ID NO: 3747 - DNA, 857 bp, Arabidopsis lyrata
atggaaaaggaaatttgcgatcaagcaatactctctctctctttcttctgccatcgccaaaaacttgtcttttgcttctgggttttgcttcttatttggaaatttggagatggccccggttggtcctcgatccggtgatgcgatcttctctagcattgatcgtgtgaatgcggagttgttcacgttgacgtatggtgcaattgtgcgtcaattgcttactgacttggaagaagtggaggaagttaacaaacagcttgatcaaatgggatacaacattggaatccgacttatcgatgagtttctagccaaatctggtgtttccagatgcgttgactttaaggaaactgctgaaatgattgccaaggtgggtttcaagatgttcttaggggtcactgcatcagtgacaagctgggacgcagatgggacttgctgcagtataatcttggaggacaacccgctagttgatttcgtggagcttccggatacttgccaaggtctttactactgcaatatcttaagtggagtcattagaggagctttggaaatggtctcaatgaagacagaagtgacatggacgcgtgatgttcttcgaggagatgatgcttacgagttgcaagtgaagctactgaaacaagtcgctgaggaatatccttacaaggatgatgaataaatgtcaatctcttatcttccctcttcctcaaagagaaactaattactgtttgtagtctctttctctacaattcttagctttatctttttcttcgtaaacacaaaaccataagctatgaaactaaatactgcatttattccatttcttagtgttcttatgtgacaagagttaattgtattacgatgtc

SEQ ID NO: 3748 - DNA, 861 bp, Cleome spinosa
ggagaaatgagactgtagcgcagattcctgggaaaatcagatcgaggagagaaaataatcttcctgttcgcaattctgggagatggcgccggctggtcctcgatctggtgatgcaatcttctccagcatcgagcgcgttaactcggagttattcacactgacttatggtgcaattgtgcgtcaattgcttacggacctggaggaagtcgaagaagtcaacaaacagcttgatcaaatgggatacaatattgggatccgactgatcgatgagtttctagcaaaatcgggtgtatccagatgtgttgacttcaaggagacagctgaagtaatcgcaaaggtgggattcaaaatgttcttgggggtgactgcgtcagtgacgaactgggatgcagatggaacttgttgcagtataatattggaggacaatcctgtcgtggactttgtggagctgcctgatacatgtcaaggtctttactactgcaacatcttaagtggagtcgttagaggagcactcgagatggtctcaatgaagacagaagtaacatggatccgtgatgttctacgaggggatgatgcttatgagttacaagtgaaactcctgaagcaagtggccgaggagtatccgtacaaggatgacgagtaaagtcacttctcgtcaatctcctctctctccccccctcacaatacaaacttatcatgtctgcttttgtagggtttatgtatgtttagcttcttaggtataacaacttcctgaaatgcctaaatcatttgactatagctctaagcattgtctggtttgtttcaattctcctctcgtttttccagtttcttggaaacacaatgatacggttttctttatca

SEQ ID NO: 3749 - DNA, 723 bp, Curcuma longa
gcacgagggaatggctcctctcgtccccaagagcggagacgcgatcttcgccagtatcgatcgcgtgaatgcggagctgttcacgctcacgtacggggcgatggtgcggcagctcctcacggatctggaggaggtcgatgtggtcaacaagcagctagatcagatgggatataacattggcgtccgcttgattgatgaatttctggccaaatccaatgtatctagatgtgttgacttcaaggagacagctgatgtaattgcaaaggttggtttaaaaatgttcttaggggttaccgcatctgtgtctaattgggatcctgagggaagcagtttcagccttgttcttgatgataatccattggtagactttgttgagcttcctgatactttccaaggtcttcactactgtaacatcttaagtggagttatacgaggagcattggaaatggtgtcaatgaagactgaaatcacttggattcgcgacatgctccatggagacgatgcatacgagctccgagtgaagcttctgaagcagatcccagaggagtacccttacaaggatgacgagtaaactagattttttgctcaatgacttaaaaagaactcgaatagtttcctcttttaaagttctttttagattctcacgctgttctttagatgcgcaccatacatgtgtacctaaatacaacgtacacaagatatgcaacatttcctttgggttag

SEQ ID NO: 3750 - DNA, 882 bp, Lactuca sativa
cccttcctaaattcctagtcccctgcccgttaacgcaaaattccgcccctccctcgatttgtaaactctccatctcagactgtggacggcgaacactccgttcaaaatctccgacgccagcccccggattccagaagatacagaagaaattgcgcacataagaacgactgtattaggaaagaactaatcgtagacttcgatggctcctgctgttcctagatctggagatgctattttcgctaatgttgagcgtgtgaactctgagctgttcactctgacgtatggagcgatcgttcgacaattgcttacggatctggaggaggttgaggaagtcaataagcagctcgatcaaatgggttataatattgggatccgtctgattgatgagttccttgcaaaatcaaatgtcactagatgtgttaattttagggagacagctgaagtcatcgcaaaggttgggttcaaaatgtttttaggggtgactgcatctgtgattaactgggattcagaaggaacgtcttgtagccttattttggaggataatccgctcatagattttgttgagcttccagatacttgtcaaggtttatattactgcaacattctaagcggagtagtcagaggagctctagaaatggtgtcaatgaagactgaaatcacatgggtgcgtgatatgcttaaaggagatgatgcatttgagttacaggtaaagctcctgaaacaagttccagaggagtacccctacaaagatgacgagtaaacatgttttagtttttaactttttaaagaataatgatttatgtatatacagttcaattcaataatcgacttttcataacttacttttgttatggatttgattatgatattatgcattttaca

SEQ ID NO: 3751 - DNA, 845 bp, Tropaeolum majus
agagaaattgtgtgagtagtcgagtttgagatctcaaagaaaatgcctccagtcattcctcgatccggtgatgccatctttgccaacgtcgaacgcgtgaatgccgagctgtttactttgacttatggggcgattgtgcgtcaattaattacggatttggaggaggttgaggaagtcaacaaacaacttgatcagatgggctataatattggaatacgtctgattgatgattttttagccaaatctaatgtctccagatgtgtagacttcagggaaactgctgaaatgattgcaaaggtgggttttaaaatgtttttaggggtcacagcatcagtgactaattgggatgctgatgggacttgttgcagtataatattggatgataatcctctggctgactttgtagagctgcctgaaacatgccaaggtctctactattgcaacgttttaagtggagtaatacgaggagccctggagatggtatcgatgaagactgaagtaacatgggtccgcgatttacttagaggcgatgatgcatatgagttacaggtaaaactgctgaagcaagtgccggaggaatacccttacaaggacgatgagtaaaactgctgatgcttatgtgtacccatttacgctactggaagcatatgattttcttatgtcctaactaaaagaatataacagcttcccttgtgacatgcgctttagaatctcactgcttgtatctttatattaggatatgtgttagagctcaaactttataacatcaatgctgtttgttatcccatcactatattatgtaaagcggagcttagcccttaccgaaaacaagctgtggtattagt

SEQ ID NO: 3752 - DNA, 870 bp, Arachis hypogaea
gcagagtacggggagcacaaaactttctagaagcttcggaacccaagagcagatcgcaggcatcagcttagatcgcacattctcacagtgacaggcaaaagaagctcggcgaggttctacaatgccgcccgttgctcctcgatccggcgactccatattcgctaacctcgagcacatgaacgcggagctatttacactgacatatggtgcgatcgtgcgtcaattgattaccgatctggaagaggttgacgaggttaacaagcagcttgatcaaatgggctataacattggggtgcgtttaattgatgagttcttagccaaatctaacatatcaagatgcgttgatttcaaagagactgctgaagtgattgctaaggttggtttcaaaatgttccttggtgttactgcttctgtgattaactgggatgctgatggaacatcttgtagtattgtgttggaggacaatcccttggtagacttcgttgaacttcctgataactgtcaagggctacactattgcaacatcttaagtggcgttgttagaggagctttagagatggtttcaatgaagactgaggtgacatgggtccgagatatgctccgtggagatgaagtgtatgagttgaatgtaaaacttatcaagcaagttccagaagagtatccatacaaagatgacgagtaacatttgaatttttttttaatacaatttgattcttttgttatttcaagcttcgtgttttttttcttttggtgtatgcatgatgaaactttatacacattgtaataaagtttgaagcatcataagactgttctgattttaccatccacaagttacaccaataaattgctctgaaaaaaagaaaaaaacac

SEQ ID NO: 3753 - DNA, 1221 bp, Glycine max
gtcagcccactgggccagtgggcattgatccaaagtcgcatcttttgcttcactctacgcagatcgcagcaaaccagagattgaactccgacgatgcctcccgtcgctcctcgatccggcgatgccatattcgccaacgtcgaacgcgtcaatgcggagctgtttactttgacgtatggcgcaattgtgcgtcaattgctcacggatctggaagaggttgaggaggttaacgagcagcttgatcaaatgggttacaatattggaatccgattgattgatgagtttttagctaagtctaatgtctcaagatgcaacgatttcagagagactactgatgtaattgcaaaggttggttttaaaatgttccttggtgttactgcatctgtgaccaattgggatgctgatggaacatgttgtagtattgttttggaggataatccattggtagattttgttgagcttcctgacaactgccaaggtttgtactattgcaacatcttaagtggagtcatcagaggagccttagatatggtgtcaatgaaaactgaggtaacttggcttcgtgatgtacttcgtggtgatgatgtgtttgagttgcaggtaaaacttctcaagcatgttcctgaagagtatccatacaaggatgatgagtgaatttgtttttgtagtgatatatgctcgaggtttttattacttcatttctgcagaattagattatcatcttctgacttgtcctgtgtgtattttgataaagcactaaatacaacagaaaatctttagttaaatcattatcatattggctttgacgcgagctacgatctattatgatttcagattgccctatagattttcagtttctcttattatcttcctcattatatgttatcatgggcttgatacggatgttttagctattagatagtactaattagcaaacaaatttcataattcaaacggatttaagtttggaatccgtgtattatcattagtcactggatatttgaatgccctgctccatttgaaatgtaatgttcctaggatttaaaatcacttatttaagcttccggcttctattttttttcttcttttggtgtctcagagatgccatttgtcatgtactgattttgcttttctaaatgataatgatgtcttgcaagtgacatatctagtgagaggagttaattttggtcatacaagggacatatctagtgagggtgagaa

SEQ ID NO: 3754 - DNA, 826 bp, Glycine max
agcattgatccaaagacgcatcttttgcttcactcgtcatcactacgcagatcgcagcaaaccagactaaactccgacgatgcctcccgtcgctcctcgatccggtgatgccatattcgccaacgtcgaacgcgtcaatgcggagctgtttactttgacgtatggcgcaattgtgcgtcaattgctcacggatctggaagaggctgaggaggttaacaagcagcttgatcaaatgggttacaatattggaatccgtttgattgatgagtttttagccaagtctaatgtctccagatgcaacgatttcagagagacgactgatgttattgcaaaggttggttttaaaatgttcctcggtgttactgcatctgtgaccaattgggatgctgatggaacatgttgtagtattgttttggaggataatcctttggtagattttgttgagcttcctgacaactgccaaggtttgtactattgcaacatcttaagtggagtcatcagaggagccttagatatggtgtcaatgaaaactgaggtaacttggcttcgtgatgtgcttcgcggtgatgatgtgtttgagttgcaggtaaaacttctcaagcatgtcccagaagagtatccatacaaggatgacgagtgaatttgtttttgtagtattgtatactccaggttttcattacttcatcatctctgcattattagattatcatattctgactggtcctgtgtgtattatgataaaacactaaatacaacagaaaatctttaattaaatgattatcatattggctttgacagcgagctacgatctattatgatttctgag

SEQ ID NO: 3755 - DNA, 1026 bp, Solanum lycopersicum
gctaaattactatgtgcgctttaaaagtggtacaagtgtatttgtgcttatttacttgtactttctctacaaaataaaccagtaaaatcaccagcacgtatgcgttctcttcttagttagctcaatatagcaattaaccgatcgcaatagcagaggaactctcatggctcctgtggtacccagatccggagacgccattttcgccaacgtcgaacgagtgaacgcagagcttttcactctaacgtatggagcaatcgtgcgccaactgctgactgatctggaggaggttgatgaggtcaataaacagctcgatcaaatgggttataatataggaatcaggctcatagacgagtttctggcaaagtctaatgtttcaaggtgtgttgatttcaaggagacagctgaagtcattgccaaggtcggtctcaaaatgttcctaggagtgactgcaacagtgacaaattggaatgttgagggaacaacatgcagtctaattttggaggataaccccttggtagacttcgttgagctccctgatacctgtcaaggcctatattattgtaacatcttaagtggagtagtcaggggagcattagaaatggtgtcaatgaaaacagaggtcacgtggcttcgtgatatgctcagaggggatgacgcatttgagttgcaactgaagcttctgaggcaagttcctgaggagtacccttacaaagatgacgagtaacatacctccttttttatgcttgccatttggagttatacgacaatctatagcaaatgcacacacagatctctgtctattattgagtatgtttaagttctgatattgacaattttctactgatgatctatgctctgtaattttgagatctgtcctatcattcatggatttaataggcattgtcctgcttctaaatgtctcgatatccaagtcttctgagactaaattagttcccgtgacacctgagatgaatatatccgttttaagttgatgcagtcgtgaaatacaatatgttttgaagtccc

SEQ ID NO: 3756 - DNA, 991 bp, Trigonella foenum-graecum
gagaaatgacgtggtagccagcgagaactttcagttaaacccaaatcaacaaaacttcacccgtcgccgccgcatcggagaacccaatcagccctccgccacacctgcacggttgcaatcgggtcatcggaaaatcacaacgtaagcaaggacagcaaacaaacctgagtgacttctaacaatggcccctgttgctcctcgatctggcgatgcaatatttgctaacatcgaacgcgttaatgcggagctgtttactctgacatatggggcaattgtgcgtcaattgattacagatctggaagaggttgaggaagtcaacaagcagctagatcaaatgggttataacattggaatccgtttgattgatgagtttttggctaaatctaatgtctcaagttgtgttgatttcagagagacggctgaggtgattgcaaaggttggttttaaaatgttccttggtgttactgcatctgtgacaaactgggatgctgaaggaacatgttgtagtattgttttggaggataatcctttggtagactttgttgagcttcctgacaactatcaaggtctgcactactgcaacatattaagtggagtcattagaggagccttagatatggtgtcaatgaaggctgaggtcacttggctacgtgatgcgcttcgaggtgatgatgtgtttgaattgcaagtaaaacttctcaagcaagtcccagaagagtatccatataaggatgatgagtaattgtaatgttgcacatgatcatttcctaagtattaattagattattatatttctgcctttgcgtgcattttgatgaaattatagaaaacatttaattaagttattatgatatttgcttcgacagcagactaagatctatgcgagccctcgagtttcttgaaactcatcttctcttcatcattctttgttattatggaagcttattttggacaatttggtactatcaagagattgagaattgctaggaat

SEQ ID NO: 3757 - DNA, 926 bp, Arabidopsis thaliana
atggaaaagaaaatttgcgatcaagcaattactctctctctctctctttcttctgccatcgccaaaaacttgtcttttgcttctgggttttgcttcttatttttgaatatagtcattggagatggctccggttggtcctcgatccggtgatgcgatcttctctagcattgatcgtgtgaatgcggagttgttcacgttgacgtatggtgctattgtgcgtcaattgcttactgacctggaagaagtagaggaagttaacaaacagcttgatcaaatgggatacaacattggaatccgacttatcgatgagtttctagctaaatctggtgtttccagatgcgttgactttaaggaaactgctgaaatgattgccaaggtgggtttcaagatgttcttaggagtcactgcatcagtgacaagctgggactcggacgggacttgctgcagtataatcttagaggacaatcccctagttgatttcgtcgagcttcccgatacttgccaaggtctttactactgcaatgtcttaagtggagtcattagaggagctttggaaatggtctcaatgaagacagaagtgacatggacgcgtgatgttcttcgaggagatgatgcttatgagttgcaagtaaagctactgaaacaagtcgctgaggaatatccttacaaggatgatgaataaatatcaatctcttatcttccctcttcctcaaagagaaactaattactgttttgtagtctctttctctgcattcttagctttgttttttttctccgcaaacacaaaactataagctatgaaactaaatactgtttaaatccatttcttagtgttctgatgtgacaagagttaatcgtatcacaatgtctcaaatcgtgtaataaatagatcaattcagtgagatcagagtgtgttttttctttcg

SEQ ID NO: 3758 - DNA, 794 bp, Cleome gynandra
gggaaaatcagatcgagcggagaaaataaccttcctgttcgtgaaactgagaaatggctccggttggtccgcgatctggcgatgcgatcttctccagcatcgaacgcgttaacgcggagctattcacgcttacttatggtgccattgtccgtcaattgcttacggacctggaggaggtcgaagaagtcaacaaacagcttgatcaaatgggatacaatattggaatccgactgatcgatgagtttttagcaaaatcgggtgtatccagatgtgttgacttcaaggagactgctgaagtaattgcaaaggtgggtttcaaaatgttcttgggggtcactgcgtcagtgacgaactgggatgcagatggcacttgttgcagtataatcctagaggacaatcctctcatagactttgtagaactccctgatacctgtcaaggtctttactactgcaacatcttaagcggagtcattagaggagcacttgaaatggtctcaatgaagacagaagtgacatggatccgtgatgctttacgaggggatgatgcttacgagttacaagtgaaacttctgaagcaaattgccgaggagtatccgtacaaggatgacgagtaaagtcatgtcccatcttttctccccacggtacaacttattgctacttgtagggtttattatgtatgtgtagcttcttagggtttattattgctcgaagcatgtctggtttattccattctctattttcttgaaaacacaatgataccgtttgccttaccttaatcataccatgagctttgt

SEQ ID NO: 3759 - DNA, 815 bp, Vigna unguiculata
gggtgggcactgatcaaagttcgcatctttgctcaactcgtcatcgctaagcagatcgcagcaaagcagagtctgagactgaactccaacaatgcctcccgtcgctcctcgaaccggcgatgccatattcgccaacatcgaacgcgttaatgcggagctgtttactttgacttatggtgcaattgtgcgtcaattgctcacggatctggaggaggttgaggaggttaataagcagcttgatcaaatgggttataatattggaatccgtttgattgatgagtttttagctaagtctaatgtctcaagatgcaacgatttcagagagactactgatgtaattgcaaaggttggttttaaaatgttccttggtgttactgcatctgtgaccaattgggatgctgatgggacatgttgtagtattgttttggaggataatcctttggtagattttgtggaacttcctgacaactgccaaggtctgtactattgcaacatcttaagtggagttattagaggagccttagatatggtgtcaatgaagactgaggtaacttggctccgtgatgtgcttcgtggtgatgatgtgtttgagttgcaggtaaaacttgtcaagcatgtaccagaagagtatccatacaaagatgatgaatgaatttgtttttgtagtgttgtatactcgaggtttttattacttctttgctgcagtattagattatcatattctgacttgtcctatgtgtattttgatgaaacactaaatacagcagaaaatctttaattaaatcattatcatattggttttgcgatctacatga

SEQ ID NO: 3760 - DNA, 1190 bp, Cycas rumphii
  misc_feature (1172)..(1172): n is a, c, g, or t
ggacacatcttaatgatcctaggagttttgactagttatggttcacttttaatgttacctacaagaataaatatcacttggtcacgagttcaaaccccgaatagggactagatcagaggctctcgcttttcagtttttaaaatagccttagggggtttacttcatgttcctttagactctcatacacagaggagcgggttctctccgttttcaccccttaaactgcacttttaattgctcaaattttcatgtcagctacttgacgatttcatcagacaaacaattgcgtggatcggtcagagaactcttcgtttttatcacacaggcggataaacaagagcagtggtcaagaggaaataatatcatggctccccttgttcctagatccggggatgcagtttttgctaatgtcgaacgtgtgaatgcagaactattcactcttacatatggggcgattgtgcgacagctgcttacagattttgaagaggtcgacgaagtgaacaaacagctcgatcaaatgggttataacattggcattcggcttatagatgaatttctagccaaatcaaatgtcacaagatgtgttgatttcaaggagacaacagaagttattgcaaaggtaggcttcaaaatgttcctgggagtgacagcgagtgtgactaattgggatgcagatggcactgaatgcagtcttatccttgaggataacccccttgtagattttgttgagcttcctgagacttgccaaggcctttattactgcaatgttttgtgtggggttattcgaggggcacttgaaatggtgtctatgaagactgaagtcagatgggttcgggatatgcttcgtggggatgatgcgtatgaattgaagttgaaacttctgaagcaggttcctgaggagtatccttacaaagatgatgaatagtcaatcgggtttcaaatacacttatttagaaaattacatgatttaaagccatttctgtgcagattaatgtcctataatgtcagcatatcttatgtctgttaccatttatcatttgtggattatttccagccagtcatttactgagccatgtgttaagtgggtctggaaatactactgtcactgcacaatgcagccactttgacgttatgtgtttgatgttttttaaatccaagccttaaaccagttncctttgattgggcttttc

SEQ ID NO: 3761 - DNA, 731 bp, Medicago truncatula
gaatcgcgcaaagcagaagctaacagtatcatcatcagtgatcaaaacaaatctgagttcgctttaacgatggctcctgttgctcctcgaactggcgatgcaatatttgctaacattgaacgcgttaatgcggagctctttactctcacatatggtgcaattgttcgtcaattgctcacagatctcgaagaggttgatgaagtcaacaagcagctagatcaaatgggttataatattggaatccgtttgattgatgagtttttggctaaatctaatgtctcaaggtgtgttgatttcagagagactgctgatgtcattgcaaaggttggttttaaaatgttcctcggtgttaccgcatccgtgaccaattgggatgctgaagggactacttgtagtattattttggaggataatcctttggtagactttgttgagcttcctgacaactatcaaggtctatactactgcaacatattaagtggagtcattagaggagccttagatatggtgtcaatgaaggctgaggtcacttggctacgagatgcgcttcgaggtgatgatgtgtttgagttgcaagtaaaacttctcaagcaagttccagaagagtatccatataaggatgatgagtaatatgttttgtaatgttgtacttcataatttcccaagtattagattatcatctttctgcctttgaaactataaatacaacagaaaatctttaattaactcat

SEQ ID NO: 3762 - DNA, 944 bp, Medicago truncatula
agtgaatcgcgcaaagcagaagctaacagtatcatcatcagtgatcaaaacaaatctgagttcgctttaacgatggctcctgttgctcctcgaactggcgatgcaatatttgctaacattgaacgcgttaatgcggagctctttactctcacatatggtgcaattgttcgtcaattgctcacagatctcgaagaggttgatgaagtcaacaagcagctagatcaaatgggttataatattggaatccgtttgattgatgagtttttggctaaatctaatgtctcaaggtgtgttgatttcagagagactgctgatgtcattgcaaaggttggttttaaaatgttcctcggtgttaccgcatccgtgaccaattgggatgctgaagggactacttgtagtattattttggaggataatcctttggtagactttgttgagcttcctgacaactatcaaggtctatactactgcaacatattaagtggagtcattagaggagccttagatatggtgtcaatgaaggctgaggtcacttggctacgagatgcgcttcgaggtgatgatgtgtttgagttgcaagtaaaacttctcaagcaagttccagaagagtatccatataaggatgatgagtaatatgttttgtaatgttgtacttcataatttcccaagtattagattatcatctttctgcctttgaaactataaatacaacagaaaatctttaattaactcattatgatattgcctttgacagccggttaggatctgtacttattttcgaaaagccctttaaatgcttaaaactgttctttgttctcttcatccttgttatgtcatagacttgaggcgtttcacacctattattggatatattgtatgattagccaacacttttcacagttgaaattgatttgtaaagtttagagccctttggcttgagaaaa

SEQ ID NO: 3763 - DNA, 662 bp, Eschscholzia californica
ggggatgcagtttttgcaaatgttgaacgtgtgaatgcggagttgtttactctaacatatggggcgatggtgcgacaattgcttacagatcttgaagaagttgaggaagtcaataaacagctcgatcagatgggttataatatcggaattcgactaattgatgagtttttagcaaagtctaatgtctccagatgtgttgacttcagggagtctgctgatgcaattgcaaaggttggttttaagatgttcttaggggttacagcaactgtaaccattgggatgccgaggacaagttgcagtcttgtattggacgagaatccccttgtagactttgttgagcttcctgatacatgccaaggtctttattattgcaacgttcttagcggggttatcagaggagcactagagatggtatcaatgaagactgaagtgacatgggttcgagatatgttgcgtggagatgatgcatatgagttacgtgtgaaacttctaaagcaggtccccgaagagtacccgtacaaagatgatgagtaacttctccgtatagattggtaaatccttctaagatgtagtttcccatttttgttatctttatattcaaatcttacaacttgagctattcgctcttagagacatctataccaactagttatcatgactct

SEQ ID NO: 3764 - DNA, 1158 bp, Picea glauca
gtacagtaaactgtgcggacaagattggcctcagtttgaatatttgcacccaaacttctatcttatataagccgccgcaagcgtgcaacagtttcgtttcatctagacgacatactactcacgctggagaagagctaaagttcaaacagcaataaggattaagaagaaaagaagaataaaacagttatcatggctcccctcgcccccagatcaggcgacgcagtcttcgcaaatgttgaacgcgtgaatgcggagctcttcactctcacatatggagccattgtgcgtcagctgctcactgattttgaagaggtcgaagaagtaaataagcagcttgatcaaatgggttataacattggcattcggcttatagatgaatttctagcgaaatcaaatatcacaagatgcgttgattttaaagagacagcagaagttattgcaaaggtaggcttcaaaatgttcctgggcgtgacagcaagcgtgggtaactgggacgcagatgggactgaatgcagtcttatccttgaggataatcctcttgtggactttgttgagttacctgagacttgtcaaggcctttattattgtaacgtattatgtggtgtcattcgtggagcacttgaaatggtctctatgaaaactgaagttagatgggttcgggatatgctttgtggggatgatgcatatgaattgaagttgaaacttctagagcaagttcctgaagaatacccttacaaggatgatgaataatctgtcaggtgtccgcttcgtattggttcgaaattacatggttcaaaaggcattctgtccctggtggatgtgtaatttttgttgtatcattgttacactattatttgtggatcattttaagaagccatacccttagttaagcatgtttggatagatctagaaatattgctttcattgcactttgtagttgattagtattttatgttttctgcttttatgaatcactctggagggagtccttcaatttggcaaatttcaagtatggcgtgtctcacttttggttgaattctagaatctgatttctttgtaaacaactacagattcgcaccctgatgggtgtgcatttccttttaaagggcctttacttgatgtcttcatattaatctatttatgtgagcatattctcca

SEQ ID NO: 3765 - DNA, 875 bp, Eutrema halophilum
ggtttattaatttgttcttcttcttcctcttcaccccggccggctgctacgaggtgaaatttatcgatttgtggaactgtgaagcgattgatagactaattgtagtttggtgaaattctgagatggctccggttggtcctcgatccggtgatgcgatcttctccagcatcgatcgcgtgaatgcggagttgttcacgttgacatatggtgcaattgtgcgtcaattgcttactgatcttgaagaagttgaggaagtcaacaagcagcttgatcaaatgggatacaacattggaatccgacttatcgatgagtttctagccaaatctggtgtttccagatgcgttgatttcagggaaactgcggaaatgattgccaaggtgggtttcaagatgttcttgggggtcacagcatcagtgtcaagctgggacgcggatgggacttgctgcagtataatcttggaggataacccgctcgttgatttcgtggaacttcccgatacttgccaaggtctttactactgcaatgtcttaagtggagtcataagaggcgctttggaaatggtctcaatgaagacagaagtgacatggacacgtgatgttcttcgaggagatgatgcttatgagttgcaggtgaagttactgaagcaagtcgctgaggagtatccttacaaggatgatgaatagaatgtctctctcttatcttcgctcttacacaaagagaaactatttactattcgtagtctcttttgtctctctgctttcttagcttgtttttttttcttcttcttttcccggaaatacaaaccataagcttttaatactgctttatgtttgggacaaaccattaatctatttcttaatgttcttatgggttaa

SEQ ID NO: 3766 - DNA, 845 bp, Cajanus cajan
atggctcccgtcgctcctcgaaccggcgatgccattttcgctaacgtcgaacgcgttaatgcggagctgtttactttgacgtatggcgcaattgtgcgtcaattgctcacggatctggaagaggttgaggaggttaacaagcagcttgatcaaatgggttataatattggaatccgtttgattgatgagtttttagctaaatctaatgtctcaagatgcaatgacttcagagagactactgatgtaattgcaaaggttggttttaaaatgttccttggtgttactgcatctgtaaccaactgggatgctgacgggacttgttgtagtattgttttggaggataatcctttggtagattttgttgagcttcctgacaactgccaaggtttatactattgcaacatcttaagtggagtcattagaggagccttagatatggtgtcaatgaagactgaggtaacttggctccgtgatgtgcttcggggtgatgatgtgtttgagttgcaggtaaaacttctcaagcatgttccagaagagtatccatacaaggatgatgagtgaatttgtttttgtagtgttgtatactcgaggtgtttatttcttcatttctgcaatattagattatcatcttctgacttgtcctgtgtgtattttgatgaaacactagatacaacaaaaaatctttaactaaaacattgtcatattggctttgactaagttctatcatgatttctgagggccctctagattgagggattcttatcatcttcctcattatatcatatgttagtaattagtatgcgcttgatacagatgtttcagtttcagctattagataataacag

SEQ ID NO: 3767 - DNA, 1017 bp, Cajanus cajan
agcccagtggacccgttgttggctttgatccaaagtcgcatcgttgcttcactcgctatcactgcgcagatcgcaccaaagcaaagcagagactgaaccctccatggctcccgtcgctcctcgaaccggcgatgccattttcgctaacgtcgaacgcgttaatgcggagctgtttactttgacgtatggcgcaattgtgcgtcaattgctcacggatctggaagaggttgaggaggttaacaagcagcttgatcaaatgggttataatattggaatccgtttgattgatgagtttttagctaaatctaatgtctcaagatgcaatgacttcagagagactactgatgtaattgcaaaggttggttttaaaatgttccttggtgttactgcatctgtaaccaactgggatgctgacgggacttgttgtagtattgttttggaggataatcctttggtagattttgttgagcttcctgacaactgccaaggtttatactattgcaacatcttaagtggagtcattagaggagccttagatatggtgtcaatgaagactgaggtaacttggctccgtgatgtgcttcggggtgatgatgtgtttgagttgcaggtaaaacttctcaagcatgttccagaagagtatccatacaaggatgatgagtgaatttgtttttgtagtgttgtatactcgaggtgtttatttcttcatttctgcaatattagattatcatcttctgacttgtcctgtgtgtattttgatgaaacactagatacaacaaaaaatctttaactaaaacattgtcatattggctttgactaagttctatcatgatttctgagggccctctagattgagggattcttatcatcttcctcattatatcatatgttagtaattagtatgcgcttgatacagatgtttcagtttcagctattagataataacagttagcaaaatatttcacaattcaaacttttggattccgtgtatttgaatatttcatatttgatacagat

SEQ ID NO: 3768 - DNA, 904 bp, Rhizophora mangle
gagtcgcctccgctaccaatggctcctgttggaccccgctccggcgatgcaatcttcgccagtgtcgaacgcgtgaatgcggagctgtttacattaacctatggggcgatagtgaggcaactgcttacggatctggaggaggttgaggaagtgaacaaacagctggatcagatgggttacaatattggaattcgactgattgatgagtttctagccaaatctcatgtctctagatgtgtggacttcagggaaacagctgaagtgattgcaaaggtgggtttcaaaatgttcctgggagtgagtgcatctgtgaccaattgggattctgatggaacatgctgtagtatcatttttgaagataacccccttgtggactttgttgaacttcctgatacatgtcaaggtctacactattgcaatgtcttaagtggagtgattaaaggagcacttgaaatggtgtccatgaagacggaagttacatgggttcgtgatatgcttcgaggtgatgatgcctttgagctgcagctgaaacttctgaagcaagccccagaagagtacccgtacaaggatgatgagtgatatcttatcttggcccttacctcatccctctatggttcctgaatttctactatgctttcctaaaacataaaattctttatgtgctgtgcctcctagttctcatttctctggaactttgaaaggtactctaccataacatatatgagaggttatgattgggaacaatgtctgcaatatttcatacggttctaaagcttggttaattttgcattcatgtttagtgactatgtatgataaggtgggattactaaactttcacacaactttagctgtcagtttttttcgatctggctgcaaattatccaatcagataaagaaataccag

SEQ ID NO: 3769 - DNA, 1863 bp, Picea glauca
  misc_feature (1845)..(1845): n is a, c, g, or t
ttttcatctagacgacatactactcacgctggagaagagctaaagttcaaacagcaataaggattaagaagaaaagaagaataaaacagttatcatggctcccctcgcccccagatcaggcgacgcagtcttcgcaaatgttgaacgcgtgaatgcggagctcttcactctcacatatggagccattgtgcgtcagctgctcactgattttgaagaggtcgaagaagtaaataagcagcttgatcaaatgggttataacattggcattcggcttatagatgaatttctagcgaaatcaaatatcacaagatgcgttgattttaaagagacagcagaagttattgcaaaggtaggcttcaaaatgttcctgggcgtgacagcaagcgtgggtaactgggacgcagatgggactgaatgcagtcttatccttgaggataatcctcttgtggactttgttgagttacctgagacttgtcaaggcctttattattgtaacgtattatgtggtgtcattcgtggagcacttgaaatggtctctatgaaaactgaagttagatgggttcgggatatgctttgtggggatgatgcatatgaattgaagttgaaacttctagagcaagttcctgaagaatacccttacaaggatgatgaataatctgtcaggtgtctgcttcgtattggttcgaaattacatggttcaaaaggcattctgtccctggtggatgtgtaatttttgttgtatcattgttacactattatttgtggatcattttaagaagccatacccttagttaagcatgtttggatagatctagaaatattgctttcattgcactttgtagttgattagtattttatgttttctgcttttatgaatcactctggagggagtccttcaatttggcaaatttcaagtatggcgtgtctcacttttggttgaattctagaatctgatttctttgtaaacaactacagattcgcaccctgatgggtgtgcatttccttttaaggcgcctttacttgatgtcttcatattaatctatttatgtgagcatattctccccccccccgaaaaagtagatttgcgatttgaactttgaaactggggatatccaagctcatttttcactgtgaaaagggattctgatcaggcgattttccagcatcctccgttcgagagttcacagaacatacgtgttaagtcttttttccagggaggctgcgaaaatggcaggcgaaatcaatagagaggcatttgttgaactacaaggtcggatgatcgaaacatcaagcaaacttaaacaggtgcaaatgcaaattcgcaataaagaagctgaaaaaaagcgagcctttcttacattggaagagctacaacagttgcctgatgaaacaaatacatataaatctgttggcaaatcattcattttggagcccaagtcagttttagttacggagcagaaggagaaaataaaagaatgtgatagttccgtagcttccttacagacctcaaaggaatacttggaaaggcagatgacagaggtggaaagcaatttcaaagagttactgcagcaagacccaggacttgctcgtcaaattatgtcaatgtcaatgtcataatggtcctgaatattaaaagtcagttgtattgagtatgtgctggtttacatgcacacttctattgttaagttttcagatttaaccatactcattatgtcaagtatcgcatttatataaatggggtataaatgcgaatcctttgaaatctggaggcaagaacaatgtaggctttttagtaaattttttatgctcgttgattttcaagttttgctttctcatctaagttanctccaggtttctaaaaaa

SEQ ID NO: 3770 - DNA, 874 bp, Thellungiella halophila
gggtttattaatttgttcttcttcttcctcttcaccccggccggctgctacgaggtgaaatttatcgatttgtggaactgtgaagcgattgatagactaattgtagtttggtgaaattctgagatggctccggttggtcctcgatccggtgatgcgatcttctccagcatcgatcgcgtgaatgcggagttgttcacgttgacatatggtgcaattgtgcgtcaattgcttactgatcttgaagaagttgaggaagtcaacaagcagcttgatcaaatgggatacaacattggaatccgacttatcgatgagtttctagccaaatctggtgtttccagatgcgttgatttcagggaaactgcggaaatgattgccaaggtgggtttcaagatgttcttgggggtcacagcatcagtgtcaagctgggacgcggatgggacttgctgcagtataatcttggaggataacccgctcgttgatttcgtggaacttcccgatacttgccaaggtctttactactgcaatgtcttaagtggagtcataagaggcgctttggaaatggtctcaatgaagacagaagtgacatggacacgtgatgttcttcgaggagatgatgcttatgagttgcaggtgaagttactgaagcaagtcgctgaggagtatccttacaaggatgatgaatagaatgtctctctcttatcttcgctcttacacaaagagaaactatttactattcgtagtctcttttgtctctctgctttcttagcttgtttttttttcttcttcttttcccggaaatacaaaccataagcttttaatactgctttatgtttgggacaaaccattaatctatttcttaatgttcttatgggtt

SEQ ID NO: 3771 - DNA, 728 bp, Rhizophora mangle
cggccggggagtttccgatctctcccatggctcctgttggcccccgttccggcgaggcaatcttcgccagtgtcgaacgagtgaatgcagagctgtttacattaacctatggggcgatagtgaggcaattgcttacggatctggaggaggttgaggaagtcaacaagcagctggatcaggtgggttacaatattggaattcgattgattgatgagtttttagccagatctaatgtctccagatgtgtagacttcagggaaacagctgaagtaattgcaaaggtgggtttcaaaatgttccttggtgtgagtgcatctgtgaccaactgggatgccgatgggacatgctgcagtatcattttggaggataatcccctggtggactttgttgaacttcccgatacctgtcaaggtctatactattgcaatgtcttaagtggagtgattagaggtgcacttgaaatggtatcaatgaagacagaagttacatggcttcgtgatatgcttcgaggtgacgatcaatttgagctgcaggtaaacttctgaagcaagttacagaagagtacccatacaaggatgacgagtaatatcttatcttggcctattatctcttgcctacatgattcctctatttctgctttgctttcctaaagttcaaaatttttgatatattgtgactcctaattctcatttgtcaggaactttgaataggttcactctaccgtatca

SEQ ID NO: 3772 - DNA, 757 bp, Abies balsamea
atcagagaagagctaaagctaacagcaggaagaaggaagaataaaacgataatcatggctcccatcgttcccagatcaggcgatgcagtctttgcaaatgttgagcgcgtgaatgcggaactcttcactctcacatatggagccattgtgcgccagctgcttactgattttgaagaggtcgaagaagttaataaacagcttgatcaaatgggttataacattggcattcggcttatagatgaatttctagcgaaatcaaatatcgcaagatgcgttgattttaaagagacagcagaagttattgcaaaggtaggcttcaaaatgttcctgggggtgacagcaagcgtggctaactgggatgcagatgggactgaatgcagtcttatcctcgaggacaatcctcttgtggactttgttgaattaccggagacttgtcaaggcctttattattgtaacgtgttatgtggtgtcattcgtggagcacttgaaatggtatctatgaaaactgaagtcagatgggttcgggatatgctttgtggggatgatgcatatgaattgaagttgaaacttctagagcaagttcctgaagagtacccttacaaagatgatgaataatgtgtcaggtgtctgcttttagaaatttacatagttcaaaaggcatttctggccttactgggcatgtaatttttgttatatcattgttatattattatttgtggatcattttcagaagccatatcctaagctaagcatgttt

SEQ ID NO: 3773 - DNA, 777 bp, Brassica juncea
ctcgttccggtgacgccatcttctccagcaaacacaaacgagaacgagaacctaaaccttctttgtcggtgagattcagacatggctccggttggtcctcgttccggtgatgccatcttctccagcatcgatcgcgtgaacgcagagttgttcacgttgacgtatggtgcaatcgtgcgtcaattgcttactgacctcgaagatgtcgacgaagtcaacaaacagcttgatcaaatgggatacaacattggaatcagacttatcgatgagtttcttgccaaatctggcgtttccagatgcgttgatttcaaggaaactgctgaaatgattgccaaggtgggtttcaagatgtttttgggcgtcactgcatcagtgtcaagctgggatgcggatgggacttgctgcagtataatcttggaagacaatccactcgttgatttcgtggagcttcccgatacttgccaaggcctttactactgcaacgtcctaagtggagtcattagaggcgctttggaaatggtgtcaatgaagacagaagtgacatggacgcgtgatgctcttcgaggggatgatgcatatgagttgcaggtgaagctactgaagcaagtcgctgaggagtatccgtacaaggatgatgaataaatgggctctttctctttctctatcttgcattcttagcttctttggctctttttccttcaagaaacaccaactttaagctttgagacttaatactgttttatgtttggcgcaaaccgattaatccatttcttagct

SEQ ID NO: 3774 - DNA, 722 bp, Brassica oleracea
  misc_feature (699)..(699): n is a, c, g, or t
gatctcgaccagatcaaaagcaaacacaacgagaagtagaacctaaaccttctttgtcggtgagattcagacatggctcctgtcggtcctcgttccggtgatgccatcttctccagcatcgatcgcgtgaatgcagagctgttcacgttgacgtatggtgcaatcgtgcgccagttgcttactgacctcgaagatgtcgacgaagtcaacaaacagcttgatcaaatgggatacaacattggaatcagacttatcgatgagtttcttgccaaatctggcgtttccagatgcgttgatttcaaggagactgctgaaatgattgccaaggtgggtttcaagatgtttttgggggtcactgcatcagtgtcaagctgggacgcggatgggacttgctgcagtataatcttggaagacaatccactcgttgatttcgtggagcttcccgatacttgccaaggcctttactactgcaacgtcctaagtggagtcattagaggcgctttggaaatggtgtcaatgaagacagaagtgacatggacgcgtgatgctcttcgaggggatgatgcttatgaattgcaggtgaagctactgaagcaagtcgctgaggagtatccgtacaaggatgatgaataaatggtctctttctctatggctcttttttttcttccagaaacacaaactttaagctttgaaactaancactgttaatgttggcacaaact

SEQ ID NO: 3775 - DNA, 850 bp, Brassica rapa
gtggaaaaccaaaggaatcagagagataaaacttgtgggaaccaaccgaagtctgaatctcgaccagatcaaaagcaaacacaacgagaagtagaacctaaaccttctttgttggtgagattcagacatggctcctgtcggtcctcgttccggtgatgccatcttctccagcatcgatcgcgtgaacgcagagttgttcacgttgacgtatggtgcaatcgtgcgccagttgcttactgacctcgaagatgtcgacgaagtcaacaaacagcttgatcaaatgggatacaacattggaatcagacttatcgatgagtttcttgccaaatctggcgtttccagatgcgttgatttcaaggagactgctgaaatgattgccaaggtgggtttcaagatgtttctgggggtcactgcatcagtgtcaagctgggatgcggatgggacttgctgcagtataatcttggaagacaatccactcgttgatttcgtggagcttcccgatacttgccaaggcctttactactgcaacgtcctaagtggagtcattagaggcgctttggaaatggtgtcaatgaagacagaagtgacatggacgcgtgatgctcttcgaggggatgatgcatatgagttgcaggtgaagctactgaagcaagtcgctgaggagtatccgtacaaggatgatgaataaatgggctctttctctatcttgcattcttagcttctttggctcttttttcttcaagaaacaccaactttaagctttgagacttaatactgttttatgtttggcgcaaaccgattaatccatttcttagctgaaatcaaatcgtatacagatcaattcagtggg

SEQ ID NO: 3776 - DNA, 779 bp, Brassica rapa
ggaccagatcaaaagcaaacacaacgagaagtagaacctaaaccttctttgttggtgagattcagacatggctcctgtcggtcctcgttccggtgatgccatcttctccagcatcgatcgcgtgaacgcagagttgttcacgttgacgtatggtgcaatcgtgcgccagttgcttactgacctcgaagatgtcgacgaagtcaacaaacagcttgatcaaatgggatacaacattggaatcagacttatcgatgagtttcttgccaaatctggcgtttccagatgcgttgatttcaaggagactgctgaaatgattgccaaggtgggtttcaagatgtttctgggggtcactgcatcagtgtcaagctgggatgcggatgggacttgctgcagtataatcttggaagacaatccactcgttgatttcgtggagcttcccgatacttgccaaggcctttactactgcaacgtcctaagtggagtcattagaggcgctttggaaatggtgtcaatgaagacagaagtgacatggacgcgtgatgctcttcgaggggatgatgcatatgagttgcaggtgaagctactgaagcaagtcgctgaggagtatccgtacaaggatgatgaataaatgggctctttctctatcttgcattcttagcttctttggctcttttttcttcaagaaacaccaactttaagctttgagacttaatactgttttatgtttggcgcaaaccgattaatccatttcttagctgaaatcaaatcgtatacagatc

SEQ ID NO: 3777 - DNA, 796 bp, Brassica napus
gaccagatcaaaagcaaacacaacgagaagtagaacctaaaccttctttgtcggtgagattcagacatggctcctgtcggtcctcgttccggtgatgccatcttctccagcatcgatcgcgtgaacgcagagctgttcacgttgacgtatggtgcaatcgtgcgccagttgcttactgacctcgaagatgtcgacgaagtcaacaaacagcttgatcaaatgggatacaacattggaatcagacttatcgatgagtttcttgccaaatctggcgtttccagatgcgttgatttcaaggagactgctgaaatgattgccaaggtgggtttcaagatgtttttgggggtcactgcatcagtgtcaagctgggacgcggatgggacttgctgcagtataatcttggaagacaatccacttgttgatttcgtggagcttcccgatacttgccaaggcctttactactgcaacgtcctaagtggagtcattagaggcgctttggaaatggtgtcaatgaagacagaagtgacatggacgcgtgatgctcttcgaggggatgatgcttatgaattgcaggtgaagctactgaagcaagtcgctgaggagtatccgtacaaggatgatgaataaatggtcactcactcctatgtctagtctctttctctatggctcttttttctcttccagaaacacaaactttaagctttgaaactaaacactgttttatgtttggcacaaactgattaatccatttcttagctgttttataaatcaatgtgagaagagttgagcgtatcaa

SEQ ID NO: 3778 - DNA, 811 bp, Brassica napus
gaatctcgaccagatcaaaagcaaacacaacgagaagtagaacctaaaccttctttgttggtgagattcagacatggctcctgtcggtcctcgttccggtgatgccatcttctccagcatcgatcgcgtgaacgcagagttgttcacgttgacgtatggtgcaatcgtgcgccagttgcttactgacctcgaagatgtcgacgaagtcaacaaacagcttgatcaaatgggatacaacattggaatcagacttatcgatgagtttcttgccaaatctggcgtttccagatgcgttgatttcaaggagactgctgaaatgattgccaaggtgggtttcaagatgtttctgggggtcactgcatcagtgtcaagctgggatgcggatgggacttgctgcagtataatcttggaagacaatccactcgttgatttcgtggagcttcccgatacttgccaaggcctttactactgcaacgtcctaagtggagtcattagaggcgctttggaaatggtgtcaatgaagacagaagtgacatggacgcgtgatgctcttcgaggggatgatgcatatgagttgcaggtgaagctactgaagcaagtcgctgaggaatatccgtacaaggatgatgaataaatgggctctttctctttctctatcttgcattcttagcttctttggctcttttttcttcaagaaacaccaactttaagctttgaaatttaatactgttttatgtttggcgcaaaccgattaatccatttcttagctgatttataaaaatcaatgtgagaagagttgagcgtatcctat

SEQ ID NO: 3779 - DNA, 1218 bp, Pinus taeda
tcacttaacgcatctacaaggttcatacattttaatctcaacaatgatgttgccagcccctaaactttcttggtttgcttccgaccttacagcggtacctttggtctccgtttgaatatttgcatccaaacttgtatcctatataagccgaaagcattcgagagtaaagctgcaacaacagcagaaggaagaagaaaggaagtataatccaggttatcatggctcccctcgtaccgagatcaggcgatgcagtctttgcaaatgtcgaacgcgtgaatgcggagctcttcactctcacctatggagccattgtgcgccagctgctaactgattttgaagaggttgaagaagttaataagcagcttgatcaaatgggttataacattggcattcggcttatagatgaatttctagcgaaatcaaatattacgagatgtgttgattttaaagagacagcagaagctattgcaaaggtaggcttcaaaatgttcctgggggtgacagcaagcgtaactaactgggatgcagatggaactgaatgcagtcttatccttgaggataatcctcttgtagactttgttgagttacctgagacttgtcaaggcctttattattgtaacgtattatgtggtgtcatacgtggagcacttgaaatggtctctatgaaaactgaagttagatgggttcgggatatgctttctggggatgatgcatatgaattgaagttgaaacttctagagcaagttcctgaagaatacccttacaaggatgacgagtaatctgtcaggtgtctgcttcaaattggttcaaaatttacatggttcaaatagcatttcttcccgtggtggacgtgtagtttttgttgtatcattgttatattattatttgtggatgatgatcatggtcagaagccatatagttaagcatattttgtttgttctagaaaaattgttggcatcacactctactgaattagtttttatgtgtttttcttttacgagtaactctgaatagtatctgatttgtttggaaacaactacagattccaaccctgatgggtgtgcatttccttttgaagggcctttacatgatgtcttgatattaatctatttatgacatattctccagatcagttagtggatgtaatgaaccatatattggtattgtgtaatatgaattcgaggaaaaaatatatatattttttgagcttctgctgaa

SEQ ID NO: 3780 - DNA, 874 bp, Raphanus sativus
ggagtggaaaaccaaaagaggcagagagatagacacctcgcgacataaaccgaagtctgaatctaatcctaccagatcaaaagcaaacacaaccagaacgaggaaaaccttctttgtcggtgagattcagacatggctcctgttggtcctcgttccggtgatgccatcttctccagcatcgatcgcgtgaatgcagagttgttcacattgacgtacggtgcaatcgtgcgtcaattgcttactgaccttgaagatgtcgatgaagtcaacaaacagcttgatcaaatgggatacaacattggaatcagacttatcgatgagtttctagccaaatctggcgtttccagatgcgttgattttaaggaaactgctgaaatgattgccaaggtgggtttcaagatgtttttgggggtcactgcatcagtctcaagctgggacgcggacgggacttgctgcagtatcatcttggaagacaatccactcgttgatttcgtggagcttcccgatacttgccaagggctttactactgcaacgtcttaagtggagtcatcagaggcgctttggaaatggtgtcaatgaagacagaagtgacttggacgcgtgatgctcttagaggggatgatgcttatgagttgcaggtgaagctactgaagcaagtcgctgaggagtatccgtacaaggatgatgaataaattgtcactcccatgtgtagcgtcttggctcttcttttcttcttccagaaacacaaactctgagctttgaaactgaatactgttttatgtttggcacaaacctattaatccatttcttagctgttttataactcaatgtgagaagagtcgagcgtatcaatatcactgaaatcaaatcaca

SEQ ID NO: 3781 - DNA, 831 bp, Brassica napus
ctcgaccagatcaaaagcaaacacaacgagaagtagaacctaaaccttctttgtcggtgagattcagacatggctcctgtcggtcctcgttccggtgatgccatcttctccagcatcgatcgcgtgaacgcagagttgttcacgttgacgtatggtgcaatcgtgcgccagttgcttactgacctcgaagatgtcgacgaagtcaacaaacagcttgatcaaatgggatacaacattggaatcagacttatcgatgagtttcttgccaaatctggcgtttccagatgcgttgatttcaaggagactgctgaaatgattgccaaggtgggtttcaagatgtttttgggggtcactgcatcagtgtcaagctgggatgcggatgggacttgctgcagtataatcttggaagacaatccactcgttgatttcgtggagcttcccgatacttgccaaggcctttactactgcaacgtcctaagtggagtcattagaggcgctttggaaatggtgtcaatgaagacagaagtgacatggacgcgtgatgctcttcgaggggatgatgcttatgaattgcaggtgaagctactgaagcaagtcgctgaggagtatccgtacaaggatgatgaataaatggtcactcactcctatgtctagtctctttctctatggctcttttttctcttccagaaacacaaactttaagctttgaaactaaacactgttttatgtttggcacaaactgattaatccatttcttagctgttttataaatcaatgtgagaagagttgagcgtatcaatatcactgaaatcaaatcatatacagtttcac

SEQ ID NO: 3782 - DNA, 733 bp, Cynodon dactylon
gccgggggggcctggtgcggcagctgctcacggatctggaggaggtcgaggaggtcaacaagcagctcgatcagatgggttacaacattggaacaagattggttgatgagttcttagcaaagtcaaatgtttcaaggtgtgttgacttcaaggaaactgctgatgtcatcgccaagcttggatttaagatgttcttgggtgtgactgcaactgtaaccaactgggatgctgagggtaccacttgcagctttgtactggaggataatcctcttgtagactttgttgagcttcctgacacttgccaaggccttcagtattgcaatgtgttaagtggagttattaggggagcattggaaatggtttctatgaaaacagaggtcacatgggttcgtgacatgcttcgtggggatgatgcttatgagatgcgggtgaagcttatcaagcaagtcccggaggaatatccgtacaaggatgatgactagttatagttccagtgggattgcttgcctggaggccatttgcttatttggactttcattctgctggcctctaaatgttgctttggtattaacgtaatgtcacatgaggaaaccgtgcattccagttatatttggtgtgtgtgttgctgatgtattgtagagatataatggggccatgctgagtttcgtaaattctgtcagggcacttgtgatgctctgtaattccagccgttgcatcctgaaataagtatttt

SEQ ID NO: 3783 - DNA, 887 bp, Flaveria ramosissima
cgtcaatcgcaggtgagatcggtagatttcgaccctagcgactaaccaaatcgaatcgctttgctgattgcgatccagaggaggtgctatatttctccctcagatagattctgtagcaagacctgcaaactgtgttcaattgcacgctgtattgctagctaatcaaccaatactagaccttcaatggctcccgcagttccgagatctggtgatgctatattcgccaacgtcgaacgtgtgaatgctgagttgttcacactgacgtatggggcaattgtgcgacaattgcttacggatctggaagaggttgaggaggttaataagcagcttgatcaaatgggttacaacattggaatccggctgattgatgaatttcttgcaaagtctaatgtcacgagatgtgttgattttagggaaaccgctgaagtcattgccaaggttggattcaagatgtttttaggggtaactgcatctgtgactaactgggatacagagggaactagttgcagtctcaattttggatgataacccgcttgtagactttgttgagcttccagatacctgcctaaggttttatattattgcaacattttaagtggagttgttaggggagctctggagatggtgtcgatgaagacggtaggtcacatgggtcagggatatagcttagaggtgatgatgcattcgagtacaagtgtaagcttcttaaacagttccagaggagtatccatacaaagtatgacgagtaacgtgcttttaatctctattgatgtatatacaaatattgtatttttcgctattttccgttttggcttagccataaattaagaatacatctttagactttgtcctaagttgtcatgcttagaataacatgttttcttcct

SEQ ID NO: 3784 - DNA, 741 bp, Cynara scolymus
ggactccatggctcccgtcgttccagatctggtgatgctatatttgccaacgttgagcgcgtgaattctgagctgtttactctcacgtatggggcaatcgtgcgacaattgcttacggatctggaggaggttgaagaagtcaataagcagctcgatcaaatgggttacaacattggaatccggctgattgacgagtttcttgctaaatctaatgtcacaagatgtgttgattttagggagacagctgaagtcattgcaaaggttggcttcaaaatgtttttaggtgtcactgcatctgtgacaaactgggatgcggagggaacttgttgcagtctcattttggatgataatccacttgtagattttgttgagcttccggatacctgtcaaggcttatattactgcaacattttaagtggagttgtcaggggagctcttgagatggtgtcaatgaagaccgaaatcacatggattagggatatgcttagaggcgatgatgcattcgagttacaggtgaagcttcttaaacaagttccagaggaatatccatacaaagatgatgagtagcataatctttaatgatttttgcatttcatggtttgtgatagtacttgtttagcattcggttctgtattttgttatgctagaacgaacctatttcatctccagcgcttggtagtgtcgctgtaattgaagatttggatcggaactattattatcacaaatggtcaagaaattcct

SEQ ID NO: 3785 - DNA, 1074 bp, Pinus pinaster
atgttgcgagcgcctaactttcttggtttgcttccgaccttacagcggtacctttggtctccgtttgaatatttgcatccaaacttgtatcctatataagccgcaagcattcgagagtaaaactgcgacaacagcagaaggaagaagaaaggaagtataatccaggttatcatggctcccctcgtaccgagatcaggcgatgcagtctttgcaaatgtcgaacgcgtgaatgcggagctcttcactctcacctatggagccattgtgcgccagctactaactgattttgaagaggttgaagaagttaataagcagcttgatcaaatgggttataacattggcattcggcttatagatgaatttctagcgaaatcaaatattacgagatgtgttgattttaaagagacagcagaagctattgcaaaggtaggcttcaaaatgttcctgggggtgacagcaagcgtagctaactgggatgcagatggaactgaatgcagtcttatccttgaggataatcctcttgtagactttgttgagttaccggagacttgtcaaggcctttattattgtaatgtattatgtggcgtcatacgtggagcacttgaaatggtctctatgaaaactgaagttagatgggttcgggatatgctttgtggggatgatgcatatgaattgaagttgaaacttctagagcaagttcctgaagaatacccttacaaggatgacgagtaatctgtcaggtgtctgcttcaaattggttcgaaatttacatggttcaaaaagcacttcttcccgtggtcgacttcttgtatcattgttatatcattatttgtggatgatgatcatgttcaaaagccatatagttaagcatattttgtttgttctagaaaaattgttggcatcacacactatcttggattagttttttctgtgtttttcttttacgagtaactctggatagaatctgatttgtttggaaacaactacagattccaaccctgatgggtgtgcatttcctttagaagggcctttacttgatgtcttgatattaatctatttatgacatattctctg

SEQ ID NO: 3786 - DNA, 750 bp, Eutrema parvulum
attgagagaataattctagggggtgagattcagagatggctccggttggtcctcgctccggtgatgcgatcttctccagcattgatcgtgtgaatgcagagttgtttacgttgacgtatggtgcaattgtgcgtcaattgcttactgacctcgaagaagtcgaggaagtcaacaagcagcttgatcaaatgggatacaacattggaatccgacttatcgatgagtttctagccaaatctggtgtttccagatgcgttgatttcaaggaaactgctgaaatgattgccaaggtgggtttcaagatgttcttgggggtcactgcatcagtgtcaagctgggacgtggatgggacttgctgcaatataatcttggaggacaatccgcttgttgatttcgtggagcttcctgataattgccaaggtctttactactgcaatgtcttaagtggagtcattagaggagctttagaaatggtttcaatgaagacagaagtgacgtggacacgtgatgttcttcgaggagatgatgcttatgagttgcaggtgaagttactaaagcaagttgctgaggagtatccttacaaggatgatgaataaatgtcactctcatcttcacttatccccaaagagaaactaattactatttgtagtctctttctattgctgcattcttagcttcttcttttttcccggaaacacaaaatttaagctttgaaacttgatactgctttatgtttggtacgatcagcat

SEQ ID NO: 3787 - DNA, 828 bp, Medicago truncatula
aaacccaaatcaacaaaactccatcccgtcgcgccgcgtcggagaacctaatcatccctcagccacacctggacagttgcaaccgcgtcacagccaccaccggaaaatcccaacgtaagcaaggatagcaaaacaaaccagagtgagctctaactatggctcctgttgctcctcgatctggtgatgcaatatttgctaacatcgaacacgttaatgcagaactgtttactctgacatatggggcaattgtgcgtcaattgcttacagatctggaagaggttgatgaagttaacaagcagctagatcaaatgggttataacattggaatccgtttgattgatgagtttttggctaaatctaacgtctcaagttgtgttgatttcagagagacggctgaggtgattgcaaaggttggtttgaaaatgttcattggtgttactgcatctgtgaccaattggaatgccgaagggacatgttgtagtattgttttggaggataatcctttggtagattttgttgagcttcctgacacttatcaaggtctccactactgcaacatattaagtggagtcattagaggagccttagatatggtgtcgatgaaggctgaggtcacttggctacgtgacgcgcttcgaggtgatgatgtgtttgaattgcaagtaaaacttctcaagcaagttccagaagagtatccatataaggatgatgagtaattgtaacgttgcacttgatcatttcctaagtattagtttatcatcttaatgccgatgtgtgcattttgatgaacctatagaaaacattaaattaagttattataatatttgc

SEQ ID NO: 3788 - DNA, 965 bp, Medicago truncatula
ggtagccaacgagaattttcagttaaacccaaatcaacaaaactccatcccgtcgcgccgcgtcggagaacctaatcatccctcagccacacctggacagttgcaaccgcgtcacagccaccaccggaaaatcccaaccaaaacaaaccagagtgagctctaactatggctcctgttgctcctcgatctggtgatgcaatatttgctaacatcgaacacgttaatgcagaactgtttactctgacatatggggcaattgtgcgtcaattgcttacagatctggaagaggttgatgaagttaacaagcagctagatcaaatgggttataacattggaatccgtttgattgatgagtttttggctaaatctaacgtctcaagttgtgttgatttcagagagacggctgaggtgattgcaaaggttggtttgaaaatgttcattggtgttactgcatctgtgaccaattggaatgccgaagggacatgttgtagtattgttttggaggataatcctttggtagattttgttgagcttcctgacacttatcaaggtctccactactgcaacatattaagtggagtcattagaggagccttagatatggtgtcgatgaaggctgaggtcacttggctacgtgacgcgcttcgaggtgatgatgtgtttgaattgcaagtaaaacttctcaagcaagttccagaagagtatccatataaggatgatgagtaattgtaacgttgcacttgatcatttcctaagtattagtttatcatcttaatgccgatgtgtgcattttgatgaacctatagaaaacattaaattaagttattataatatttgcttcgacaacggactaggatctatgcaagccctcgagattcttgaaactgatcttgttctgtcattctttgctgtttgtatgggttcattttagttgcaattcaaaacttggttcttggtgcttcaaa

SEQ ID NO: 3789 - DNA, 547 bp, Vinca minor
atcagcaggaaaaaaaacgaaattcctcgccgatctccaatggctcccgtcgctcctaggtccggtgacgctatttttgccagcgttgaacgtgtgaacgctgaacttttcactctaacatatggcgcgatcgtccgtcaactgcttacggatctggaagaggtcgaggaagtcaacaaacagctagatcagatgggatataacattgggatccgattaattgatgagtttcttgcaaaatcgaatgtctctggttgtgttgatttcaaagaaacagctgaagtcatagctaaggttggttttaaaatgttcctaggggtgactgcaactgtaactaattgggatgctgagggaacaacatgcagcttaattttggaggacaacccattggtagattttgttgaacttcctgatacatgtcaaggcttgtattattgcaacatcctaagtggagtcatcagaggagctttagagatggtttccatgaaaactgaagtaacatggatacgtgacatgctaagaggtgatgatgcttatgaaatgcagg

SEQ ID NO: 3790 - DNA, 897 bp, Gnetum gnemon
ggaagcaatgatcctttaataataataattaagaatggaaatcaataattaccctaaagtaagaaaggaagcctttgcgtttctgttctgctaaatttgttaaatagaacgtttgaatgaaattaaaagacgcaggaggattgaaggagagatttgttgcaacgggtccttgagattcgataatggctcctttagtccccagatccggcgatgcggccttcgctaatgttgagcgcgtgaacgcagagctttttacccttacttatggagccattgtgcgtcagctgctcacggacttcgaggaagtcgaccaggtcaacaagcagcttgatcaaatggggtataacattggtattcggcttatagatgaatttctagcaaagtcaaatgtgacaagatgtgttgatttcaaagagacagcagaggtcatcgcaaaggtgggcttcaaaatgttcttgggtgtgacagcaaatgtcactaattgggattccgatggcactgaatgcagtctcattttggaggataatccacttgtggactttgttgaattacctgacaactgccaaggcctctactactgtaacatactgtgtggtgtcatacgtggagctcttgaaatggtatctatgaaaacagaagttaaatgggttcgggacatgcttcgtggggatgaggcatatgaattgaggttgaaacttttagagcaagtccctgaggtttacccttacaaagatgaagaataattgtatatcttttataatttggcatgaaggcatgaaaatgtggttgaggagtttggtgaaactttgcaattctttaatgtaattatgaaattattttctttcttttggaaaagtcataatttttctctattaggggtataacaaaggttgggta

SEQ ID NO: 3791 - DNA, 825 bp, Podocarpus macrophillus
ggagatgcagtctttgccaatgttgaacgcgttaatgcagagttgtttacacttacatatggagccattgtgcgccaattgctcactgatttcgaagaggtggaagaagtcaataaacagctcgatcaaatgggctataacattggcatccggcttatagatgaatttttggccaaagcaaatgtttcgagatgtgttgactttaaagagacgtcagaagttattgcaaaggtaggtttcaaaatgttccttggtgtgacagcaaatgtcactaactgggatgtggatggtactgaatgcagtcttatcctcgaggataatcctcttgttgactttgttgaactacctgagacatgccatggtctttactactgcaatgtcttatgtggagtcattcgaggagcacttgaaatggtctctatgaaaactgaggtcagatgggttcgagatatgcttcgtggggacgatgcttatgaattgaagttaaaacttctagagcaagttccagaggaatatccatacaaagatgaggactaattagtcagttgtattcttcataccaattagaaatccacatggcttaaaagctttgcctgactaacttttgatgaaagttttgtcatattcttgctttaattttttgttgaatattttcaaacctcaattgtgttcaatgaggttcagaacttttattattggaatttattttagtgattttgttgggaactccacatgtagccctttgaaattggttagttgttattgatgacaatcttcatgggtatatactcatgaagttctttggtggtagcttttagtatgatc

SEQ ID NO: 3792 - DNA, 1155 bp, Cryptomeria japonica
ggagctctggcagagtactaagaaaacaaatatccgacaaaacgctcttgaaaccaaattctgttcgtttcttcaattttaaagcgaaactgctgtactgccatagatctgacagaagaaagctgtggtaggaagtagacaaaaaataccagggtatcaccatgtctcggctcgttccaagagcaggagacgcagtctttgctaatgttgagcgagtgaacgcagagctgttcacccttacctacggtgccattgtgcgccagttgcttactgatttcgaagaggttgaagaagtaaacaaacagctcgatcaaatgggttataacattggaatccgtcttattgatgaattcttagcaaaagcaaatgttgcaagatgtgtggacttcaaagaaacaacagatgttattgcaaaggtaggtttcaaaatgttccttggtgttacagcaactgtggctaactgggatgcagatggtactgaatgcagccttatccttgaggataatcctcttgttgactttgttgagttacctgagacatgccatggcctttattactgcaatgttttatgtggagttattcgaggagcgcttgaaatggtatctatgaagactgaagtcaggtgggttagggatgtgctaaggggagacgatgcttacgagttgaagttgaaacttctagaacaagttcctgaagaatatccgtacaaagatgaggaataaacagccagttggtctctccgtaccagttataaatttgtgtttttgaagcaatttctgtcccgatgaatccgagagtatgcttcagtatattatttccagaatattatttctgtgttattttatgaaccacgccctccattattgctaaagcagtattttttcaaattatttttctttaatgtggaactcaatacatggcccttgcaatgtacaaaataaaggtattcttctgactcttcacttaatataaaattatgtagagccttacttcttaatgacgtatgactagcatatgcctaccttcatgggtgtatgtcctcacaaaagtgcattgttggatgctttcattttaacttgtttccgaatacatatttttcagctcacatgccagacttggtgaaggctgtattgataatataatttgaatttgagg

SEQ ID NO: 3793 - DNA, 761 bp, Ipomoea nil
cggaagtcgaaagcacactcgaaatcccacatactttgtagtttgtactaaattaagagtagcagctcggatcgaaggcttccatggctcccgtcgcccccagatctggagacgccattttcgccaacgtagagcgagtgaacgcggagctcttcactctaacgtatggcgcgatcgtgcgtcaactgctcaccgatctggaggaggttgatgaagtcaacaagcagcttgatcaaatggggtataacattggagttcggctaattgatgagttccttgcaaagtcgaatgtttctagatgtgtggatttcaaggaaacggctgaagtcattgccaaggttggttttaaaatgttcttgggtgtcacagcaactgtgtccaattgggatgcggatggaacaacctgcagtctaattcttgaggacaacccactggtggactttgttgagcttcctgatacttgtcaaggtctatattattgcaatatcttaagtggagttgtcaggggggcattagagatggtgtcaatgaaaactgaggtcacttggatccgtgatatgcttcgaggggatgatgtgttcgagttgcagttgaagttgctcaagcaagttccctaggagtacccttataaggatgatgagtaacatgctttctttatgctcagtataatgtaaatacaatttgtcaagttttgtgcttgtccttacttaataattacttaaacattacactttagtttctttccttccctgattgacttt

SEQ ID NO: 3794 - DNA, 1061 bp, Sciadopitys verticillata
gaccgcattgttagtattacgttttctataatagacttacaaaacactacctagtacatctaacgtcttggacagcagctgcactatttagatctgcagtattcttgaaacaatcaagctctgaaacggcagcggagaatattgtgatggctcgcctcgttccaagagcaggagatgcagtatttgcaaatgttgaacgcgttaatgcagagctgttcactcttacatacggggccattgttcgccagttgcttaccgatttcgaagaggtagaggaagtgaacaaacagctggatcaaatgggatataatattggaattcggcttatagatgaatttttagccaaagcaaatgttgcaagatgtgttgatttcaaagagacagcagaagttattgcaaaggtaggcttcaagatgttcctcggtgtgacagcaagtgtgactaattgggatgcggatggtactgaatgcagtattatccttgaggataatcctcttgttgactttgttgagttacctgagacatgtcatggcctttactactgcaatgttttgtgtggagttattcgaggagcacttgaaatggtatctatgaaaactgaagtcagatgggttcgggatatacttcggggagatgatgcatatgaattaaagttgaaacttcttgaacaagttcctgaagaatatccatacaaagatgatgagtaataaatcagatgttgacctcataccacttggaaatttgatggttcaaaagccatttctgtccttactaatccaagtgtaagttttgttatattatttgtcgattatattcaggaaccatgtactcaattatgccttacttatgttcaagaggccaaaaattgtcatcagtacactttgcttttatttaatttttatccttcgggcttacatgagaagctctgttcatggcccttgagattggcttaattcaagtattatctaaatctgactatgaaagattatgtagagtcggatgtcttaataagatattactaacaaagcccttagaaacacctaggtcttaagaatttgcac

SEQ ID NO: 3795 - DNA, 941 bp, Cephalotaxus harringtonia
aaacttgcaggatattatcatggctcggctcgttccaaaagctggagatgcagtctttgctaatgttgaacgagtgaatgcagagctcttcactcttacatacggggcaattgtgcgccagttgcttactgatttcgaagaggtagaagaagtaaacaaacagctcgatcaaatgggttataacattggcattcggcttatcgatgaatttttagcaaaagcaaatgttgcaagatgtgttgacttcaaagaaacaacagaagttattgcaaaggtaggtttcaaaatgttcctcggtgttacagcaaatgtgtctaactgggatgcagatggtactgaatgcagtcttatcctcgaagataatcctcttgtcgactttgttgagttacctgagacatgccatggcctttattactgcaatgttttatgtggagttattcgaggagcgcttgaaatggtatctatgaagactgaagtcaggtgggttcgggatattcttcggggagatgatgcgtatgaattgaagttgaaacttctagaacaagttcctgaagaatatccatacaaagacgaggaataacgagtcggttatccttttatgactagtccgttgtgtctgtgtaccattgctacagtatatcttgcacattattttccagaatatgcccttcattatgttcaaaaagtccagaattgtcattaatgcactttgtttttatttactttttaattgttgtgcttttgtgagaaactgaatacacggcccttgaaattggcatagttcaggtattttctaaatattacttttatcagattaggtagaccctgacttcttaatgacatatggctaacatatgcatactaccttcatgggtctgtgtcctcgtgaaggcacattgttggatgttttcattttaacatttatatgtatagatactaac

SEQ ID NO: 3796 - DNA, 911 bp, Taxus baccata
caaaggaatgagcgaaattcactcttcatttcttacttgtatttggtcctaaagtttctctactgttacagatctcacagaaggaaactgtgtaatcggaagaaaagaacaaatagcaggattttatcatggctcgcctcgttccaagagccggagatgcagtatttgccaatgttgaacgggtgaatgcagagctcttcactcttacctatggggccatcgtgcgccagttgcttactgatttcgaagaggtagaacaagtaaacaaacatctcgatcaaatgggttataacattggcattcggcttattgatgaatttttagcaaaagcaaacgttgcaagatgtgttgacttcaaagaaacaacagaagttatcgcaaaggtaggtttcaaaatgttccttggcgttacagcaagtgtggctaactgggatgcagatggtactgaatgcagtctaatcctcgaggataatcctcttgtcgactttgttgagttacctgagacatgccatggcctttattactgcaatgttttgtgtggagttattcgaggagcacttgaaatggtatctatgaaaactgaagtcaggtgggttcgggacatgctacgaggagacgatgcgtatgaattaaagttgaaacttatagaacaagttcctgaagaatatccatacaaagatgatgaataaccagacaaagatgaggaatagccaattacttgccctcttatgactgatctgtgtatcattgttatgctattatttgtccattatttcatgaacttcccctcaattatgttcaaaaggttcggaattgtcagtaaatgcacttttttaaatttaatttttaattgttgtgcttgtgtgaggaacttaatacgtggcccttgaaattctcataattgagctatt

SEQ ID NO: 3797 - DNA, 948 bp, Eragrostis curvula
ccacctttcgggccgaacctcgtttggctcgtcgcctgctaagcccacgtggcatcgccggcgacgttgtcctcgccgtcggcgagaggagccccgcgatgccgcctcttacgccgcccaagtccggcgacgccctcttcgccagcgtcgaccgcgtcgtaagcttctgaaccgtcgccccgcggaattcccggggctaaatctggtcctgatatgatcgccttcttctgcttcgttggttgcagaatgcggagctgttcacgctcacgtacggcgccatggtgaggcagctgctcacggatctggaggaggtcgaggaggtcaacaagcagctcgatcagatgggttacaacattggaacacggttggttgatgagttcttagcaaagtcaaatgtatctaggtgcgatgacttcaaggagactgccgatgtcatcgcgaagcttggatttaaaatgttcttgggtgtgactgcaactgtaaccaattgggatgctgaaggtaccacttgcagctttatattggaggacaatcccctagtagattttgttgagctacctgacacctgccaaggtcttcagtattgcaatgtgttaagtggagttattaggggatcactggaaatggtgtctatgaagacagaggtcacttgggtccgtgacatgcttcgtggggatgatgcctatgagatgagggtgaaacttatcaagcaagtcccggaggagtacccctacaaggatgatgactagtttgattcagggaggtttcttcctgcaggcggccatttgcttgcttagattttcattgtgctgtcctctgtggatcttgttcttgtattgcatgatgccacatgaggaagccgtgcactgtgatatttggtgtggtgctaatgtattgtagagatattatgccacctttatgcttccaggctttggattaattttggtt

SEQ ID NO: 3798 - DNA, 730 bp, Panicum virgatum
gcagctgctcacggatctggaggaggtcgaggaggtcaacaagcagctagatcagatgggttacaacattggaacacggttgattgatgagttcttagcaaagtcaaacgtatcaaggtgtgttgacttcaaggagactgctgatgttatcgcaaagcttggatttaagatgttcttgggtgtgactgcaactgtaaccaattgggatgccgagggtacaagctgcagctttatattggaggacaatcctcttgttgattttgttgagctccctgacacttgccaaggccttcagtattgcaatgtgttaagtggagtaatcaggggagcattggaaatggtgtctatgaagacagaggtgacatgggtccgtgacatgctccgtggggatgatgcctatgagatgcgtgtgaagcttatcaagcaagtccccgaggaatacccctacaaggacgatgactagtttgagtttaagcgaagttcctgcagcagggcgctagtttgcttgtctggatgttaattttgttgtggatatagtcctggtattacatgatgtcacaagagtaaactgttgattgcatttacaattgtcgtgtgtattactggtgtattgtagaaatattgcatatcttccatgccttgtggctttgaattaatccggtgaattacgggcatctgtgctgctctggatcgttcctgctgtgctagcaaaaataaagtttttttcttt

SEQ ID NO: 3799 - DNA, 750 bp, Zostera marina
ggggagaaaataaaatacaacttgtggttttccggtaaggatctatcggttctgtgaaatcaccaagtaattttggagggtcttatctgtcatcatgcagaacgcagagctgtttactctgacctacggggcgattgtgagacagctgctaacggatctggaagatgttgacgaggttaacaagcaacttgatcagatgggctataatattggaattcgtttgatcgatgagtttttggcaaagtctaatgtttcacgatgtgtcaattttaaggaaacagctgaagtgattgcaaaggttggtttcaaaatgttcttagggatcacagctacagtaacgaattgggatgtggatggaagtagctgtagtcttgttttggaagataatccccttgtagatttcgtagaacttcctgatatgtgtcagggtctttattactgcaacgttcttagtggtgttatcagaggagcattggaaatggtctcaatgaagacagaagtgacatgggtccgtgatatgctgcgtggagacgacgcatatgaactacgcctcaaacttctgaagcaagttccagaggaatacccttacaaagacgatgagtgattcttctatttctgaagcaacttttgttttttttttaaataaaaatctaaacacgattatttgccttacgttgaacatttattgatcaaatttacatcatgtttcaattatttcttatgtgatcgggattatttcttgtcaaactc

SEQ ID NO: 3800 - DNA, 879 bp, Saccharum officinarum
catagcacttcctaggacccagcaacacaacagccgagctttgtttaggcaagatgaacaggaagccgggagactgggactgcagggcgtgccagcacctcaacttcagccgtcgggacatatgccagcgctgcagtgaaccacgtggggtcactgatcgtggcagcggtggtggaggtgactatgccaacttcggtggccgtggtggttcctccttcggcggtggctttggtgctggctctgatgtccgccctggtgactggtactgctcctgcggtgcacacaacttcgccagccgctccagctgcttcaagtgctctgcctacaaggaggaggctgctgtaaacagtggtgctggtggctttgatagtgacatgtcacgctcacggggctacggcttcggcagcggtgctgcccgtaccaaccgccccggttggaagtctggagactggatctgcaccaggtctggatgcaacgagcacaactttgctagcaggatggaatgtttcaggtgcaacgcaccacgggactccggtagcgctgccatgacctacgaaaattacttgcactgaggcgtaggagccaagtttgcagcgtcgacgaagcagaagcagcaagaagaggagtcctcacatcataagagagtagtagatttgcaaaagacatccgcgatgctccattactagttttgttccacccctaccgtaatttcttttagatttggttcgttctcatccccatttgggacagtaccccggacctatgtttgctgttttatttccgttcgttcatctccgcatgtttgcgcttggatcgagtcctgtgatgtaaccccaaaacgcttgcttcacaagtattaactagtactgttgcttctta

SEQ ID NO: 3801 - DNA, 1086 bp, Sorghum bicolor
taactcccctcttctttctagttttacgtgattcccttgttcttcgcgggccaaagtgcactaagaatcaaaggcacaaagatagctcaccctcggtttcagcatcccctccacacttcactataaatacccctgcacatacgcaccttgctgcatcaccatttcacttcatagcacttcctaggacccagcaacacaacagccgagctttgtttaggcaagatgaacaggaagccaggagactgggactgcaggtcgtgccagcacctcaacttcagccgtcgggacatatgccagcgctgcagtgaaccacgcggagttgctgatcgtggcagtggtggtggaggtgactatgccaacttcggtggccgtggcggttcctccttcggaggtggctttggtgctggctctgatgtccgccctggtgactggtactgctcctgcggtgcacacaacttcgccagccgctccagctgcttcaagtgctctgcctacaaggaggaggctgctgtaaacagtggtgctggtggctttgatagtgacatgtcacgctcacggggctatggcttcggcagcggtgctgcccgtaccaaccgccccggttggaagtctggagactggatctgcaccaggtctggatgcaacgagcacaactttgctagcaggatggaatgtttcaggtgcaacgcaccacgggactccggtagcgctgccatgacctacgaaaattacttgcactgaggcgtaggagccaagtttgcagcgtcgtcgacgaagcagaagcagcaagaagagaggagtcctcagctcacatcataagagagtagtagatttgcaaaagacatccttgatgctctattactagttttgttccacccctaccgtaatttcttttagatttggttcgttctcatccccatttgggacagtacccccggacctattatgtttgctgttttatttccgttggttcatctccgcatgtttgcgcttggaatcgagtcatgtgatgtaaccccaaaacgcttgcttcacaagtattaactagtactgttgcttcttaatatctcggggcgttcatcttgt

SEQ ID NO: 3802 - DNA, 1117 bp, Sorghum bicolor
taactcccctcttctttctagttttacgtgattcccttgttcttcgcgggccaaagtgcactaagaatcaaaggcacaaagatagctcaccctcggtttcagcatcccctccacacttcactataaatacccctgcacatacgcaccttgctgcatcaccatttcacttcatagcacttcctaggacccagcaacacaacagccgagctttgtttaggcaagatgaacaggaagccaggagactgggactgcaggtcgtgccagcacctcaacttcagccgtcgggacatatgccagcgctgcagtgaaccacgcggagttgctgatcgtggcagtggtggtggaggtgactatgccaacttcggtggccgtggcggttcctccttcggaggtggctttggtgctggctctgatgtccgccctggtgactggtactgctcctgcggtgcacacaacttcgccagccgctccaactgcttcaagtgctctgcctacaaggaggaggctgctgtaaacagtggtgctggtggctttgatagtgacatgtcacgctcacggggctatggcttcggcagcggtgctgcccgtaccaaccgccccggttggaagtctggagactggatctgcaccaggtctggatgcaacgagcacaactttgctagcaggatggaatgtttcaggtgcaacgcaccacgggactccggcactgaggcgtaggagccaagtttgcagcgtcgtcgacgaagcggaagcagcaagaagagaggagtcctcagctcacatcataagagagtagtagatttgcaaaagacatccttgatgctctattactagttttgttctacccctaccgtaatttcttttagatttggttcgttctcatccccatttgggacagtacccccggacctattatgtttgctgttttatttccgttggttcatctccgcatgtttgcgcttggaatcgagtcatgtgatgtaaccccaaaacgcttgcttcacaagtattaactagtactgttgcttcttaatatctcggggcgttcatcttgttcatgtgtaacagtatgggtatgatccttggtgtgtgaattgctctggcacccccatcatct

SEQ ID NO: 3803 - DNA, 1409 bp, Zea mays
taactcccctcctctttctagttttacgtgattcccttgttcctcgcgggccaaagcgcgctaagaatcaaaggcacaaagatagctcaccctcggtttcagcatcccctccaaacatcactataaatacccctgcacacacgcaccttgctgcatcaccaccatctcacttcatataccactccctaggaggacccagcaacacacacagccgagctttgcttaggcaagatgaacaggaagccaggagactgggactgcagggcgtgccagcacctcaacttcagccgccgagacatatgccagcgctgcagcgagccacgtggagttgctgatcgtggcggcggaggaggaggaggcgactacgccagcttcggtggccgcggtggctcctccttcggcggcggctttggcgctgctggctctgacgtccggcctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaagcgacgacaagaggagtcctcatcacgtcgtaacgtaagagagagagagagtagtggatttgcaacaaaaaaaaaaaaagacggccgcgatgctctgttactagctagctagttttgttcaaccacccatgccgtctcttctcttttattagatttggtttggttctcatagccctttaattaccatttgggacctatgtttgctgttctgtttcccgttcgtctcctccgcatgtttgcgcttggatcgagtcttgtgatgtaaccccccaaaaaacgcttgcttaactagtactgttgcttcttaatatctccgggggcgttcatcttgttcttgctttatggtgtaaggctagctccaacaaggagctttaaaaggttctgtaccctaaatttagaggatcagggtcatctactctctccagcagcgtctctaaatgctgctggatcctttatatatagagtttctctaaacggttttttatctatttgaatactttaaacaaccggtttagtaaaactaaaatatgtataatatatttgagagtatgataaatacgtatgtataaaaaataaaaaatatct

SEQ ID NO: 3804 - DNA, 1149 bp, Setaria italica
taactcccctcttctttctagttttacgtgattcccttgttcttaccagccaaagtgcaccaagaatcaaaggcacaaagatagcttaccctcggtttcagcatccccttcaaacttcactataaatacccctgcacatacgcaccttgctgcatcaccatttcacttcacagcacttcttgtcctaggccccagaaacccgacagccctgctttgtttaggcaagatgaacaggaagccaggagactgggactgcagggcgtgccagcacctcaacttcagccggcgggacctatgccagcgctgcggtgagccccgtggagctgctgaccgtggcagtggtggtggaggtgactacgccaacttcggtggccgcggtggctcctccttcggcggtggctttggtgctggctctgatgtccgccctggtgactggttatgcaactgcggcgcgcacaactttgccagccgctccaactgcttcaagtgctctgccttcaaggaggaggctgctgtcaacagtggtgctggtggctttgatggtgacatgtcgcgctcacgctacagcttcggtggcggcgctgcccgcactaaccgccctggttggaagtctggagactggatctgcaccaggtctggatgcaacgagcacaacttcgctagcaggatggaatgtttcaggtgcaacgcaccacgggactccggtagcgctgccatgacctacgataattataacttgcactgaggtgtaggagctgacggacccccatgaagtctgcagcgacgtcgagcagaagcagcagcaagaagaagagtcttcaatcaacatcataagagagtagtagatttgcaaaaggcatccccgatgctctattacttagttttgttccacccctaccgttccttttagatttggttcccatcccattcccatttgggacagtaccccagacctatgtttgctgttttattcccccgttatttcccgcatgtttgcgcttggatcgagtcatgtcatgtaaccccaaaacgcttgcttcatcacaagtattaactagtactgttgcttcttaatatttgtcgggcgtctgttcttatgtatgtgtggtgtgtgagaagtaaaccttggtggtttggtgcttcgccggg

SEQ ID NO: 3805 - DNA, 1014 bp, Setaria italica
aaaaaatattaaaaaaaaacctctcccgttttgttcgtgcggcgacgaggcgaggagcggaggagtcgcgaggagtcgaggaggatccgggataaggcaagatgaacaggaagccaggagactgggactgcagggcgtgccagcacctcaacttcagccggcgggacctatgccagcgctgcggtgagccccgtggagctgctgaccgtggcagtggtggtggaggtgactacgccaacttcggtggccgcggtggctcctccttcggcggtggctttggtgctggctctgatgtccgccctggtgactggttatgcaactgcggcgcgcacaactttgccagccgctccaactgcttcaagtgctctgccttcaaggaggaggctgctgtcaacagtggtgctggtggctttgatggtgacatgtcgcgctcacgctacagcttcggtggcggcgctgcccgcactaaccgccctggttggaagtctggagactggatctgcaccaggtctggatgcaacgagcacaacttcgctagcaggatggaatgtttcaggtgcaacgcaccacgggactccggtagcgctgccatgacctacgataattataacttgcactgaggtgtaggagctgacggacccccatgaagtctgcagcgacgtcgagcagaagcagcagcaagaagaagagtcttcaatcaacatcataagagagtagtagatttgcaaaaggcatccccgatgctctattacttagttttgttccacccctaccgttccttttagatttggttcccatcccattcccatttgggacagtaccccagacctatgtttgctgttttattcccccgttatttcccgcatgtttgcgcttggatcgagtcatgtcatgtaaccccaaaacgcttgcttcatcacaagtattaactagtactgttgcttcttaatatttgtcgggcgtctgttcttatgtatgtgtggtgtgtgagaagtaaaccttggtggtttggtg

SEQ ID NO: 3806 - DNA, 1051 bp, Pennisetum glaucum
ggagcggaggaggagtcgtgaggagtcgaggaggagaggccatcgatcaggtgaacagcacgcaaaaaaaaaaaaaaaactctcccgttttgttcgtgcggcgacgaggcgaggagcggaggaggagtcgtgaggagtcgaggaggaggattcgggataagcttctccaggcaagatgaacaggaagccaggagactgggactgcagggcgtgccagcacctcaacttcagccggagggacctctgccagcgctgcggagagccccgtggagctgctgaccgtggcagtggtggtggaggtgactacgccaactttggtggccgtggtggctcctccttcggcggtggctttggtgctggctctgatgtccgccctggtgactggttgtgtaactgtggcgcacacaactttgccagccgctccaactgcttcaagtgctctgccttcaaggaggaggctgctgtcaacagtggtgctggtggctttgatggtgacatgtcacgctcacgctatggcttcggtggcggtatgggcggtggtggtggtgctgcccgcaccaaccgccctggttggaagtctggagactggatctgcaccaggtctggatgcaacgagcacaactttgctagcaggatggaatgtttcaggtgcaacgcaccacgggactccggtagcgctgccatgacctacgataattataacttgcactgaggtgtaggagctgacggaccacccatgaaggtctgcagcgacgacatcgagcagaagcagcagcgagaagaagagtcctcaacatcatcataagagagtagtagatttgcaaaaaaggcatcccggatgctctattacttagttttgttttagttttgttccacccctaccgttcccttttagatttggttccccgcatcccattcccaaatgggacagtatccccccagacctatgtttgctgttaattttattccaccaccccgttatttcccgcatgtttgcgcttggatcagagtctcgtgtcatgtaaccccaaaacgcttgcttcgtcacaag

SEQ ID NO: 3807 - DNA, 856 bp, Panicum virgatum
gcatcaccatttcacttcacagaactccttgtcctaggccccagaaacacaaacgaccgctctttgtttaggcaagatgaacaggaagcctggagactgggattgcagggcttgccagcacctcaacttcagtcggcgggacctatgccagcgctgtggtgagccacgtggagctgctgaccgtggcagcggcggtggaggtgactatgccaacttcggtggccgtggtggctcctccttcggcggtggctttggtgctggctctgatgtccgccctggtgactggttatgttcctgcggcgcgcacaacttcgccagccgctccaactgcttcaagtgctctgccttcaaggaggaggctgctgtcaacagtggtgctggtggctttgatggtgacatgtcacgctcgcgctacggcttcggtggcggtgctgcccgcaccaaccgccctggttggaagtctggagactggatctgcaccaggtccggatgcaacgagcacaactttgccagcaggatggagtgtttcaggtgcaacgcaccacgggactccggcactgaggtgtaggatcggagctggtgcttcgaacggaccccgacgagcagaagcagcaagaaacctgataagaagagtagtagatttgcaaaaggcatcccggatgctctattactgttttgttccacccctaccgtttccttttagaatttggttctcgtctccttagtacccctcggacctatgtttgctgttttattcccgttgtttcccgcaatgtttgcgctttgcatcgagtcatgtgatgtaaccccaaaacgcttgcttcacaagtattaactagtactgttgcttcttaat

SEQ ID NO: 3808 - DNA, 887 bp, Panicum virgatum
atcaccatttcacttcacagcactccttgtcctaggccccagaaacacaaacggacgctctttgtttaggcaagatgaacaggaagcctggagactgggactgcagggcttgccagcacctcaacttcagccggcgggacctatgccagcgctgtggtgagccacgtggagctgctgaccgtggcagcggtggtggaggtgactatgccaacttcggtggccgcggtggctcctccttcggcggtggctttggtgctggctctgatgtccgccctggtgactggttatgttcctgcggcgcgcacaacttcgccagccgctccaactgcttcaagtgctctgccttcaaggaggaggctgctgtcaacagtggttctggtggctttgatggtgacatgtcacgctctcgctacggcttcggtggcggtgctgcccgcaccaaccgccctggttggaagtctggagactggatctgcaccaggtccggatgcaacgagcacaactttgccagcaggatggaatgtttcaggtgcaacgcaccacgggactccggcactgaggtgtaggatcggagctgatgcttcgaacggaccccgacgagcagaagcagcaagaagatgagtccctcaagctgataagaagagtagtagatttgcaaaaggcgtccccgatgctctattactagttttgttccacccctaccgtttccttttagaatttggttctcatctcattcgcatctgggacagtaccccctcggaccctatgtttgctgttttattcccgttgtttcccgcaatgtttgcgctttgcatcgagtcatgtgatgtaaccccaaaacgcttgcttcacaagtattaactagtactgttgcttcttaatatttc

SEQ ID NO: 3809 - DNA, 1074 bp, Saccharum officinarum
agcagctgactttgcctcccctgttataaaaaggaggaggagggggcagggaagccgtccatagattcctccgcctcgtcagtcgtcactccttgagaaccagaaggccacacccaccctccaagagtccaaggacatggcggacgccgtccagcgcttgaagagcgggttcaacaagttcaagaccgaggtctatgacaagaagccggagctgttcgagcctctcaaggccggccagtcccccaagtacatggtgttcgcctgcgctgactcccgtgtgtgcccgtcggtgaccctgggcctacagcctggtgaggccttcaccgtccgcaacatcgccgccatggtcccagcctacgacaagaccaaatacaccggcattgggtctgccatcgagtacgccgtgtgcgctctcaaggtggaggtcctcgtggtcattggccacagctgctgcggtggcatcagggcgctcctctccctccaggacggcgcacctgacaacttccacttcgttgaggactgggtcaggatcggcttccctgccaaggtgaaggtgaagaaagagcatgcctcggtgccgttcgatgaccaatgctccatcctggagaaggaggccgtgaacgtgtccctcgagaacctcaagacctacccctttgtcaaggaagggctggccaacgggaccctcaggctggtcggcggccactacaacttcgtgtcaggggagttccacacatgggaaattaagagctaagccacccggccgcccgcttaacaacttctacaccatcataaatattatatactacatacctaccgatatgcacccaatcgatgtgaatgcgtggagtactacctgcatgttttcagcatgcagctacatatacatatataccggatcacccattgtgaatgtaataagcaatagcattttctaccgcttttatttctaacgccgagctttcattggactatataatgtattatatgatgaagaatttgtccgccctggggtcaaaagacatcaactatagccctttttccaatattattatgaagcctttacccttttctatt

SEQ ID NO: 3810 - DNA, 1207 bp, Sorghum bicolor
aacaagaggcacagccaaacgagagagagagagaggagaggagaaagggagggagggccgccgcgcatccatccgtccggagataagaggggagtggaagaaaagaggagaagatgagcagctgactttgcctcccccgttataaaagggaggagggggcagggaggaagccgtccatagattcctccgcctcgtcactccactccttgagatttgagaaccacaagggccaccccccacccaccctccaaggacatggcggacgccgtcgaccgcttgaagaccgggttcaacaagttcaagaccgaggtctatgacaagaagccggagctgttcgagcctctcaaggccggccagtcccccaagtacatggtgtttgcgtgctccgactcccgtgtgtgcccgtcggtgaccctgggtctgcagcccggtgaggccttcaccgtccgcaacatcgccgccatggtcccagcctacgacaagaccaagtacaccggcattgggtctgccattgagtacgccgtgtgcgccctcaaggtgcaggtcctcgtcgtcattggccacagctgctgtggtggcatcagggcgctcctctccctccaggatggcgcacctgacaccttccacttcgttgaggactgggtcaggatcggcttccctgccaagatcaaggtgaagaaagagcacgcttcggtgccgttcgatgaccagtgttccatcctggagaaggaggccgtgaacgtgtccctcgacaacctcaagacgtaccccttcgtcaaggaagggctggccaacgggaccctcaggctggtcggcggccactacaacttcgtgtcaggggagttcgacacatgggaaattaagagctaagctgcccggccggccgcttaacaactcctaccatcatcataaatatatatactacatacctaccgatatgcacccgatcgatgtgaatgcgtggagtattactcatgttttctgcatgcagcgacatatatatatatataccggatcgcccaatgtgaatgtaataagtaatagcattttctaccgcttttatttctaacgccgagctttcatgtactatataatgtgttatatgatgagtaatttgaccgccctgtggtcaaaagacatcagctataatccttttttcgcaatatttattatgaagcgtttacctcttgtactgcctttactgttc

SEQ ID NO: 3811 - DNA, 964 bp, Zea mays
atgggaggagggaggggggcagcgaagccatccatccatccatagatccctcacctcactcactcgtgaagaaccagagaacccacccaccctccttcatctcctacatccacatctatccaagaaggccatgggcgacgccgtggagcacctcaagagcgggttccagaagttcaagaccgaggtgtatgacaagaagccggagctgttcgagcctctcaaggccggtcaggcccccaagtacatggtgttcgcctgctccgactcccgcgtgtgcccgtcggtgaccctgggcctgcagcccggcgaggccttcaccgtgcgcaacatcgccgccatggtcccggcctacgacaagaccaagtacaccggcatcgggtccgccatcgagtacgccgtgtgcgccctcaaggtggaggtcctcgtggtcatcggccacagctgctgcggtggcatccgggcgctgctctccctccaggacggtgcacccgacaacttccacttcgtcgagaactgggtcaagatcggcttccctgccaaggtcaaggtgaagaaagagcacgcctccgtgcccttcgatgaccagtgctccatcctggagaaggaggccgtgaacgtgtccctggagaacctcaagacctaccccttcgtccaggaagggctggccaaggggaccctcaagctggtcggcgcccactacgacttcgtgtccgggaacttcctcgtatgggaaacttagccacacccgccgctcagcgcgcggcttcgtcgtcacaactcctatatcttcataaatatatatatccactacctatatatacctaccgatatgtgaatgcgaggagtactattacctgcatgttttcagcagtatgcagctacgtacatatatatgtaccggatcgcctaacgacgtgaatgtaataagcaataatattttctaccgcttttttttatttctttc

SEQ ID NO: 3812 - DNA, 2926 bp, Sorghum bicolor
ggcaagtggcactcgcgcacacagcacaattgatgtccgccttccccgtccgcggctccacgtccagcagcagcatcgtcgccagcctcggcagcagccgcgcccccgcccccgcgccgtcctccgtccgccggcgccccagcctcatcaggaacgcccccgtcgtcgccgtccccgccaccctcgtgggcatggacgccgtcgagcgcttgaaggtcgggttccagaagttcaagaccgaggtctatgacaaaaagccagagctgttcgagcctctcaaggctggccaggcccccaagtacatggtgttcgcctgctccgactcccgtgtgtgcccgtcggtgaccctgggcctgcagcccggcgaggccttcaccgtccgcaacatcgcctccatggtgccaccctacgacaagaccaagtacagcggcaccgggtccgccatcgagtacgccgtgtgcgccctcaaggtgcaggtgctcgtcgtcattggccacagctgctgcggtggcatcagggcgctcctctccctcaaggacggtgcacctcacaacttccacttcgttgaggactgggtcaggatcggctcccctgccaaggcgaaggtgcacaaagagcatgcctcagtgccgttcgatgaccagtgctccatcctggagaaggaggccgtgaacgtgtccctcgccaacctcaagacttaccccttcgtcaaggaacggctggccaaagggaccctcaagctggtcggcgcccactacgacttcgtgtccgggaagttcctcacatgggagcctgtgatggacgccgttgaccgcttgaagagcgggttcgagcagttcaagatcgaggtctatgacaagaagccagagctttttgagcctctcaaatctggccaggcccccaggtacatggtgttcgcctgcgctgactcccgtgtgtgcccgtcggtgaccctgggcctgatgcccggcgaggccttcaccgtccgcaacatcgccgccctggtcccaggctacgacaagaccaagtacaccggcatcgggtccgccatcgagtacgccgtgtgcgccctcaaggtgcaggtgctcgtcgtcattggccatagctgctgcggtggcatcagggcgctcctctccctccaggacggtgcacctgacaacttccactttgttgaggactgggtcaagattggcttccctgccaagatgaaggtgaagaaagagaacgcttcggtgccgttcgatgaccaatgctacattctagagaaggaggccgtgaatgtgtccttggagaacctcaagacctacccattcgtcaaggaagggctggccaacggtaccttaaagctggtcggcggccactatgacttcgtgaaaggagagttcctcacatggaaagacatggcggacgccgtcgaccgcttgaagaccgggttcaacaagttcaagaccgaggtctatgacaagaagccggagctgttcgagcctctcaaggccggccagtcccccaagtacatggtgtttgcgtgctccgactcccgtgtgtgcccgtcggtgaccctgggtctgcagcccggtgaggccttcaccgtccgcaacatcgccgccatggtcccagcctacgacaagaccaagtacaccggcattgggtctgccattgagtacgccgtgtgcgccctcaaggtgcaggtcctcgtcgtcattggccacagctgctgtggtggcatcagggcgctcctctccctccaggatggcgcacctgacaccttccacttcgttgaggactgggtcaggatcggcttccctgccaagatcaaggtgaagaaagagcacgcttcggtgccgttcgatgaccagtgttccatcctggagaaggaggccgtgaacgtgtccctcgacaacctcaagacgtaccccttcgtcaaggaagggctggccaacgggaccctcaggctggtcggcggccactacaacttcgtgtcaggggagttcgacacatgggaaattaagaggacatggcggacgccgtcgagcgcttgaagaccgggttcgagcagttcaaggccgatgtctacgacaagaagccggagctgttcgagccactcaaggcgcaccagtcacccaagtacatggtgttcgcctgctccgactcccgcgtgtgcccgtcggtgaccctgggcctgcaccccggcgaggccttcgccgtccgcaacatcgccagcatggtgccaccctacgacaagaccaagtacgccggcgtcgggtccgccatcgagtacgccgtgtgcgccctcaaggtggaggtcatcgtcgtcatcggccacagccgctgcggcgggatcaaggcgctcctctccctcgaggacggcgcgcccgacaagttccacttcgtggaggaatgggtcaggatcggcggtccggccaagactaaggtgaagaccgaccacgcctcggtgccgttcgaagaccaatgctccatcctcgagaaggaggccgtgaacgtgtcccttgagaacctcaagacgtacccgttcgtcaaggaaggggtggagaaagggaccctcaagctggtcggcggccactacgacttcgtcaatggaaagttcgagacatgggagccctaagccgcgcgcggccggccaaattaacagccgcagcaaggcttcatcatataactccaacaaggctacaccatatatacatgcatattatatacaaacgctcccgaacctatttgccgcgtggagtacttatttgccgctatatactagctatacacataccggaattgacgtaccggtgagaacaactatactgtaataagcaatacctgcgtgctttgacttctaacgcggagttgttttttttttatgataatatgatgcatatataatttgattaatctgtggtcctcactgttctttgtc

SEQ ID NO: 3813 - DNA, 1865 bp, Sorghum bicolor
agcacagggggcaagtggcactcgcgcacacagcacaattgatgtccgccttccccgtccgcggctccacgtccagcagcagcatcgtcgccagcctcggcagcagccgcgcccccgcccccgcgccgtcctccgtccgccggcgccccagcctcatcaggaacgcccccgtcgtcgccgtccccgccaccctcgtgggcatggacgccgtcgagcgcttgaaggtcgggttccagaagttcaagaccgaggtctatgacaaaaagccagagctgttcgagcctctcaaggctggccaggcccccaagtacatggtgttcgcctgctccgactcccgtgtgtgcccgtcggtgaccctgggcctgcagcccggcgaggccttcaccgtccgcaacatcgcctccatggtgccaccctacgacaagaccaagtacagcggcaccgggtccgccatcgagtacgccgtgtgcgccctcaaggtgcaggtgctcgtcgtcattggccacagctgctgcggtggcatcagggcgctcctctccctcaaggacggtgcacctcacaacttccacttcgttgaggactgggtcaggatcggctcccctgccaaggcgaaggtgcacaaagagcatgcctcagtgccgttcgatgaccagtgctccatcctggagaaggaggccgtgaacgtgtccctcgccaacctcaagacttaccccttcgtcaaggaacggctggccaaagggaccctcaagctggtcggcgcccactacgacttcgtgtccgggaagttcctcacatgggagcctgtgatggacgccgttgaccgcttgaagagcgggttcgagcagttcaagatcgaggtctatgacaagaagccagagctttttgagcctctcaaatctggccaggcccccaggtacatggtgttcgcctgcgctgactcccgtgtgtgcccgtcggtgaccctgggcctgatgcccggcgaggccttcaccgtccgcaacatcgccgccctggtcccaggctacgacaagaccaagtacaccggcatcgggtccgccatcgagtacgccgtgtgcgccctcaaggtgcaggtgctcgtcgtcattggccatagctgctgcggtggcatcagggcgctcctctccctccaggacggtgcacctgacaacttccactttgttgaggactgggtcaagattggcttccctgccaagatgaaggtgaagaaagagaacgcttcggtgccgttcgatgaccaatgctacattctagagaaggaggccgtgaatgtgtccttggagaacctcaagacctacccattcgtcaaggaagggctggccaacggtaccttaaagctggtcggcggccactatgacttcgtgaaaggagagttcctcacatggaaagtctagagctaaggcacccggacggcccaactcctacatcatcataaatttataccacatatatacctaccgatatgcacccgatcgatgcgaatgcgcggagtactacatgcatgttttcagcaactacatatatacataccggatcgccccaatgtgaatgtaataagcaatagcattttcaaccgctttcatttctaacgccgagcttttatgtactatatatataatatgatgcataattgaccggcttgtggtcaaaagacatcaactataatccttttttcataatattgttatgaagagtttacctcttttttttgtcattaacggatccagagaaacaggccaggagggcaacacgccaacaccctccgtcctaaaatagagtgcattctgacatttaagatgtgtcccaaaatatagtacattcaaggaacatgaagataatatttactt

SEQ ID NO: 3814 - DNA, 1953 bp, Zea mays
acgataagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaaatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggtccgccatcgagtacgccgtgtgcgcgctcaaggtgcaggtcatcgtggtcattggccacagctgctgcggtggcatcagggcgctcctctccctcaaggacggcgcgcccgacaacttccacttcgtggaggactgggtcaggatcggcagccctgccaagaacaaggtgaagaaagagcacgcatcggtgccgttcgatgaccagtgctccatcctggagaaggaggccgtgaacgtgtcgctccagaacctcaagagctaccccttcgtcaaggaagggctggccggcgggacgctcaagctggttggcgcccactacgacttcgtcaaagggcagttcgtcacatgggagcctccccaggacgccatcgagcgcttgacgagcgggttccagcagttcaaggtcaatgtctatgacaagaagccggagcttttcgggcctctcaagtccggccaggcccccaagtacatggtgttcgcttgctccgactcccgtgtgtgcccatcggtgaccctgggcctgcagcccggcgaggccttcaccgttcgcaacatagccgccatggtcccaggctacgacaagaccaagtacaccggcatcgggtccgccatcgagtacgctgtgtgcgctctcaaggtggaggtcctcgtggtcattggccatagctgctgcggtggcatcagggcgctcctctccctccaggacggcgcacctgacaccttccacttcgtcgaggactgggttaagatcggcttcattgccaagatgaaggtaaagaaagagcacgcctcggtgccgttcgatgaccagtgctccattctcgagaaggaggccgtgaacgtgtccctggagaacctcaagacctaccccttcgtcaaggaagggcttgcaaatgggaccctcaagctgatcggcgcccactacgactttgtctcaggagagttcctcacatggaaaaagtgaaaaactagggctacggcaattctaccggcccgccgactcctgcatcatcataaatatatatactatactatactactacgtacctaccgatatgcacccgagcaatgtgaatgcgtcgagtactatatatctgttttctgcatctacatatatataccggatcaatcgcccaatgtgaatgtaataagcaatatcattttctaccacttttcattcctaacgctgagctttttatgtactatatcttatatgatgaataataatatgaccgccttgtgatctaa

SEQ ID NO: 3815 - DNA, 868 bp, Saccharum officinarum
cggacgccgtcgagcgcttgaagagcgggttcgagcagttcaagatcgaggtctatgacaagaagccagaccttttcgagcctctcaagtccggccaggcccccaggtacatggtgttcgcctgcgctgactcccgtgtgtgcccgtcggtgaccctgggcctgctgcccggtgaggccttcaccgtccgcaacatcgccgccatggtcccaggctacgacaagaccaagtacaccggcatcgggtccgccatcgaatacgccgtgtgcgccctcaaggtgcaggtcctcgtggtcattggccacagctgctgcggtggcatcagggcgctcctctccctccaggacggcgcacctgacaacttccactttgttgaggactgggtcaaaatcggcttccctgccaagatgaaggtgaagaaagagcacgcctcggtgccgtttgatgaccagtgctatattctggagaaggaggccgtgaacgtttccctggagaacctcaagacctaccccttcgtcaaggaagggctggccaaggggaccctcaagttggtcggcggccactacgacttcgtgagaggggagttcctcacatggaaagtctagagctaagccacctggtcggcccaactcctacatcatcgtaaatatatactacatacctaacgatatgcacccgatcgatgtgaatgcgtggagtactacctgttttcagcagctacatacataccggatcgcccaatgtgaatgtaataagcaatagcattttcaaccgctttcatttctaatgctgagattttatgtactatatgatgcataatttgaccaccttgtggtcaaaagacatcagctatatataatcctttttt

SEQ ID NO: 3816 - DNA, 1219 bp, Saccharum officinarum
attaatgtccagcttcgccgtccgctcatccacgtccagcatcgccgccagcctcggcagcacccccgcgccgtcctcggtccgccggcgccccagcctcatcaggaacgcccccgtcttcgccgtccccgccaccctcgtgtaaacgggacgacgggcagctcaaaagtcgagcgagagagaaagggagggagggcgacatcgcatccatccgtccggcgataagggaggagaggaagaaaagaggaggagatgagcagctgcctttgcctccccaaaaagaaggagggggcagcgaagccgtccatagattcaaccaccacgtcagtcgttcagaacccgaagcccacccaacctccacctcctccctccaagggcatggacgccgtcgagcgcttgaaggtcgggttccagaagtttaagaccgaggtctatgacaagaagccggagctgttcgagcctctcaagggcggccaggcccccaagtacatggtgttcgcctgcgctgactcccgtgtgtgcccgtcggtgaccctgggcctgcagcccggtgaggccttcaccgtccgcaacatcgccgccatggtcccaccctacgacaagaccaaatactccggcaccgggtccgccatcgagtacgccgtgtgcgccctcaaggtggaggtcctcgtggtcatcggccacagctgctgcggtggcatcagggcgctcctctccctcaaggacagcgcacctgacaacttccacttcgttgaggactgggtcaggatcggctcgcctgccaagacgaaggtgcagaaagagcacgcctcggtgccgttcgatgaccagtgctccatcctggagaaggaggccgtgaacgtgtccctcgcgaacctcaagacctaccccttcgtcaaggaacggctggccaaagggaccctcaagctggtcggcggccactacgacttcgtgtccgggaagttcgtcacatgggagcctgtgacggacgccgtcgagcgcttgaagagcgggttcgagcagttcaagatcgaggtctatgacaagaagccagaccttttcgagcctctcaagtccggccaggcccccaggtacatggtgttcgcctgcgctgactcccgtgtgtgcccgtcggtgaccctgggcctgctgcccggtgaggccttcaccgtccgcaacatcgccgccatggtcccaggctacgaaaagaccaagtaca

SEQ ID NO: 3817 - DNA, 1246 bp, Setaria italica
acggagcaaggggcactctcacagacgaatgtctacttgcttcgctgggttgagcatcgtcgcaagcctcggcacccccaagccgtcctccgcctccgcacgccccaggctcatcaggaacgcgcccgtcttcgccgccgccaccgccgtcgtgtaagccgacgaacgagaagctcatcaaaaagtcagacgagagagaggcgaggagtagtagcatccaagccggccggccataggaagaggagaagatgagcgggtgcctttgcctccctaaaaagaaggagggggtctccgcagcgaagcagtccataaattcccccgcctcgtcactcctccagaaccagaagcccacccaacctccacctcctccttccaagaagggcatggacgccgtcgagcgcttgaagagcgggtttgacaagttcaagaccgatgtctatgacaagaagccggagctgttcgagccgctcaaggagggccaggcacccaggtacatggtgtttgcctgctccgactcccgttgctgcccgtcggtgaccctgggcctgcagcccggcgaggccttcaccgtccgcaacatcgccgccatggtcccaccttacgacaagaccaagtacaccggcattgggtccgccatcgagtacgccgtctgcgccctcaaggtggaggtcctcaccgtcatcggccacagccgctgcggcgggatcaaggcgctcctctcgctccaggacggcgaggccgacaagttccacttcgtcgaggactgggtcaggatcggcgcccccgcgaaggcgaaggtgcaggccgaccacgcctcagctgctttcgaggaccaatgctccatcttggaaaaggaggccgtcaacgtgtcccttgagaacctcaagacctacccgttcgtcaaggaagggctggagaaggggaccctcaagctggtcggcggccactacgacttcgtctccggcaagttcgagacatgggaaccctaagaggccaaccaggccagtacaccatatacctacaaatatgctcccgatcgatatatatgactgcgtggagcacaactaattcgcccctatacagccataccgtattgctctatgtggactgtaataagcgatggaaatttctaccgtggaggatttatttgttttttttttgtaatgtatgatgcataatttgatcgatctgtggtcaaaagacatcagctataatgatcttttcattaatattatcatgaagagag

SEQ ID NO: 3818 - DNA, 1345 bp, Setaria italica
cgcgcgtataaggaggcggcacggagcaaggggcactctcacagacgaatgtctacttgcttcgctgggttgagcatcgtcgcaagcctcggcacccccaagccgtcctccgcctccgcacgccccaggctcatcaggaacgcgcccgtcttcgccgccgccaccgccgtcgtgccgacgaacgagaagctcatcaaaaagtcagacgagagagaggcgaggagtagtagcatccaagccggccggccataggaagaggagaagatgagcgggtgcctttgcctccctaaaaagaaggagggggtctccgcagcgaagcagtccataaattcccccgcctcgtcactcctccagaaccagaagcccacccaacctccacctcctccttccaagaagggcatggacgccgtcgagcgcttgaagagcgggtttgacaagttcaagaccgatgtctatgacaagaagccggagctgttcgagccgctcaaggagggccaggcacccaggtacatggtgtttgcctgctccgactcccgttgctgcccgtcggtgaccctgggcctgcagcccggcgaggccttcaccgtccgcaacatcgccgccatggtcccaccttacgacaagaccaagtacaccggcattgggtccgccatcgagtacgccgtctgcgccctcaaggtggaggtcctcaccgtcatcggccacagccgctgcggtggcatcaaggcgctcctctccatgaaggacggcgcacctgacaacttccacttcgtcgaggactgggtcaggatcggcttcctcgccaagaagaaggtgctgaccaaccatgcctcggttccgttcgatgaccagtgcaccctcttggagaaggaggccgtcaacgtgtccctctacaacctcctgacctacccctgggtgaaggaaggtgtggccaacgggacactcaagctggtcggcggccactacgacttcgtcaacggggtgttctccgtgtgggagaaataagccacccggtttattcatcatacatacataccgaaataatgcatccaatcgatgtgaatgcatgagtacttactacctattttcggccgctacatatatatcagatcggccgatgtgaatgtaataagatatagcattttctaccgctttacgacttctatgtactatatgatgcgtaatttggccgccttgtggtcaaaagacatcagctatgtataagccgttttactaccatggctatgtataatttcataatattttcgtcaagagtttaccttttactaccccttcatgttggcttatttgtctgtccccttcctggttgctgatgcagtatttt

SEQ ID NO: 3819 - DNA, 1360 bp, Setaria italica
atggcaccccagccccggcgccacgcgcgcccgcgcctgcccggagctcccatcagccggaggtcaaggcgaaggcttggacctttgggagctcggtgggttagtggtgtacgtgtgtacctgtccatctgtccggtacaagaacacgtcccggtctggactggttcgccgtttcacgcatccatccgtccagctgcacgaccgtcgaccgcccgaggaggggagcaggccggaaaagaaggtgagccgctgcttcccgtgcctccccctcctataaaaggacccccagggaggcatggacggggcagcagctctacagcgaaccaagcctttcttctacagtcttctcaaatcctcgagaaccagaggtccacccaccttctcctccaccgcacaaaggccatggcggacgccgtcgagcgcttgaagaccgggttcgagcagttcaaggccgatgtctacgacaagaagccggagctgttcgagccgctcaaggcccaccagtcccccaagtacatggtgttcgcctgctccgactcccgcgtgtgcccgtcggtgaccctgggcctgcagcccggcgaggccttcgctgtccgcaacatcgccagcatggtcccaccctacgacaagaccaagtacgccggcgtcgggtccgccatcgagtacgccgtctgcgccctcaaggtggaggtcatcgtcgtcatcggccacagctgctgcggcgggatcaaggcgctcctctcgctccaggacggcgaggccgacaagttccacttcgtcgaggactgggtcaggatcggcgcccccgcgaaggcgaaggtgcaggccgaccacgcctcagctgctttcgaggaccaatgctccatcttggaaaaggaggccgtcaacgtgtcccttgagaacctcaagacctacccgttcgtcaaggaagggctggagaaggggaccctcaagctggtcggcggccactacgacttcgtctccggcaagttcgagacatgggaaccctaagaggccaaccaggccagtacaccatatacctacaaatatgctcccgatcgatatatatgactgcgtggagcacaactaattcgcccctatacagccataccgtattgctctatgtggactgtaataagcgatggaaatttctaccgtggaggatttatttgtttttttttttgtaatgtatgatgcataatttgatcgatctgtggtcaaaagacatcagctataatgatcttttcattaatattatcatgaagagagaaaagagtttacctttttatgctacctctcttgctgttccccaactttaattctgactctttcttaaatgttgatgacttttcttttgcca

SEQ ID NO: 3820 - DNA, 1059 bp, Brachypodium distachyon
ctcgcacaatgtcgaccgccgcggccaactggtgctacgcaaccgtcgcgccccgcgctaagagcgtcgtcgtcgccagcctcggcaccccggccccgtcctcttccggcagcttccggcccaggctcatcaggaacgcccccgtccaggccgcgcccgtcgcgcccgcattgatggacgccgccgtggagcgcctcaagaccgggttcgagaagttcaagaccgaggtctacgacaagaagccggatgtcttcgagccgctcaaggccggccaggcccccaagtacatggtgttcgcctgcgccgactcacgtgtgtgcccgtcggtgaccctgggcctggagcccggtgaggccttcaccgtccgcaacatcgccaacatggtcccgtcctactgcaagaacaagtacgccggtgttgggtcggccatcgagtacgccgtgtgtgccctcaaggttgaggtcatcgtggtgattggccacagccgctgcggtggaatcaaggcactcctctcgctcaaggatggtgcagatgacagcttccacttcgtcgaggactgggtcaggatcgggttcccggccaagaagaaggtgcagaccgagtgcgcctccatgcctttcgatgaccaatgcgccgtcttggaaaaggaggccgtgaacgtgtccctcgagaacctcaagacctacccgttcgtcaaggaaggcgtcgccaacggaaccctcaagctcgtgggcggccactacgacttcgtctccggcaagttcgacacatgggagctctaagtcctctcatccggttaactcctatacatacaacgtatacttatacatacagatatggagatgaccctacagatcgatccattgatgtggatgcgatgccatggagtatatgtactcgctattttccagtactgcatgccggatggctcgatgtgaatttgtaataagcaatagaagtttctaccattttctgacgtggggttgtacttgtgatgcgtaatttggtcatcttgtgaccaaaagacatcaactatataattataataccattttcatc

SEQ ID NO: 3821 - DNA, 1322 bp, Brachypodium distachyon
gcgcgcgcgcgtcctgtacatgttttgtccgcaccccggcgcgccctccgctatttcttggcgcgtataaggagggcacagggcactgcccactcgcacaatgtcgaccgccgcggccaactggtgctacgcaaccgtcgcgccccgcgctaagagcgtcgtcgtcgccagcctcggcaccccggccccgtcctcttccggcagcttccggcccaggctcatcaggaacgcccccgtccaggccgcgcccgtcgcgcccgcattgatggacgccgccgtggagcgcctcaagaccgggttcgagaagttcaagaccgaggtctacgacaagaagccggatgtcttcgagccgctcaaggccggccaggcccccaagtacatggtgttcgcctgcgccgactcacgtgtgtgcccgtcggtgaccctgggcctggagcccggtgaggccttcaccgtccgcaacatcgccaacatggtcccgtcctactgcaagaacaagtacgccggtgttgggtcggccatcgagtacgccgtgtgtgccctcaaggttgaggtcatcgtggtgattggccacagccgctgcggtggaatcaaggcactcctctcgctcaaggatggtgcagatgacagcttccacttcgtcgaggactgggtcaggatcgggttcccggccaagaagaaggtgcagaccgagtgcgcctccatgcctttcgatgaccaatgcgccgtcttggaaaaggaggccgtgaacgtgtccctcgagaacctcaagacctacccgttcgtcaaggaaggcgtcgccaacggaaccctcaagctcgtgggcggccactacgacttcgtctccggcaagttcgacacatgggagctctaagtcctctcatccggttaactcctatacatacaacgtatacttatacatacagatatggagatgaccctacagatcgatccattgatgtggatgcgatgccatggagtatatgtactcgctattttccagtactgcatgccggatggctcgatgtgaatttgtaataagcaatagaagtttctaccattttctgacgtggggttgtacttgtgatgcgtaatttggtcatcttgtgaccaaaagacatcaactatataattataataccattttcatcaagactctgtatttgtgttacattgaggggttttataggtactccataaagacagatgatagtaccattcaaatctaaccctccatttaatagaatatattagacattatattcttccctgccgcaaccgtctcacgattggaacggaatatattcaacatttattcttca

SEQ ID NO: 3822 - DNA, 903 bp, Panicum virgatum
gcgaagcaaagccttccacagtcttcgtcaatccttccacagctcgccccacctgctctcctctacagcccaaaggacgccatggcggatgccgtcgagcgcttgaaggccgggttcgagcagttcaaggccgatgtctacgacaagaagccggaggtgtacgagccgctcaaggcccaccagtcccccaagtacatggtgttcgcctgctccgactcccgcgtgtgcccgtcggtgaccctgggcctgcagcccggcgaggctttcgccgtccgcaacatcgccagcatggtcccaccctacgacaagacccggtacgccggcgtcgggtccgccatcgagtatgccgtctgcgcgctcaaggtggaggtcatcgtggtcatcggccacagccgctgcggcgggatcaaggcgctcctctcgctccaggacggcgagcccgacaagttccacttcgtcgaggaatgggtcaggatcggcgcccccgcgaagacaaaggtgcaggccgaccacgcctcagcccccttcgaggaccaatgctccgcgttggaaaaggaggccgtcaacttgtcccttgagaacctcaagacctacccgttcgtcaaggaagggctggagaaggggaccctcaagctggtcggcggccactacgacttcgtctccggcaagttcgagacctgggatccatgagtggccaaccaggctagctgtttaatcacgtacggctacaccatacatatgtgctcccgatcgatacgtctgactgcgtggagcagtactactaatttgcccctatacacacataccggattgctcttttgtgaactgtaataagcaatacaattttttgtcgcggagttcttttttttgtaatatatgatgcataatttgatcgacgtgtgg

SEQ ID NO: 3823 - DNA, 1218 bp, Saccharum officinarum
ctcacctcgacaccgccatggccttcgtctccgcgaccgccgccgcccccgccaccctcttcctctccgtcctgtccgcaccacagggcgccggcgcgtgcgtcctcccgcagcgcctgcagccgttcttagctccgctccacgcggcgaagggccccaactcggcgccggtggtgttggagagcaaggctaagggtaagaagaagaaggggtccggcgccgggaacctcgccggagccctcgacgtcgagatcagggaggcgcaggagtacctcgacagcgacgagcaggaccctgttccagacaacttcccatttgaaataattgacgaagagggtatgagtgtggttattttgagaagggactacaaggacgagaagattgaagttactgtcagcatgcctaatttagatggaggccctgagtttgatgatgaggatggtgagggcgatggtgagagtgctgtcaaggatgacgaagaagcagaggaagatgatgagagtgccggagatagcagcatctctcttaaggtggtagtttccaaagactctggcccaaagcttgagttcacatgcacagcttttcgtgaggagatcaccattgatgatatgctaatagtagaggaaacagaagatgatggagaagagaagttcccctatgagggccctgagttcaccgagctccctgtgaatgttcagaaaggcctgttcaaatacttggagcaaaggggggtaacgctgccagcaaccaactatatgcatgattacatggtgactaagcaggctcaggagtacatccggtggatgactaagctgaaggatttcgtcaagcaatgaggaacgacagttttggtagaacctagccttagcatgtgtaggcttacagccttacaggaatactacgattacacgaagttggttgcactccaaaaaggagaattgtatctgcctcaatgtatctgtatcagctggcaaaacaggagcaagtagatttccagtaatgtttagtggtggctattaggtattacaatacatatctgtcttcctgttaggcgtgtgctctgaagagcgttatcctttagtgtctacgttagttggttttacctgttttcttgttgtttagcaagggttgctgttgctgtaatgcgtgagtgttaactggtatacccagttgtaaaactcttatgtgctttcttaaaagcagaggtaatctcctttc

SEQ ID NO: 3824 - DNA, 1291 bp, Sorghum bicolor
aaagccctcccccctcccctcttcctcgccttatctcctcctccgtcactcgcctcgacaccgccatggccttcgtctccgcgaccgccgccgcctccaccaccctcttcctctccgtcctgtccccagcacgcagcgcgggcgcgtgcgtctgctcacaggcgcggaagccgtcgacagctccgctccacgcggcaaagggccccaactcggcgccggtggtgttggagagcaaggctaagggaaagaagaagaaggggtccggggccgggaacctcgccggagccctcgacgtcgagatcagggaggcgcaggagtacctcgacagcgacgagcaggaacctcttccagacaacttcccatttgaaataattgatgaagatggtatgagcgtggttattttgagaagggactacaaggacgagaagattgaggttactgtcagcatgcctaatttagaaggaggccctgaatttgatgatgaggatggtgagggtgatggtgagagtgctggcaaggatgacgaagaggcagaagaagaagatgagagtgctggagatagcagcatttctcttaaggtggtagtttccaaagactctggcccaaagcttgagttcacatgcacagcctttcgtgaggagatcaccattgatgatatgctaatagtagagaaaacagacgacgatggagaagagaagttcccctatgagggccctgagttcaccgagctccctgtgaatgttcagaaaggcctgttcaaatacttggagcaaaggggggtaacgctgtcggctaccaactatatgcacgattacatggtgactaagcaggctcaggagtacatacggtggatgacaaagctgaaggatttcgtcaagcagtgaggaacagcggcgcgatttgacaaatttgttttggtagcctagccttagtatgcgttacagccttacaggaatactacgattacacgaagttggtcacactccaaaaaggagaattgtatctgcctcaatgtatctgtatcagcgggcaaaacaggagcaagtagatttccagtaatgtttagtggtggctattaggtattacgatacatatctgtcttcctggctgttaggcgtgtgctctgaagagcgttatcctttagtgtctacgttagttggttttacctgttttcttgttgtttagcaagggttgctgttgctgtaatgcgtgagtgttaactggtatccccagtaaagtcttatatgctttcttaaaagcaaaggtaatctcctttccaaaaactaaaata

SEQ ID NO: 3825 - DNA, 1688 bp, Sorghum bicolor
aaacggttttagttccacgcactcagtttgaggaaaaaaggtgaagttgtgagagcacctaaagaggtactccacaaactccagttttttatggaggtgctccatagtgaagtttgtggagcagtcccaacactccctaactctcatagtctctgccaaagttgttcgccttctcgaaagattcccaacaaaattttagctttcgggttgtacactaattcagttcttctaccaaatttatacataatacaaacacaactaatatcactgctgtgtttgtaccgttagtatgtcactgtctcactgacgtgtgggccacacaagccggcagcccgtgcgcattctgctgcccaagcaataaaaaaacatccaatccaaaacccaagcaaagccctcccccctcccctcttcctcgccttatctcctcctccgtcactcgcctcgacaccgccatggccttcgtctccgcgaccgccgccgcctccaccaccctcttcctctccgtcctgtccccagcacgcagcgcgggcgcgtgcgtctgctcacaggcgcggaagccgtcgacagctccgctccacgcggcaaagggccccaactcggcgccggtggtgttggagagcaaggctaagggaaagaagaagaaggggtccggggccgggaacctcgccggagccctcgacgtcgagatcagggaggcgcaggagtacctcgacagcgacgagcaggaacctcttccagacaacttcccatttgaaataattgatgaagatggtatgagcgtggttattttgagaagggactacaaggacgagaagattgaggttactgtcagcatgcctaatttagaaggaggccctgaatttgatgatgaggatggtgagggtgatggtgagagtgctggcaaggatgacgaagaggcagaagaagaagatgagagtgctggagatagcagcatttctcttaaggtggtagtttccaaagactctggcccaaagcttgagttcacatgcacagcctttcgtgaggagatcaccattgatgatatgctaatagtagagaaaacagacgacgatggagaagagaagttcccctatgagggccctgagttcaccgagctccctgtgaatgttcagaaaggcctgttcaaatacttggagcaaaggggggtaacgctgtcggctaccaactatatgcacgattacatggtgactaagcaggctcaggagtacatacggtggatgacaaagctgaaggatttcgtcaagcagtgaggaacagcggcgcgatttgacaaatttgttttggtagcctagccttagtatgcgttacagccttacaggaatactacgattacacgaagttggtcacactccaaaaaggagaattgtatctgcctcaatgtatctgtatcagcgggcaaaacaggagcaagtagatttccagtaatgtttagtggtggctattaggtattacgatacatatctgtcttcctggctgttaggcgtgtgctctgaagagcgttatcctttagtgtctacgttagttggttttacctgttttcttgttgtttagcaagggttgctgttgctgtaatgcgtgagtgttaactggtatccccagtaaagtcttatatgctttcttaaaagcaaaggtaatctcctttccaaaaactaaaataaaataaaaaa

SEQ ID NO: 3826 - DNA, 1077 bp, Panicum virgatum
agaaagccttatcccctccgccgctcacctccactccgccatggccttcgtctccgtctccgcctccgcatccgccaccctcctcatctccgtcccgtccaccggacgcaccggcgccggcgcatgcgccttcccgcagccccggcggaccctcctggccccgctgcacgcggcgaagggcgccaagtcggtgccggtggaggtggtgatggagagcaaggtcaaggggaagaaaaagaaggggtccggcgccgggaacctccccggagcgctcgacgtcgagatcagggaggcgcaggagtacctcaacagtgacgagcaggaacctgttccagacaacttcccttttgaaatccttgatgaagatggtatgagcgtggttattttgaaaagggactacaaggatgagaagattgaggttgttgtcagcatgcctaatttagaagggggtcctgagtttgatgatgaggatggtgagggcgacggtgagagtgctgacaaggatgatgatgaagaagaagatgagagtgctggagatagtagcatttctttgaaggttgtagtctccaaagcctctggcccgaagcttgagttcacctgcacagccttccgtgaggagatcaccatcgatgatatgctgatagtagagaaagcagatgatgatggagaagagaagttcccatacgagggccctgaattcacggagctccctgtgaatgtgcagaaaggcctgttcaagtacctggagcaacggggtatcacgctgtcagctaccaactacatgcacgactacatggtgaccaagcaggcccaggagtacatccggtggatgaggaagctgaaggatttcgtccagcaatgaggaacagcaacgtgaattggcaacattgttttggtagcagcctcgccttagtgtgttagaggaatattacaattacgcaaagcttatgactccctaaaggagagggaaagatgtatctgtctcagtgaatctgtatcagctggcgaatcaggagcatgtagatttctagttgcattgttgcatttcaagaaaattaagaattactggttacttct

SEQ ID NO: 3827 - DNA, 1062 bp, Panicum virgatum
cacctccactccgctatggccttcgtctccgcctccgcctccgccaccctcctcgtctccgtcccgtccaccggacgcgccagcgccggcgtatgcgcctgcccgcagccccggcggaccctcctggccccgctgcacgcggcgaagggcgccaagtcggtgccggtggaggtggtgatggagagcaaggtcaagggcaagaagaagaaggggtccggcgctgggaacctccccggcgccctcgacgtcgagatcagggaggcgcaggagtacctcgacagtgacgagcaggaacctgttccagacaacttcccttttgagatccttgatgaagatggaatgagtgtggttattttgaaaagggactacaaggatgagaagattgaggtcgttgtcagcatgcctaatttagaagggggtcctgagtttgatgatgaggatggtgagggcgatggtgagagtgctggcaaggatgatgatgaatgaagaagaagatgagagtgccggagatagtagcatttctttaaaggttgtagtctccaaagcctctggcccgaagcttgagttcacctgcacagccttccgtgaggagatcaccattgatgatatgctgatagtagagaaagcagatgatgatggagaagagaagttcccgtacgagggccctgaattcacagagctccctgtgaatgtgcagaaaggcctgtttaagtacctggagcaacgggggatcacgctgtcagctaccaactacatgcacgactacatggtgaccaagcaggcccaggagtacatccggtggatgaggaagctgaaagatttcgtccagcaatgaggaactggaacgtgatttggcaacattgttttggtagcctagccttagtagtatgtgttaagaggaatattacaattacgcaaagcttatgagttatgactccctaaaggagagggaaagatgtatctgtctcaatgaatctgtatcagctgaccaatcaggagcatgtagatttgtagttgcattcttgcatttctgtgcttcaggagcaattacgggttacttct

SEQ ID NO: 3828 - DNA, 640 bp, Zea mays
gaccaccagagcagcagtagactcacagctcactcaccgtgtctcacactctcacacgtaccgatcgagcggaagcaaacaaagcacacgtacggggtcgtcgagagaggatcggaatcggatggcgttcatgcggtaccgcgcgctgccgcagggggagctgacggtggaggggttccgggcgtggctggcgcagttcgacgcggaccgcgacggccggatcagcagggaggagctgcagcacgcgctgcgcagcctcaacgtgtggttcgcgtggtggaaggcccggggcgccgtgcgcgccgccgacgccgaccgcgacggcggcgtgcagctcatcggggaggacgaggtggcccgcctcttcgccttcgcgcagacccacctccacgtcaagatcgcccagcttgggtactaactgctcatggatggatatgatctatgatcgatcggccagtaataacttggagcatgcccgtgggccgtgtcaagtctgtaatctgtatggattggattggatgtgatgtgatgttatttttcctttttcaatcctcgtggatgtgtgttgttgttacttattaaacgttgtacgggggcttttcaaattaatgtcttgtagtaacttcaatttgtggatggt

SEQ ID NO: 3829 - DNA, 645 bp, Setaria italica
gtcgccttcttcactcaccaaaagccaagcgaagcagctagagctagcgttacacaggcaaggcaagcagcggcggcgccgcccggtcggttgttagagctagggagccatggcgttcatgcggtaccgggcgctgccgcagggggagccgacggtggaggagttccgggcgtggctggcgcagttcgacgccgacagcgacgggcggatcagccgggaggagctccagcacgcgctgcggagcctcaacgtgtggttcgcgtggtggaaggcgaggggcggggtgcgcgccgccgacgccaaccacgacggcggcgtcgccggggacgacgaggtcgcccggctcttcgccttcgcgcagaggcacctcaacgtcaagatcacccagctcgggtactactagatcaccgatctcaggcgacggcggcgatcatcgtcggcgttgtgagtgtatttgtatgggggtggatgtgttgttacttctttgtgttttttacactccgatggatgcatgccttgtttaattcttataaatggtgtacggatgttttgctttcgcaatgtttcgtgtggtaattaactgtgtttccagcatcagaaatttgttgaggaatgttacaatgcaagcatgcatgtggcatgtcg

SEQ ID NO: 3830 - DNA, 781 bp, Sorghum bicolor
acttgcaactgcaactcgatcagcagcacaacagtagactcagagctctagctcactcgcaagctagcaagcactctcaccaagcggaagcagcaagcgcacagaggcaaggcaagcaagccaagcagagcagcggtcgcgcgccggcgaggggatggcgttcatgcggtaccgcgcgctgccgcagggggagctgacggtggaggagttcagggcgtggctggcgcagttcgacgcggaccgcgacgggcggatcagcagggaggagctgcagcacgcgctgcggagcctcaacgtgtggttcgcgtggtggaaggcgcgggacggcgtgcgcgccgccgacgccaaccgcgacggcggcgtgcagggggacgacgaggtggcccgcctcttcgccttcgcgcagaggcaactccacgtcaagatcacccagcagctcggctactactgatctgatctgatctgatctgatctgatctgattgatccatgcatcggccaataagcatcgtaccatcgatcgatgtgagtcgagatgtatttatttattgtcaggatggattggatgtgttgttaattatgcctttttttttcatcctgtggtggatgtgtgttgttgtttaaacgatgtacgggtgctttacttggctttttaaatgtcttgtgtaatttgtggatggtttgaaaagagtctgcgtactcgtatttccaattcagctccacgaacttaatttgttgagaaatggtcaataaatgcatgtggcatgctgcggccttcgttt

SEQ ID NO: 3831 - DNA, 962 bp, Sorghum bicolor
gcaaaacgtgcagtaaaccgagtcgtatcgtaaaaacggtcctcagcgccgtgtggccctctcctcttggaccggtatatatataggatgtagccgtgtgcgtcgctacttgcaactgcaactcgatcagcagcacaacagtagactcagagctctagctcactcgcaagctagcaagcactctcaccaagcggaagcagcaagcgcacagaggcaaggcaagcaagccaagcagagcagcggtcgcgcgccggcgaggggatggcgttcatgcggtaccgcgcgctgccgcagggggagctgacggtggaggagttcagggcgtggctggcgcagttcgacgcggaccgcgacgggcggatcagcagggaggagctgcagcacgcgctgcggagcctcaacgtgtggttcgcgtggtggaaggcgcgggacggcgtgcgcgccgccgacgccaaccgcgacggcggcgtgcagggggacgacgaggtggcccgcctcttcgccttcgcgcagaggcaactccacgtcaagatcacccagcagctcggctactactgatctgatctgatctgatctgatctgatctgattgatccatgcatcggccaataagcatcgtaccatcgatcgatgtgagtcgagatgtatttatttattgtcaggatggattggatgtgttgttaattatgcctttttttttcatcctgtggtggatgtgtgttgttgtttaaacgatgtacgggtgctttacttggctttttaaatgtcttgtgtaatttgtggatggtttgaaaagagtctgcgtactcgtatttccaattcagctccacgaacttaatttgttgagaaatggtcaataaatgcatgtggcatgctgcggccttcgtttatcttgcgagttcgagctatatatggggattgattttccttttaatcaagaaggatcagcgtgatagatgatcc

SEQ ID NO: 3832 - DNA, 438 bp, Triticum aestivum
  misc_feature (378)..(378): n is a, c, g, or t
  misc_feature (385)..(385): n is a, c, g, or t
  misc_feature (399)..(399): n is a, c, g, or t
  misc_feature (402)..(402): n is a, c, g, or t
  misc_feature (418)..(418): n is a, c, g, or t
  misc_feature (421)..(421): n is a, c, g, or t
  misc_feature (427)..(427): n is a, c, g, or t
  misc_feature (432)..(432): n is a, c, g, or t
cttgcctgccactcgatcagcagtaggcccacagctcactcgcaaccactcaccaagctagcggaagcaaagcagagcagcggtcgccggccgggcacgataccagcgtcgcgagagagagagaggatggcgttcatgcggtaccgcgcgctgccgcggggggagctaacagcggaggagttccgggcgtggctggcgcagttcgacgcggacagcgacgggcggatcagcagggaggagctgcggcacgcgctgcggagcctcaacgtgcggttcgcgtggtggaaggcgatgggcggcgtgcgcgccgccgacgccgaccgcgacggaggcgtgcagctgggggaggacgaggtggcccgcctcttcgccttcgcncagagcnacctcggcgtcaanttncccagctccgggtacnacnattacngttanccttct

SEQ ID NO: 3833 - DNA, 314 bp, Setaria italica
gatcgatggcgttcgtgcggtaccgggcgctgccgaggggggagctgacagtggaggagttccgggcgtggctggcgcagttcgacgccgaccgcgacgggcggatcagccgggaggagctccagcacgcgctgcagagcctcaacgtgtggttcgcgtggtggaaggcgcggggcggggtgcgcgccgccgacgccaaccgcgacggcggcgtcgccggggaggaggaggtcgcccggctcttcgccttcgcgcagaggaacctccacgccaagctcacccagctcgggtactactgaacaccgatgaccaga

SEQ ID NO: 3834 - DNA, 367 bp, Setaria italica
caagtagcgggttgccgaggatcgatggcgttcgtgcggtaccgggcgctgccgaggggggagctgacagtggaggagttccgggcgtggctggcgcagttcgacgccgaccgcgacgggcggatcagccgggaggagctccagcacgcgctgcagagcctcaacgtgtggttcgcgtggtggaaggcgcggggcggggtgcgcgccgccgacgccaaccgcgacggcggcgtcgccggggaggaggaggtcgcccggctcttcgccttcgcgcagaggaacctccacgccaagctcacccagctcgggtactactgaacaccgatgaccagacgactggataatcaatgtgatgtgacttgtgagt

SEQ ID NO: 3835 - DNA, 535 bp, Setaria italica
gcggtaccgggcgctgccgaagggggagccgacagtggaggagttccgggcgtggctggcgcagttcgacgccgacagcgacgggcggatcagccgggaggagctccagcacgcgctgcggagcctcaacgtgtggttcgcgtggtggaaggcgaggggcggggtgcgtgccgccgacgccaaccacgacggcggcgtcgccggggacgacgaggtcgcccggctcttcgccttcgcgcagaggcacctcaacgtcaagatcacccagctcgggtactactagatcaccgatctcaggcgacggcggcgatcatcgtcggcgttgtgagtgtatttgtatgggggtggatgtgttgttacttctttgtgttttttacactccgatggatgcatgccttgtttaattcttataaatggtgtacggatgttttgctttcgcaatgtttcgtgtggtaattaactgtgtttccagcatcagaaatttgttgaggaatgttacaatgcaagcatgcatgtggcatgtcgtggctttcgt

SEQ ID NO: 3836 - DNA, 754 bp, Oryza sativa
ggcactgagcagccaggtccggttgccgatgtccctgcgggtggcgacggcgccggcgccggcgcgcgtgtcggtgctgccggcgagcaacaagctgggagacaggctgcggatgcaggcgacgtacaacgtgaagctgatcacaccggacggcgaggtggagctgcaggtgccggacgacgtgtacatcctggaccaggcggaggaggaagggatcgacctgccttactcctgccgcgcgggctcctgctcctcctgcgccggcaaggtggtctccggcgagatcgaccagtccgaccagagcttcctcgacgacgaccaggttgccgccggctgggtcctcacctgccacgcctaccccaagtccgacgtcgtcatcgagacccacaaggaggacgacctcatctaatcaatcaagcaagctccatatttataaatctctcgatccatctccatgcgttcttgagtttatcaattaagaatataatgtcgtcgtccctatgctatgcaagcaaagtattacgtacgtatatgttgagcgagataacaaaacacaggcgtgcccgagggttaattgttgttgtttaattaatgtacgttttgctgcacctgcttaatcatatccatatcacattttggtgtcatatatgcatgcattactgtgtcatatatactactgtcaaatacgtactccatgtatttgaaagaacagttaattaataagctatatatcctagttctactcttgtgtcta

SEQ ID NO: 3837 - DNA, 1145 bp, Setaria italica
cagtagcacattgcactgttctagctcagagcaccaacatgttcttgctcgatctgtatgcgtggcctccacacgcccatcgatgacgatgagcagcgtgtgaacctccttgctccggcgatcccgccgcagataagccgcccactcgccgcccgccacgtggcaccccaccccctccttcctctctatcgataaatcgctggccggccacccgcccctccattgctccttcattccttccctaatccctaggtgtgtgtggccgattcttccattgcttcagctgctgcagctacctagcaaccacaaagcacaataatggccaccgccctcagcagcctccgcgcgccggccttctccgtccgcgccgccccggcgccggcgccggccaccgtcgcgctgccggccaaggtcgcccgcggcgccaggctgcgcgcgcaggccacctacaacgtcaagctcatcacccccgacggcgaggtggagctccaggtgcccgacgacgtctacatcctcgaccaggccgaggaggatgggatcgacctgccctactcgtgccgcgccggctcctgctcctcctgcgccggcaaggtcgtctccggctccgtcgaccagtccgaccagagcttcctcgacgacggccaggtcgccgccgggtgggtgctcacctgccacgcctaccccacctccgacgtcgtcatcgagacgcacaaggaggaggagctcatctaagaagctcgatcactacctgctacgcgcttgctatatctagtatctgtcttgctcttgcaagagatcgagtttgacgacgccggacaattccctttcttgtatcatgcatgtcagtgtcaccatgagaccttgcaattaagcatcggcatcagcagcttctccatcgtttgttactctgcttattgctggtctctgtatcattcatttttactgcggatgcatgataggcttcgctcaagtaattaataacgtttttcctctttatttttgtacaaccaatacatatatatactatatatctgtgtgtgtgtgtgtacgtatgtacctgactaaacgtgctacggaaatgcagcttgagtagtcgtctgaatctgatgctatttgttatgccatgctataaaatgattcaaaag

SEQ ID NO: 3838 - DNA, 802 bp, Pennisetum glaucum
cggtggccatggctcctttcattccttccttgctaagtgtgttcagcaagctacctagccgattcttccattgcttgacctagctgctgcatctactacctagcaaaaccacagatcagcacagtagccatggccaccgccctcagcagcagcctccgcgcgccggctttctccgtccgcgccgccccggcgccggcgccggccaccgtggccctgccggctgccaagctcgcccgcggcaccaggctgcgcgcgcaggccgtccacaacgtgaagctcatcacccccgacggcgaggtggagctgcaggtgcccgacgacgtgtacatcctggaccaggccgaggaggaagggatcgacctgccctactcgtgccgcgccggctcctgctcctcctgcgccggcaaggtcgtctccggcagcgtcgaccagtccgaccagagcttcctcgacgacgaccaggtctccgccgggtgggtgctcacctgcgccgcctacccgacctccgacgtcgtcatcgagacccacaaggaggaggacctcatctgatttattacgcactgctaatgctatgctttgcttatttttgtctctgttgatttacgtcgtgcgtgctagtgcttcctctactccgtttgcaattaattaatcaataagctagccttgttgttgagtgttcaaccatggagagacgtcctagctgctgtgtactaccttgtatgctgcgtttcgtttctcttgcgatgcagtaccgatttggtttgcaagttttgagttaatgtgtgatggtttctctcataaa

SEQ ID NO: 3839 - DNA, 724 bp, Setaria italica
cattccttccctaatccctaggtgtgtgtggccgattcttccattgcttcagctgctgcagctacctagcaaccacaaagcacaataatggccaccgccctcagcagcctccgcgcgccggccttctccgtccgcgccgccccggcgccggcgccggccaccgtcgcgctgccggccaaggtcgcccgcggcgccaggctgcgcgcgcaggccacctacaacgtcaagctcatcacccccgacggcgaggtggagctccaggtgcccgacgacgtctacatcctcgaccaggccgaggaggatgggatcgacctgccctactcgtgccgcgccggctcctgctcctcctgcgccggcaaggtcgtctccggctccgtcgaccagtccgaccagagcttcctcgacgacggccaggtcgccgccgggtgggtgctcacctgccacgcctaccccacctccgacgtcgtcatcgagacgcacaaggaggagtaagaagctcgatcactacctgctacgcgcttgctatatttagtatctgtcttgctcttgcaagagatcgagtttgacgacgccggacaattccctttcttgtatcatgcatgtcagtgtcaccatgagaccttgcaattaagcatcggcatcagcagcttctccatcgtttgttactctgcttattgctggtctctgtatcattcatttttactgcggatgcatgataggcttc

SEQ ID NO: 3840 - DNA, 8403 bp, Oryza sativa
cgcccataactacgcgagagccccaaagcccaatcgtctccttcgcctcgccaccaccaccaaccacgcctccgctgccacacgatggacgacgcgtggcccgcgcggtggcctccgcctccgcctccgcctgctccggcgccggcgacggcgacggcgacaccgctgccgagccagattgacagcgccagtctgcgccacatcctccgccccttcgccgcacagggagcggcgccgccggagcagctggccgcaagccatccgagctcgcagtacggccagcccgcgagagcggcgccgagcacctcgttgcttgctcaggtggctgggaaccatccccatgccacccatgtttcggaccggaaggcgttgtttggcatgctcaatgcaggcaatgctgctaatgtcattgatcttactcgcgcttccccgctcggaggcgcggagcctctgcccaagcatccgaggcacggcttggaagccagcagcagcgttgagcagccctcctgcttggggccgttgtttcagaacacaagtgcaaatgtgcagggtagttttccaggggaatgttcagttaacaatgggatatcccaaggcgccatccagtttcaggactcgagcacatgcgcagtgcagaaattgccatcccaatcaacccctcgccatcatcctgcgcttctaggggatcagatatgcgtctcctgtctgaatgttggtgggttcaacttgcaacaatatctgcaacctagatcgactaccctctgtcatggtctcatgagggaggtagtcattgaatggctagttacagtggtgaattctttgtcggtgaagctgggatttttggagttcgttgcttttgtcaccggctgagaatgtctgtggctaagttctgtgagcattcaggaggacccgcagaaaaagctggtgaaattgtcattatggataatggcatgactattgtacaatggctcaagtactgcatgggggttggagcatccatttctgacactaagtgggactggccagaatgggcatatatgagatattcttcagaagaatactggactaaaagtctccttacaacgaacaataacatggaaaaaacagggctattcagtggacatggaaaaagcactggacatataaacaatccagtttattccagtgatatccacaatgaggttggacgattcacttctgttgagaagctagtgaataagccagatgaaacattttatagaaagagtgtcggtttacatgaagctttctcaaagaatccagctatacagcagagttcgaaaataaacttagcaaatcatatgatccatgacatgaacatgaactctattagcaggccaagtgaacgaacatattcaacagcaaacatgggaataacttacagtagaaatcatttggcacatgattatgcaaactttctggagaaaaacttaaataacttgtctcgtagtcctggtcctagttctacaagagttttgagcaatgacagtagggcatgcatgcctgatgtacctcacaaaataattcaagatggttcaggtagagcatcaaacaccgaactgaagctggggcaatcatcttatcatcaatctatggctaccctatttccatcggtgcagtcgacaataatcgaatttcagaaacctcagcaccacctgcaattcacaactccaaatgcttatccgaagcaaactaccaaagccaacaaaactatagaaaacattgagccatcatttggtacaggtaataggaaacgatcacttgatgtttctaatggaaccagccattctgaactcaatgagattacagatgatgcagcaaagaattcatttatttcattatttctttcacatcttgagagaaatagtacatctgagtccattgatgatgttctcaacagtaatgagcattaccttcttaaggctccagatgttgcatatagttccgatcgtttaaaaactgcaagtacacaagttgagacaagggcaaatgataatcagttgaagttggcacctgccattattcacacgaaaaggatatcagatagcaggtctcttccagttccagtggcttccaagggatatgttcatcaagatgtacttcatgcaaatagtcaagagcctttaataaatggggactgcctgccacatttgctgcctagtcaacctaacgccggaatctccaaaatttgcgcagaagtttcttctccagtgaattgcaggtgttgtaatcatgttgctgacaaatcccatcttgcacattctgagactggggctccctgtttttatgatagaacggccaggagatatatttcttttgaatgtgctgatgacttgtgcacacataaaagtttgagagctaccaattatcagtgtggaagagccttttgttctacagctaatgagtttctacctagctttggccaaaatgatcaatcgccaataggaaaatcaatgcatagatgctgttgcaaagctcaagaagattcttccaaacttggttttagagctggcaatttctgccgatctcatttctgtaatgatggcactccagttccagcccataggtctattgttgaagggctagatgaagtgcgcacccgctctactttcataccaagatcctcattatgttctagagagcttatgttgcagtcctgttgccatgcatgtcccattgatgggtactacagaagttctatgggacacacagccaacagcttgactaagaacactctgcttgatgcacctaataatacagaatgtagtccttaccgggatggaaaatgctgctgctctttagccccaaaatgtttggcaggttatggatttacaaagcactgtgttgctagaatcgatcaaactgatcatacagtacaaaagagcaaggatgatggcatgcaagctgctgccagatgttgcacgctaggggagagtgaaaaattaatatgccagtgctcaagcgagataattgctagaaaaagcgactctaaagcttctttccagaatgaggtctctactgaagtattgaaccgaccttgtgttcctacattacagcagctgaagaatgtaacagaagcatcggctgtaggtggccattggccctatgaaactgtaaaagagaaagcgagtgcttgtagagattctggaatatttaaagaactaaaatccggtttctcttctggattctccagcgatgttgtgaccaagttttctgcatcacctgaattgaacaagtatggtcttgaacacaaaaatcttgtgtttgatgaagggtcacgaattgagaaatgttcctcatccagctatttgcctattagtacaggatgtgaagaagcccaaaatagtttttctagatttcacctggagccatctttagtgaagcacaaaaataatcaaatttctgagggaagtacacggaaagaacatgagaatgagggacaatgttctgaaatgtcaaagaaaacacgaacattgaggtgctgtgcaaacaaatcagaatccgatgattgtactaggaaaattgatctgtcatcccgggaaggggattctcaaccgcagcataaggctggtccattttcacgcagagtatcaaaaaccaagaggaaacatcctcccacgcatctgaataaacatgtgaaacggcttcacagcaactgcaaagttctcaatgttgacaatgaacggtcagatgatgagggcatttatgttggagaatcaaattcctctgatagaaaaaagcaagaagataatatgaccactttggatagaacaaaatgccaacagcaagggagtcgattgcttgtccgcaaactgccaaaatatgtgtctctgaattgcattgtaaatgaaactaacagtgaagatgcctgtagtgggagtgccagtattgattctagtttgattgctacaggaataactaatgataatcggaaatctcccaaaattgttccactcaatctgattcttaaaaaggctaagagatgtcatgctatcaaacccctcagtaagacagaaaatatccatttttctgaggaaaagagttcagatggttctgcagataaatcttcctctggtgacagaagtttcagtccacaagatgaactgtggtctcccaaaaagaataggtattcatctaatgtctcgaggccacacgtcaagactgactgccaaagtccctgctgtgtacttgaagaagatgagcctcttagccttgcagatatggggacaagtcagctgtcagcatcaagaagtagaggaagtaagaatcaaagagcatgcatatctcttaataggatggagaggtgtgaagaatttacaaatgaatcagcatgcagtccttgtggcgataaacacgctgcggttcaagcctgtgtaacaaaatttgaaagatatatacaaaggcctagtttagatgcttcatgttgtgtttgtggtatctcaaacctggagccttccaatcagttgatagagtgcagcaagtgctttatcaaggtgcaccaagcttgctatggtgttctaaaagttccaagaggacaatggttctgtaagccctgcaagatcaatacccaggacacagtctgtgttctgtgtggttatggaggtggagctatgacaagggcattgaaagcccagaatattctcaaaagcttgctgaggggtattgcaactgcaaaaagatcagataaatatgtttattcatcaggaaatgtgaacagtgagtgtacaagcaagttacatggggaatatgtcaggcatgattcatttaatggacacagatcaagaagcttcaatgctatatcttcttttggtataaaagaagcttcaataggtagtgcacgtggggacattatcagcaagtcgtggacctctaatcgcaattccagtctacttggtccacgaacaaggcagtgggttcatgtggtctgtgggttgtggacacctggtacaaaatgcccaaatacaatcacaatgagtgcttttgatatatcaggggcttcacctgccaaaagaaataccgaatgctcaatgtgtaacagaactgggggctcatttatggggtgtcgtgatgttaattgctcagttctctttcatccttggtgtgctcatcagaggggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacagaaggaatatgtccactacaagcagttaaagggatggaagcatttggtagtgtacaaatctagcattcatgggcttggtctctacacatcggagtttattccacgtggctctatggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatcaaccactcttgccaaccaaactgtgtcgcaaaaataatctcagtaaggaacgagaagaaggtagtgttcttcgcggaacgccacataaatccgggggaggaaattacctacgattatcacttcaaccgagaagatgaagggcaaagaatcccctgcttctgtagatcgagaggctgcaggagatatctgaactaagatagtgtacttcggtcgtatgtttgtagtgctgtttaaacattgtaatgtgcgcactgtatatatgaataaactgtagggacttaatctggcactgataatttagacatccaaacttaaatttagaatggatttagaattaatttagacttcctctcccgtgctcggcagcaaaattggaagctacttgccgctgctggagaaggccactgaccttgatagaacccgtaactcgttgatttcccgggacattgttgtcgtaggtactgggaattgtgctcatggaacaagctcataattcatagaaaattcatacacaacctaggtccaatataacaattgaaccttaaagtacaacatcagtaacttggaggtaaaactatcacagaaatttccaacacaaaagaccaattacattcactcgcagtatcaatcgtagcttggagtcaagaaaggattcttctcgtcatagaaagggtttgtgaaatgttgactgctgctaagactgtcatggacgttacccttcactgcagcctgatgctgagagaatgctctcgggttgaaattttcgtcatggctgtctccgaatgcaacccagccatcaccgccgccggtgatgtccctctgcttctccatctcttcgacgtgctccttgaactctttcttcgccacgttgatcacgttgtctccgtgttcatcgcaccatgccctgcaaaaacagatactatcatctcagaatttctgaaccatgtctgttaaatctgaatgatgacggaattgtgaagttttcagtactttgggaagaaggtcttgaggtcagatttgtccactggaagccttgttgagatggcctcaatttgttgatccctacaatgatgccaggacatacattttacacacttcaaacaacagtaattgatcaaaaaattcattggcaaaacagacagattaaaacttacgaaaagttcaagtttcggttggtggatgacaactcagcctgaatccttgaaagctctttctttgtgttctccaccaaaaccttcagtaagttcagatacaaaaagctcagttcagtccagtaattctgaaactaccaagtaccaatcaatggacacctgcacaatctgtttactgaaactaaacacgatggagagatcaaccactttgcaataccttatcattcgctaaatcggaagcagaatcatcgtcgccggtggccgtattcagcttcttcttggctctctttgcatccttggcaacagccgggctcgcctcaagccggcactcactgtacgaagaccgcggcgcagcgtgctccggccgctcaccgccggccgtcgcctcatcgttgcttgccttcttccacttcttgaggccatcgaacccccacgaactcttcttcttgctctttgacgcatccttctcctgatctgtgccttccatggacgccgccgggggctccttgttctcgctgccattgccgccgttgtggaacatcgccgtcaggtgcctcctcttccccttgtcggtcttggcggtgggcatggcttccgacggcgagctctcggccatgaggacggatggggcgttcttgctgttgttctggtcgacgggggctaacggtggcctcgatgcgtccagctccttcttgcctctgctcttccatggcgggacgaaggccttgtgcttcggcttgtcggaggccgccgcggcgggcggcgggtcccggaggtcgatctccgaccactcctccatggaagacgacgaggctggtgccgccgccgaagccgcgccgccatcgccgacgtccgcgtcggggcagtcgaccacgacaccgaacgccgcgaggcgctgcacgagtgggctcttggtggagttgtactccgccgccgagatgcacttggcgtacaagagctcctgcaaaaggagaagggagaagcgttcgatcaattgctcgctcggattggagggagggaggtagaagaagaagaagaagaaggcgatgcgggtgggtagtacctggaggaagaggagcttgtcgcggaggatggcgggctggtcggggtgggcgggcgggggcggggcggcggcgagggtggcgagcatgtcggcgcggaaggcgtcgacgtcggagggcgggacgatgccctcgcggtggagcgcggagaggtggaggatgcggtggaacgattcctgctgccacttgagcgcgtcggcgtggcgcctcgccgcggcctggtcggcggtgaggcggcggccggacctgaagccgccgaaggggaggatggacttgcacagcgacgcgatggtgtcgtgcaggcccgagtagtacgtcggcgtgtacgtgtaccccatcgtcgtcggcgactcgtcggcggcgagctgctgctgctgctgctccggtggctgctcaggcgaggcgaggaggggagcgtgagagagagagagagggagatggtggtgagagagtgaaggggaacgggttttgttgggctacggc

SEQ ID NO: 3841 - DNA, 3764 bp, Setaria italica
cttcccgcctccccctcccactccctccccaacctcttcgacgatgagctcaggcgggcgcggcggcaagaggcgggcccccccgccccccgcgccctcaggggcggcggcgaagagggcccaccccaacccgggcaccccgcagccgcctccaccggcggcggcggcggcgcccggggcggaggaggaggacatgatggacgaggacgtgttcctggacgagtccatcctggcggaggacgaggcggcgctgctgatgatccagcgggacgaggctctcgcgtcccgcctcgcgcggtggaagcgccccgcgctccccgcagacctcgccaccggctgctcccgcaccgtcgcttttcagcaattggaaatagattatgttattggtgagaatcacaaagaactgctgcccaactcatctggtcctgcagccatactcaggatttttggtgtcaccagagaaggtcacagcatatgctgtcaggtgcatggatttgagccatatttctatatcggttgtccttctgggatgggtcctgatgatatatcacgctttcaccaaacacttgaggggaggatgaaggagtcaaatagaagtagcaatgtgccaaggttcgtgaagagagttgagcttgtgcagaagcagacaattatgcattaccaaacacaacaatctcagcctttcctcaagatagtagtcgctttgcctacaatggttgctagctgtcgcggcatcctggaaaggggcataacgattgaaggccttggttcaaagagtttcctgacatatgagagcaatattctttttgcccttcgtttcatgattgattgcaatattgttggtggcaactggattgaagttcctgctgggaagtacaggaaagcagcccgtgtcatgtcctattgtcagctagagttggattgcctatactcagatttggtaagccatgctgccgaaggagaatattctaagatggctccatttcgcatattaagtttcgatattgagtgtgctggtcgcaaaggtcatttcccagaaccaactcatgatcctgttattcagatagccaacttagtcacacatcaaggagaaggccaaccttttgtacggaatgtcatgactcttaaatcatgttctcccattgttggagtcgatgtaatgtcatttgatacagagagagatatactacttgcttggagggatttaatacgtgaagtggatcctgatatcataattggatacaacatttgcaaatttgacttgccttatcttattgagagggctgaggttcttaagataacggagtttcctttacttggccgaatcagaaacagtcgtgttcgtgtccgtgatacgaccttttcctcgaggcaatatggtgtgcgcgaaagtaaggatgttactattgaggggagagtgcaatttgatctcctgcaggctatgcaacgagattacaagctgagttcctattcattgaactctgtatcagcacacttccttggggagcaaaaagaggatgttcatcattcaattatatctgatcttcaaaatggaaactcagagacacgaaggaggctggcagtttattgcttgaaggatgcttatcttcctcaaagactgttagataaattgatgtatatctacaactatgtggaaatggcgagggtcactggtgttcccatttcatttcttctttcaaggggacagagcattaaggtcctctcacagctactcaggaaagctaaacagaaaaaccttgttataccaaacataaagggtcaagggtctggacaagatacctttgagggtgcaactgttttggaggcaagggctggattttatgagaagcccattgcaactttggattttgcttctttgtatccatcaatcatgatggcgtataatctgtgctactgtactttggtgcccccagaggatgcccggaaactcaacttacctccagaaagcctcaataaaactccatctggtgaaatatttgtgaaaccagagctacagaagggtatacttcctgagatccttgaagaattgttagctgctcggaaaagggcaaaagcagatttaaaggaagcaaaggacccactcgaaagggctgttcttgatggtcgtcagcttgcattgaaaataagtgcaaactcagtttatggtttcactggtgcaactgttggtcaattaccttgtttggagatttcttcaagtgtgaccagctatggtcgacagatgattgaacatacaaaaaagcttgtcgaagataaattcacaacagtaggaggctatgagcataatgcagaggtaatttacggggatacagattcagtgatggtacagtttggtgcttctactgttgaagatgcaatgaagttaggaagagaagctgcagattatattagtggaacgtttactaagcccatcaagctggagtttgagaaggtctactttccttacctgctgatcagcaagaagagatatgctggtttgtactggacgaatcctgagaaatttgacaaaatggatgcaaaaggtattgaaactgtaagaagagataactgtttattagtaaagaacctggtaactgagtgccttcataaaatactagtggaccgtgatattcctggtgcagttcaatatgtcaagaacaccatatctgatctattaatgaatcgtgtggacttgtctcttcttgttataacaaagggtttgactaaaacaggagaagattatgccgtaaaagctgctcatgtagagcttgctgagagaatgcgaaagagggatcctgctactgcacctactgttggtgatcgtgttccttatgttataattaaagcagcaaaaggggcaaaggcatatgagaagtcagaagatccaatctatgttttggacaataacatacccatagatcctcaatactaccttgagaaccaaattagcaagccacttttgcggatcttcgagccaatcctgaagaatgccagcaaagaattgcttcatggaagccacaccagatctgtttcgatctctactccttcaaatagcggtataatgaagtttgcaaagaaacaattgacttgccttggatgcaaagccgttatcagcggtgccagtcagacactttgctcacattgcaagggtagggaagcagagttatactgcaaaacagtagcaaatgtttctgacctggaggtgctctttgggaggctatggacgcaatgccaggagtgccaggggtctctgcaccaggacgtcctctgcacaagtcgggattgcccaattttctaccggcgacggaaggctcaaaaggatatggccgaagctaggctgcagctggatcgatgggacttctgagccttgtaagatctcatgcgaactacccagcattttcgcacataatgcgaaaacactgcagcatggtatgcgatcatacggccacatcgtgagcttcggcaaggagtcagccgtgcgccctcggagttgagtcacgtaggattattttctgtaggatttacccgtatgttgtttaggtgggtgttcttagttcgcaggagatttgtgtctcctgccattaactagatgacaagatggatggtggctctcttggtctgatgatgtaccaatgtaaaagagttggtaggagtacggaacaagtcatgttgtaacttgtttggtgacatgatccaaaaaggccgagaagcatccattccacgtctatgtgaactttttatggtgttatgcccacggactcccttcc

SEQ ID NO: 3842 - DNA, 3748 bp, Brachypodium distachyon
cccactcccgctctacggcgatgagctcaggcgggcgcggcggcaagcggcggacggcgccgccccaagcgccctccgcggcggcggcgaagcgggcccaccccatgccgaccaccggcaccccgcagccgccgcctccggccccgccggccgcgacggcggaggaggaggacatgatggacgaggacgtgttcctggacgaggccatcctggcggaggacgaggcggcgcttctgctgctcgaccgcgacgaggccctcgcctcccgcctctcccggtggaagcggcccgccctccccgccgacctcgtctccggttgctcccgctccgttgcttttcagcagctggatatagattatgttattggcgagagccacagagaattgctccccaacacttccggacctgcagctataatcagaatttttggtgtcaccaaagaaggtcacagtgtttgctgtcaggtgcatggatttgagccatatttctacattagctgcccatcagggatgggtccggatgatatttcacgcttccagcaagcacttgaggtgaggatgaaggaatcaaatagaagtagcaacgtgccaaggtttgtgaagagagttgatcttgtgcagaagcagacaattatgcattaccagacacagaaatctcagtctttcctcaagatagtagttgccctacctacaatggttgctagttgtcgcggcatcctggaacggggcataacgattgaaggctttggttcgaagagtttcctgacatatgaaagcaacattctttttgcccttcgctttatgattgactgcaacattgttggtggcaattggattgaagttcctcgtgggaagtataggaaagcagctcgcatcatgtcgtattgtcaactagagctggattgcatatattccgatttagtaagccatgctgctgaaggggaatactctaagatggccccatttcgcatattaagttttgacatagaatgtgctggtcgcaaagggcacttcccagaaccaactcatgatcctgttattcagatagccaatttactgacgcttcaaggagaagcccaacctttcgtacggaatgtcatgacccttaaatcatgctcacctattgttggagtcgatgtgatgtcatttgacacggagagagatattctacttgcttggagggatttaatacgcgaggcggatcctgatattataattggatacaatatctgcaaatttgatctgccctatcttattgagagagctgaagttctgaagatagtggagtttccgctacttggtcgaatcagaaatagccgtgttcgtgtccgtgatactaccttcaactcaaggcaatatggtgtgcgtgaaagtaaagatgtaactgtggagggaagggtacaatttgatcttctgcaggctgtgcaaagggattacaagctgagttcttattcgctgaactctgtatctgcacattttcttggggagcaaaaagaagacgttcatcattcaattatatctgatcttcaaaatgggaactcagagacacgaaggcggctggcagtctattgcttaaaggatgcttaccttccgcagagactcttagataaattgatgtacatctacaactacgtagagatggcgagggtcacaggggttcccatttcatttctgctctcgagaggacagagcattaaggtcctctcgcagctactcaggaaagcaaagcaaagaaaccttgttataccaaacataaagggccaaggttctggacaagatacctttgagggtgcaactgttttggaggcaagggctggattttatgagaagcccattgcaactttggactttgcttctctatatccatccatcatgatggcacataacctatgctactgcactctggtgccccctgaggatgtccgtaaactcaacttgcctccagaaagcctgtacaaaaccccatctggtgaaatatttgtgaaaccagaactgcaaaagggtatacttcctgaaatccttgaagaactgttgactgctcgaaaaagagcaaaagcagatctgaaggaagcaaaagacccatttgaaagggcggttcttgatggtcgtcagcttgccctaaaaataagtgcaaactcagtttacggttttactggagctactgttggtcaattgccctgtttagagatttcttcaagtgtgacaagctacggaagacagatgattgagcatacaaagaagcttgttgaagataaattcacaacacttggaggctatgagcataacgcagaggtgatttatggagatactgattctgtgatggtacagtttggtgtttcgacagttgaggacgcaatgaaattgggcagagaagctgcagattatattagtggaacatttattaagcccatcaagctagagtttgaaaaagtctatttcccatatctgctgatcagcaagaagagatatgctggtttgtactggacaaatcctgagaaatttgacaaaatggatacaaaaggtattgaaacagtaagaagggacaattgtttgttggtaaagaacctggtaaccgagtgccttcacaaaatactagtggaccgagatgttcccggggcagttcaatatgttaagaacaccatatctgatctattaatgaaccgtgtggacttgtcacttctagttataacaaagggtctgactaaaacaggagaagactatgctgtaaaagctgcccatgtagagcttgctgagaggatgcggaagagggatgctgctactgcaccaactgttggtgaccgtgttccttatgttataataaaagcagcaaaaggggcaaaggcatatgagaagtcagaagatcctatttatgttctggataataacataccaatagatcctcaatactaccttgagaaccaaattagcaaaccactgttgagaatatttgaaccaattctgaagaacgccagcagagaactgcttcatggaagtcacaccagagctgtttcaatctcaactccatcaaatagcgggataatgaaatttgctaagaaacaactgacttgccttggatgcaaagctgttataagtggccccaatcaaacactttgctcacattgcaaggggagagaagcagaattatactgcaaaactgtagcaaatgtttctgatctggagatgctctttgggaagctatggacacagtgccaagagtgccaaggctccctacaccaggatgttctctgtaccagtcgggactgccctattttctaccggcgaagaaaagcgcagaaagacatggctgaagctagggtgcagctcgatcgctgggacttctgagtcctctcagaaatctgacaactcgcgttttctctctgacaacccgcatttccatacgtgttgcaaaaaggcgtaattgcgagtggcgtgctgctgccagatcatgtgattgcatcatgatgctatgggccagcgtgatgacgattagtggtcgcccttctagtcagaatgggctttgagataggcttgctgtatggttcatctgcatgccggattagttggcagggactttgtatctcctgccattggcagcaacaaccttggtagatagaatgattggtgtagcggtgagctgctgacgtgtaaggtatagcagctcatcttgtaatttggtgaattgtaacaaagtgatgttgtaacttgctgagattttacacgtggtcatgtctggcaagttttcctaattt

SEQ ID NO: 3843 - DNA, 3914 bp, Brachypodium distachyon
aaaccctacatctccagcaatggcgggaaccccaattcccccttcccagccttcccgcctctccagtccccacccacatcccctctcccactcccgctctacggcgatgagctcaggcgggcgcggcggcaagcggcggacggcgccgccccaagcgccctccgcggcggcggcgaagcgggcccaccccatgccgaccaccggcaccccgcagccgccgcctccggccccgccggccgcgacggcggaggaggaggacatgatggacgaggacgtgttcctggacgaggccatcctggcggaggacgaggcggcgcttctgctgctcgaccgcgacgaggccctcgcctcccgcctctcccggtggaagcggcccgccctccccgccgacctcgtctccggttgctcccgctccgttgcttttcagcagctggatatagattatgttattggcgagagccacagagaattgctccccaacacttccggacctgcagctataatcagaatttttggtgtcaccaaagaaggtcacagtgtttgctgtcaggtgcatggatttgagccatatttctacattagctgcccatcagggatgggtccggatgatatttcacgcttccagcaagcacttgaggtgaggatgaaggaatcaaatagaagtagcaacgtgccaaggtttgtgaagagagttgatcttgtgcagaagcagacaattatgcattaccagacacagaaatctcagtctttcctcaagatagtagttgccctacctacaatggttgctagttgtcgcggcatcctggaacggggcataacgattgaaggctttggttcgaagagtttcctgacatatgaaagcaacattctttttgcccttcgctttatgattgactgcaacattgttggtggcaattggattgaagttcctcgtgggaagtataggaaagcagctcgcatcatgtcgtattgtcaactagagctggattgcatatattccgatttagtaagccatgctgctgaaggggaatactctaagatggccccatttcgcatattaagttttgacatagaatgtgctggtcgcaaagggcacttcccagaaccaactcatgatcctgttattcagatagccaatttactgacgcttcaaggagaagcccaacctttcgtacggaatgtcatgacccttaaatcatgctcacctattgttggagtcgatgtgatgtcatttgacacggagagagatattctacttgcttggagggatttaatacgcgaggcggatcctgatattataattggatacaatatctgcaaatttgatctgccctatcttattgagagagctgaagttctgaagatagtggagtttccgctacttggtcgaatcagaaatagccgtgttcgtgtccgtgatactaccttcaactcaaggcaatatggtgtgcgtgaaagtaaagatgtaactgtggagggaagggtacaatttgatcttctgcaggctgtgcaaagggattacaagctgagttcttattcgctgaactctgtatctgcacattttcttggggagcaaaaagaagacgttcatcattcaattatatctgatcttcaaaatgggaactcagagacacgaaggcggctggcagtctattgcttaaaggatgcttaccttccgcagagactcttagataaattgatgtacatctacaactacgtagagatggcgagggtcacaggggttcccatttcatttctgctctcgagaggacagagcattaaggtcctctcgcagctactcaggaaagcaaagcaaagaaaccttgttataccaaacataaagggccaaggttctggacaagatacctttgagggtgcaactgttttggaggcaagggctggattttatgagaagcccattgcaactttggactttgcttctctatatccatccatcatgatggcacataacctatgctactgcactctggtgccccctgaggatgtccgtaaactcaacttgcctccagaaagcctgtacaaaaccccatctggtgaaatatttgtgaaaccagaactgcaaaagggtatacttcctgaaatccttgaagaactgttgactgctcgaaaaagagcaaaagcagatctgaaggaagcaaaagacccatttgaaagggcggttcttgatggtcgtcagcttgccctaaaaataagtgcaaactcagtttacggttttactggagctactgttggtcaattgccctgtttagagatttcttcaagtgtgacaagctacggaagacagatgattgagcatacaaagaagcttgttgaagataaattcacaacacttggaggctatgagcataacgcagaggtgatttatggagatactgattctgtgatggtacagtttggtgtttcgacagttgaggacgcaatgaaattgggcagagaagctgcagattatattagtggaacatttattaagcccatcaagctagagtttgaaaaagtctatttcccatatctgctgatcagcaagaagagatatgctggtttgtactggacaaatcctgagaaatttgacaaaatggatacaaaaggtattgaaacagtaagaagggacaattgtttgttggtaaagaacctggtaaccgagtgccttcacaaaatactagtggaccgagatgttcccggggcagttcaatatgttaagaacaccatatctgatctattaatgaaccgtgtggacttgtcacttctagttataacaaagggtctgactaaaacaggagaagactatgctgtaaaagctgcccatgtagagcttgctgagaggatgcggaagagggatgctgctactgcaccaactgttggtgaccgtgttccttatgttataataaaagcagcaaaaggggcaaaggcatatgagaagtcagaagatcctatttatgttctggataataacataccaatagatcctcaatactaccttgagaaccaaattagcaaaccactgttgagaatatttgaaccaattctgaagaacgccagcagagaactgcttcatggaagtcacaccagagctgtttcaatctcaactccatcaaatagcgggataatgaaatttgctaagaaacaactgacttgccttggatgcaaagctgttataagtggccccaatcaaacactttgctcacattgcaaggggagagaagcagaattatactgcaaaactgtagcaaatgtttctgatctggagatgctctttgggaagctatggacacagtgccaagagtgccaaggctccctacaccaggatgttctctgtaccagtcgggactgccctattttctaccggcgaagaaaagcgcagaaagacatggctgaagctagggtgcagctcgatcgctgggacttctgagtcctctcagaaatctgacaactcgcgttttctctctgacaacccgcatttccatacgtgttgcaaaaaggcgtaattgcgagtggcgtgctgctgccagatcatgtgattgcatcatgatgctatgggccagcgtgatgacgattagtggtcgcccttctagtcagaatgggctttgagataggcttgctgtatggttcatctgcatgccggattagttggcagggactttgtatctcctgccattggcagcaacaaccttggtagatagaatgattggtgtagcggtgagctgctgacgtgtaaggtatagcagctcatcttgtaatttggtgaattgtaacaaagtgatgttgtaacttgctgagattttacacgtggtcatgtctggcaagttttcctaatttgtatagtagttccacaacagataaaatctgaccattgtttcaagtacaccattcattaatcttcgccaaatttgcatgtt

SEQ ID NO: 3844 - DNA, 3853 bp, Sorghum bicolor
tccggcgatgagctcaggcgggcgcggcggcaagcggcggggtcccccgccccccgccccctccggggcggcggcgaagagggccaaccccagccccggcatgccgcagcctcctcctcccgcggcggcggaggaggacatgatggacgaggacgtgttcctggacgagtccatcctggcggaggacgaggcggcgctgctgatgctccagcgcgacgaggccctcgcgtcccgcctcgcgcggtggaagcgccccgcactcccctccgacctcgccgccgggtgctcccgcgccgtcgcttttcagcagttggaaatagattatgttattggtgagagccacaaagaattgctccccaactcatctggttcggcagccatactcaggatttttggtgttaccagagaaggtcacagcatatgctgtcaggtgcatggatttgagccatatttctacattggctgtccttcagggatgggtcctgatgatatatcgcgctttcaccaaacactagaggggaggatgaaggagtcaaatagaagcagcaatgttccaaggttcgtgaagagagttgagcttgtgcagaagcagacaattatgcattaccaaacgcaggaatctcagcctttcctcaagatagtagtcgctttgcctaccatggttgctagctgtcgtggtattctggaaaggggcataatgattgaaggccttggttcaaagagtttcctgacatatgaaagcaacattctttttgcccttcgtttcatgattgattgcaatattgttggtggcaactggattgagcttcctgctggaaaatacaggaaagcagcccgtctcatgtcctattgtcagctagagctagattgcctatactcagatctggtaagtcatgctgctgaaggagaatattctaagatggccccatttcgcatattaagttttgatattgaatgtgctggtcgcaaaggtcatttcccagaaccaactcatgatcctgttattcagatagctaacttggtaacacatcaaggagaaggccaaccttttgtacagaatgtcatgactcttaagtcatgctctcccattgtgggagtcgatgttaggtcatttgatacggagagagatattctacttgcatggagggatttcatacgtgaagtggatcctgatatcataattggatacaatatctgcaaatttgacatgccatatcttattgagagggctgaagttctcaagatagcggagtttccaatacttggccgaatcagaaatagtcgtgttcgtgtccgtgatacgaccttttcctcaaggcaatatggtgtgcgtgaaagtaaggatgttaccattgaaggaagagtgcaatttgatctcctgcaggctatgcaacgggattacaagctgagttcttattcattgaactctgtatcggcacacttccttggggagcaaaaagaagatgttcatcattcaattatatctgatcttcaaaatggaaactcagagacacgaaggcggctggcagtttattgcttgaaggatgcttatcttcctcaaagactgttagacaaattgatgtatatctacaattatgtggaaatggcgagggtcactggtgttcccatttcgtttctactttcgaggggacaaagtattaaggtcctctcgcaactactcaggaaagcaaaacagaaaaaccttgttataccaaatataaagggtcaagggtctgggcaagatacctttgagggtgcaactgttttggaggcaagggctggattttatgagaagcccatcgcaactttggactttgcttctttgtatccatccatcatgatggcatataacctttgctactgtactttggtgcccccggaggacgcccgtaaactcaacttacctccagaaagcatcaataaaaccccatctggtgaaatatttgtgaaaccagaactacagaagggtatacttcctgagatccttgaagaattattagcagctcggaaaagggcaaaagcagatttaaaggaagcaaaggacccactcgaaagggctgttcttgatggtcgtcagcttgcactgaaaataagtgcaaactcagtttatggtttcactggagcaactgttggtcagttaccttgcttagagatttcttcaagtgtgaccagctatggacgacagatgattgaacatacaaaaaagcttgttgaagataaattcacaacagtaggaggttatgagcataatgcagaggtaatttatggggacactgattctgtgatggtacagtttggtgtttctacagttcaagatgcaatgaagttaggaagagaagctgcagattatattagtggaacctttaccaagcccatcaagctggagtttgagaaggtctattttccttaccttctgatcagcaagaagagatatgctggtttgtactggacgaatcctgagaaatttgacaaaatggatgcaaaaggtattgaaactgtgagaagggacaactgtttgttggtaaagaacctggtaaccgagtgccttcataaaatactggtggatcgtgatgttcctggtgcagtccaatatgtcaagaacaccatatctgatctattaatgaatcgtgtcgacttgtctcttcttgtcataacaaagggtttgacaaaaacgggagaagattatgcggtaaaagctgctcatgtggagcttgctgagaggatgcgaaagagagatccagctactgcacctactgttggtgatcgtgttccttatgttataattaaagcagcaaaaggggcaaaggcatatgagaaatcagaagatccaatttatgttttggacaataatatacccattgatcctcaatactaccttgagaaccaaattagcaagccacttttgaggatctttgagccaattctgaagaatgccagcaaagagttgcttcatggaagccacaccagatctgtttcaatctcaactccttcaaatagcgggataatgaaatttgcaaagaaacaattaacttgccttgggtgcaaagctgttatcagtggtgccagtcagacactttgctcacattgcaagggaagagaagcagagttatactgcaaaacagtagcaaatgtttctgacctggagatgctctttgggaggttatggacacaatgccaggagtgccaaggatctctgcaccaggacgttctctgcacgagtcgggattgtccgattttctatcggcgaaggaaggctcagaaggatatggccgaagctaggctgcagcttgaccggtgggacttttgactttctgggcttgtaaattctcacacggctgcctgcggaggacaggaggctaccgtcgaccgcatgacggatacacgttaagatgagactggccttttgcgagcatccagacacacttgagcccgttgtcgcgtaggtagtccgtaggctggctcgccagtaggattcagcgttatgtttgctgtttatattttgatgagttgtagtttactagtttaggtgagttgtttgatgataggaggttcgtgtctcctctctgtagtttgtgccgtgaaagaatgcttgctcccgaggtgagttgctgctgatgtacaaggcagaaggcttctggagcagttcatcttgtaagttgtagctgggtgagatgagacaatttgaaggccacgtggattctctcaattcttgttctaattgtgcaattttcgaactgagaatgccagcaagtctctgagcatctgaactggcgaggtgcttatgtcaggaactgcacagagctaggagacgagcgctagcaacgacgcgacccagctgttgccttcgtctatg

SEQ ID NO: 3845 - DNA, 4418 bp, Sorghum bicolor
aaaatttttcgaaactaaacaaggccataggaaccatcctatcctcctccaactaaacatgaaacaaggtcgattccatccctaaaaaagattttggacctatcctatgtcctatctcaccgtgaccatgaaccctcccaaaaaaaaaaaaaaaaacgctagacgcccctgaataactcgtgtctacaattgacgtaaccattacaagggaggcgtatttctttacctcctcccctctctgtattaaaccctacctccccagcaatggcgggaaccccaatttcagtccccgcacttcccgcctaaccctcccactcccggtcccaccccccgtcccccaatccggcgatgagctcaggcgggcgcggcggcaagcggcggggtcccccgccccccgccccctccggggcggcggcgaagagggccaaccccagccccggcatgccgcagcctcctcctcccgcggcggcggaggaggacatgatggacgaggacgtgttcctggacgagtccatcctggcggaggacgaggcggcgctgctgatgctccagcgcgacgaggccctcgcgtcccgcctcgcgcggtggaagcgccccgcactcccctccgacctcgccgccgggtgctcccgcgccgtcgcttttcagcagttggaaatagattatgttattggtgagagccacaaagaattgctccccaactcatctggttcggcagccatactcaggatttttggtgttaccagagaaggtcacagcatatgctgtcaggtgcatggatttgagccatatttctacattggctgtccttcagggatgggtcctgatgatatatcgcgctttcaccaaacactagaggggaggatgaaggagtcaaatagaagcagcaatgttccaaggttcgtgaagagagttgagcttgtgcagaagcagacaattatgcattaccaaacgcaggaatctcagcctttcctcaagatagtagtcgctttgcctaccatggttgctagctgtcgtggtattctggaaaggggcataatgattgaaggccttggttcaaagagtttcctgacatatgaaagcaacattctttttgcccttcgtttcatgattgattgcaatattgttggtggcaactggattgagcttcctgctggaaaatacaggaaagcagcccgtctcatgtcctattgtcagctagagctagattgcctatactcagatctggtaagtcatgctgctgaaggagaatattctaagatggccccatttcgcatattaagttttgatattgaatgtgctggtcgcaaaggtcatttcccagaaccaactcatgatcctgttattcagatagctaacttggtaacacatcaaggagaaggccaaccttttgtacagaatgtcatgactcttaagtcatgctctcccattgtgggagtcgatgttaggtcatttgatacggagagagatattctacttgcatggagggatttcatacgtgaagtggatcctgatatcataattggatacaatatctgcaaatttgacatgccatatcttattgagagggctgaagttctcaagatagcggagtttccaatacttggccgaatcagaaatagtcgtgttcgtgtccgtgatacgaccttttcctcaaggcaatatggtgtgcgtgaaagtaaggatgttaccattgaaggaagagtgcaatttgatctcctgcaggctatgcaacgggattacaagctgagttcttattcattgaactctgtatcggcacacttccttggggagcaaaaagaagatgttcatcattcaattatatctgatcttcaaaatggaaactcagagacacgaaggcggctggcagtttattgcttgaaggatgcttatcttcctcaaagactgttagacaaattgatgtatatctacaattatgtggaaatggcgagggtcactggtgttcccatttcgtttctactttcgaggggacaaagtattaaggtcctctcgcaactactcaggaaagcaaaacagaaaaaccttgttataccaaatataaagggtcaagggtctgggcaagatacctttgagggtgcaactgttttggaggcaagggctggattttatgagaagcccatcgcaactttggactttgcttctttgtatccatccatcatgatggcatataacctttgctactgtactttggtgcccccggaggacgcccgtaaactcaacttacctccagaaagcatcaataaaaccccatctggtgaaatatttgtgaaaccagaactacagaagggtatacttcctgagatccttgaagaattattagcagctcggaaaagggcaaaagcagatttaaaggaagcaaaggacccactcgaaagggctgttcttgatggtcgtcagcttgcactgaaaataagtgcaaactcagtttatggtttcactggagcaactgttggtcagttaccttgcttagagatttcttcaagtgtgaccagctatggacgacagatgattgaacatacaaaaaagcttgttgaagataaattcacaacagtaggaggttatgagcataatgcagaggtaatttatggggacactgattctgtgatggtacagtttggtgtttctacagttcaagatgcaatgaagttaggaagagaagctgcagattatattagtggaacctttaccaagcccatcaagctggagtttgagaaggtctattttccttaccttctgatcagcaagaagagatatgctggtttgtactggacgaatcctgagaaatttgacaaaatggatgcaaaaggtattgaaactgtgagaagggacaactgtttgttggtaaagaacctggtaaccgagtgccttcataaaatactggtggatcgtgatgttcctggtgcagtccaatatgtcaagaacaccatatctgatctattaatgaatcgtgtcgacttgtctcttcttgtcataacaaagggtttgacaaaaacgggagaagattatgcggtaaaagctgctcatgtggagcttgctgagaggatgcgaaagagagatccagctactgcacctactgttggtgatcgtgttccttatgttataattaaagcagcaaaaggggcaaaggcatatgagaaatcagaagatccaatttatgttttggacaataatatacccattgatcctcaatactaccttgagaaccaaattagcaagccacttttgaggatctttgagccaattctgaagaatgccagcaaagagttgcttcatggaagccacaccagatctgtttcaatctcaactccttcaaatagcgggataatgaaatttgcaaagaaacaattaacttgccttgggtgcaaagctgttatcagtggtgccagtcagacactttgctcacattgcaagggaagagaagcagagttatactgcaaaacagtagcaaatgtttctgacctggagatgctctttgggaggttatggacacaatgccaggagtgccaaggatctctgcaccaggacgttctctgcacgagtcgggattgtccgattttctatcggcgaaggaaggctcagaaggatatggccgaagctaggctgcagcttgaccggtgggacttttgactttctgggcttgtaaattctcacacggctgcctgcggaggacaggaggctaccgtcgaccgcatgacggatacacgttaagatgagactggccttttgcgagcatccagacacacttgagcccgttgtcgcgtaggtagtccgtaggctggctcgccagtaggattcagcgttatgtttgctgtttatattttgatgagttgtagtttactagtttaggtgagttgtttgatgataggaggttcgtgtctcctctctgtagtttgtgccgtgaaagaatgcttgctcccgaggtgagttgctgctgatgtacaaggcagaaggcttctggagcagttcatcttgtaagttgtagctgggtgagatgagacaatttgaaggccacgtggattctctcaattcttgttctaattgtgcaattttcgaactgagaatgccagcaagtctctgagcatctgaactggcgaggtgcttatgtcaggaactgcacagagctaggagacgagcgctagcaacgacgcgacccagctgttgccttcgtctatgattggagcatgaataactgggagccgaggctgttgcttgcagctaaaacttggtccggaccagagaatcttgtgatttgtgagccatcttctaatttaaatattgcctggttttatgagattggtccttttttaaatcttggttacgcatctagatttttgttgcatattggataccactctgcaaacccagacttacatataaaaagaaatactaaataataa

SEQ ID NO: 3846 - DNA, 3795 bp, Sorghum bicolor
atgagctcaggcgggcgcggcggcaagcggcggggccccccgccccccgctccctccggggcggcggtgaagagggctaaccccagccccggcatgccgcagcctcctcctcccgcggcggcggcggcggaggaggacatgatggacgaagacgtgttcctggatgagtccatcctggcggaggacgaggcggcgctgctgatgctccagcgtgacgaggccctcgcgtcccgcctcgcgcggtggaagcgccccgcactccccgccgacctcgccgccgggtgctcccgcaccgtcgcttttcagcagttggaaatagattatgttattgatgagagccacaaagaattgctccccaactcatctggttcagcagccatactcaggatttttggtgttaccagagaaggtcacagcatatgctgtcaggtgcatggatttgagccatatttctatattggctgtccttcagggatgggtcctgatgatatatcacactttcaccaaacactagaggggaggatgaaggagtcaaatagaagcagcaatgttccaaggttcgtgaagagagttgaacttgtgcagaagcagacaattatgcattaccaaacgcagcaatctcagcctttcctcaagatagtagtcgctttgcctaccatggttgctagctgtcgtggtatcctggaaaggggaataatgattgaaggccttggctcaaagagtttcctgacatatgaaagcaacattctttttgcccttcgtttcatgattgattgcaatattgttggtggcaactggattgaacttcctgctgggaaatacaggaaagcagcccgtgtgatgtcctattgtcagctagagctagattgcctatactcagatctggtaagtcatgctgctgaaggagaatattctaagatggccccgtttcgcatattaagttttgatattgaatgtgctggtcgcaaaggtcatttcccagaaccaactcatgatcctgttattcagatagctaacttggttacacatcaaggagaaggtcaaccttttgtacagaatgtcatgactcttaaatcatgctctcccattgtgggagtcgatgttatgtcatttgatgcagagagagatattctacttgcatggaggaatttcatacgtgaagtggatcctgatatcataattggatacaatatttgcaaatttgacatgccctatcttattgagagggctgaggttctcaagatagcggagtttccaatacttggccgaatcagaaatagtcgtgttcgtgtccgtgatacgaccttttcctcgagacaatatggtgtgcgtgaaagtaaggatgttactattgaaggaagagtgcaatttgatctcctgcaggctatgcaacgggattacaagctgagttcttattcattaaactctgtatcggcacacttccttggggaacaaaaagaagatgttcatcattcaattatatctgatcttcaaaatggaaacccagagacacgaaggcggctggcagtctattgcttgaaggatgcttatcttcctcaaagactgttggacaaattgttgtatatctacaattatgtggaaatggcgagggtcactggtgttcccatttcatttttactttcaaggggacaaagtattaaggtcctctcacaactactcaggaaagcaaaacagaaaaaccttgttataccaaatataaagggtcaagggtccgggcaagatacctttgagggtgcaactgttttggaggcaagggctggattttatgagaagcccattgcaactttggacttcgcttctttgtatccatccatcatgatggcatataacctctgctactgtactttggtgccccctgaggacgctcgtaaactcaacttacctccagaaagcatcaataaaaccccatctggtgaaatatttgtgaaaccagaactacagaagggtatacttcctgagatccttgaagaattattagcagctcggaaaagggcaaaagcagatttaaaggaagcgaaggacccactcgaaagggctgttcttgatggtcgtcagcttgcactgaaaataagtgcaaattcagtttatggtttcactggagcaactgttggtcagttaccttgcttagagatttcttcaagcgtgaccagctatggacgacagatgattgaacatacaaaaaagcttgttgaagataaattcacaacagtaggaggttatgagcataatgcagaggtaatttacggggacactgattctgtgatggtacagttcggtgtttctacggttgaagatgcaatgaagttaggaagagaagctgcagattatattagtggaacctttaccaagcccatcaaactggagtttgagaaggtctattttccttaccttctaatcagcaagaagagatatgctggtttgtactggacaaatcctgagaaatttgacaaaatggatgcaaaaggtattgaaactgtgagaagggacaactgtttactggtaaagaacctggttactgagtgtcttcataaaatactggtggaccgtgatgttcctggtgcagtccaatatgtcaagaacaccatatctgatctattaatgaatcgtgtcgacttgtctcttcttgtcataacaaagggtttgacaaaaacgggagaagattacgcggtaaaagctgctcatgtggagctggctgagaggatgcgaaagagagatccagctactgcacctactgttggtgaccgtgttccttatgttataattaaagcagcaaaaggggcaaaggcatatgagaaatcagaagatcctatttatgttttggacaataatatacccattgatcctcaatactaccttgagaaccaaatcagcaagccacttttgaggatctttgagccaattctgaagaatgccagcaaagagttgcttcatggaagccacaccagatctgtttcaatctcaactccttcaaatagcgggataatgaaatttgcaaagaaacaattaacttgccttgggtgcaaagctgttatcagtggtgccagtcagacactttgctcacattgcaagggaagagaagcagagttatactgcaaaacagtagcaaatgtttctgacctggagatgctctttgggaggctatggacgcaatgccaggagtgccaaggatctctgcaccaggacgttctctgcacaagtcgggattgtccgattttctatcggcgaaggaaggcacagaaggatatggcggaagctaggctgcagcttgaccggtgggacttctgagcttgtaaattctcacactggctgcctgcatctgctgtggatatattgctgcagagggcaggaagctaccgtcgaccgcagcatgatgcatgccaagatgagactggacttttgcaagcatccaggtacacttgagttcgggtcacctaggctggctcgccacttagccagtacgattcactggcatgtttgctgtttatatgttcttagttgtagtttaggtgtgagttggtagatggtaggaggtttgtgtctccttcatgtggctagtgccgagaaagaatgcttgctcctcaagtgaggtgatgctgacgtactaggcagaagaattctggagcagttcaccttataagatgtaaccgagtaagatgagacactttgaaggccacatgaattctccatcatgtgacaggtgtgactgtgtgagcatgaggttgtttaatcccgagcaattagcaagcttgaaccaggttcaatccttgggtggct

SEQ ID NO: 3847 - DNA, 4106 bp, Sorghum bicolor
gcttcttcatgcgtttgggcctggcatcggctcttgggccttccattctcgtggcccgttcagcagaagccgatggcgctctccttcccgccatcaggtgtttttcagaagtggaagtcctcagccgtgccttcttcttcagatagtcagtggacctgacacgcgcctcccactcccggtcccacccctgtcccccaatccggcgatgagctcaggcgggcgcggcggcaagcggcggggccccccgccccccgctccctccggggcggcggtgaagagggctaaccccagccccggcatgccgcagcctcctcctcccgcggcggcggcggcggaggaggacatgatggacgaagacgtgttcctggatgagtccatcctggcggaggacgaggcggcgctgctgatgctccagcgtgacgaggccctcgcgtcccgcctcgcgcggtggaagcgccccgcactccccgccgacctcgccgccgggtgctcccgcaccgtcgcttttcagcagttggaaatagattatgttattgatgagagccacaaagaattgctccccaactcatctggttcagcagccatactcaggatttttggtgttaccagagaaggtcacagcatatgctgtcaggtgcatggatttgagccatatttctatattggctgtccttcagggatgggtcctgatgatatatcacactttcaccaaacactagaggggaggatgaaggagtcaaatagaagcagcaatgttccaaggttcgtgaagagagttgaacttgtgcagaagcagacaattatgcattaccaaacgcagcaatctcagcctttcctcaagatagtagtcgctttgcctaccatggttgctagctgtcgtggtatcctggaaaggggaataatgattgaaggccttggctcaaagagtttcctgacatatgaaagcaacattctttttgcccttcgtttcatgattgattgcaatattgttggtggcaactggattgaacttcctgctgggaaatacaggaaagcagcccgtgtgatgtcctattgtcagctagagctagattgcctatactcagatctggtaagtcatgctgctgaaggagaatattctaagatggccccgtttcgcatattaagttttgatattgaatgtgctggtcgcaaaggtcatttcccagaaccaactcatgatcctgttattcagatagctaacttggttacacatcaaggagaaggtcaaccttttgtacagaatgtcatgactcttaaatcatgctctcccattgtgggagtcgatgttatgtcatttgatgcagagagagatattctacttgcatggaggaatttcatacgtgaagtggatcctgatatcataattggatacaatatttgcaaatttgacatgccctatcttattgagagggctgaggttctcaagatagcggagtttccaatacttggccgaatcagaaatagtcgtgttcgtgtccgtgatacgaccttttcctcgagacaatatggtgtgcgtgaaagtaaggatgttactattgaaggaagagtgcaatttgatctcctgcaggctatgcaacgggattacaagctgagttcttattcattaaactctgtatcggcacacttccttggggaacaaaaagaagatgttcatcattcaattatatctgatcttcaaaatggaaacccagagacacgaaggcggctggcagtctattgcttgaaggatgcttatcttcctcaaagactgttggacaaattgttgtatatctacaattatgtggaaatggcgagggtcactggtgttcccatttcatttttactttcaaggggacaaagtattaaggtcctctcacaactactcaggaaagcaaaacagaaaaaccttgttataccaaatataaagggtcaagggtccgggcaagatacctttgagggtgcaactgttttggaggcaagggctggattttatgagaagcccattgcaactttggacttcgcttctttgtatccatccatcatgatggcatataacctctgctactgtactttggtgccccctgaggacgctcgtaaactcaacttacctccagaaagcatcaataaaaccccatctggtgaaatatttgtgaaaccagaactacagaagggtatacttcctgagatccttgaagaattattagcagctcggaaaagggcaaaagcagatttaaaggaagcgaaggacccactcgaaagggctgttcttgatggtcgtcagcttgcactgaaaataagtgcaaattcagtttatggtttcactggagcaactgttggtcagttaccttgcttagagatttcttcaagcgtgaccagctatggacgacagatgattgaacatacaaaaaagcttgttgaagataaattcacaacagtaggaggttatgagcataatgcagaggtaatttacggggacactgattctgtgatggtacagttcggtgtttctacggttgaagatgcaatgaagttaggaagagaagctgcagattatattagtggaacctttaccaagcccatcaaactggagtttgagaaggtctattttccttaccttctaatcagcaagaagagatatgctggtttgtactggacaaatcctgagaaatttgacaaaatggatgcaaaaggtattgaaactgtgagaagggacaactgtttactggtaaagaacctggttactgagtgtcttcataaaatactggtggaccgtgatgttcctggtgcagtccaatatgtcaagaacaccatatctgatctattaatgaatcgtgtcgacttgtctcttcttgtcataacaaagggtttgacaaaaacgggagaagattacgcggtaaaagctgctcatgtggagctggctgagaggatgcgaaagagagatccagctactgcacctactgttggtgaccgtgttccttatgttataattaaagcagcaaaaggggcaaaggcatatgagaaatcagaagatcctatttatgttttggacaataatatacccattgatcctcaatactaccttgagaaccaaatcagcaagccacttttgaggatctttgagccaattctgaagaatgccagcaaagagttgcttcatggaagccacaccagatctgtttcaatctcaactccttcaaatagcgggataatgaaatttgcaaagaaacaattaacttgccttgggtgcaaagctgttatcagtggtgccagtcagacactttgctcacattgcaagggaagagaagcagagttatactgcaaaacagtagcaaatgtttctgacctggagatgctctttgggaggctatggacgcaatgccaggagtgccaaggatctctgcaccaggacgttctctgcacaagtcgggattgtccgattttctatcggcgaaggaaggcacagaaggatatggcggaagctaggctgcagcttgaccggtgggacttctgagcttgtaaattctcacactggctgcctgcatctgctgtggatatattgctgcagagggcaggaagctaccgtcgaccgcagcatgatgcatgccaagatgagactggacttttgcaagcatccaggtacacttgagttcgggtcacctaggctggctcgccacttagccagtacgattcactggcatgtttgctgtttatatgttcttagttgtagtttaggtgtgagttggtagatggtaggaggtttgtgtctccttcatgtggctagtgccgagaaagaatgcttgctcctcaagtgaggtgatgctgacgtactaggcagaagaattctggagcagttcaccttataagatgtaaccgagtaagatgagacactttgaaggccacatgaattctccatcatgtgacaggtgtgactgtgtgagcatgaggttgtttaatcccgagcaattagcaagcttgaaccaggttcaatccttgggtggctcacgcggttttgtttactcccaaaacctcctagggcgcttggtcacccaacgcacgttgttgtaatttgtaaactaaaactcctatcttaataggatgatccacaa

SEQ ID NO: 3848 - DNA, 3733 bp, Secale cereale
atgagctcagtcgggcgcggcggcaagcgacgggcggggcctcccgcagcgccatccccgctggcggcgaagcgggcccagcccatgccgcctggcgccccacaaccgcctccgccggctgccgcggcggcggaggaggaggatatgatggacgaggacgttttcctggacgagactatcctcgcggaggacgaggcggcgctgctgctgctcgaccgcgacgaggccctcgcctcccgtctttccaggtggaagcgccccgccctccccgccgacctcgtctccggttgctcccgctccgtcgcttttcagcagctggatatagattatgttattggtgagagccacaaagagtttctgcccaattcttctggtcctgcggctataatcaggatttttggtgtcacaagagaaggtcacagtgtgtgctgtcaagtgcatgggtttgaaccatatttctacattagctgcccgccaggaatgagccctgatgatatttcaggtttcaaacaaacactagaggcgaggatgaaggaatcaaataggaatagcagtgtgcaaagatttgtgaagagtgttgagcttctgcagaagcagacaattatgcattaccagccaattaaatctcagtccttcctcaagatagtagttgccctacctacaatggttgctagctgtcgtggcatccttgaaaggggcataacgattggcagtcttggttcaaagagtttcctgacatatgaaagcaacattctctttgcccttcgctttatgattgactgcaacattgttggtggcaattggattgaacttcctgctgggaagtatagcaaagcaactcgcgtcatgtcctattgccagctagagttggattgcctatattcagatttggtaagccatgctcctgaaggggagtactctaagatggccccctttcgcatattaagttttgacatcgaatgtgctggtcgcaaaggacacttcccagaaccaactcatgatccggttattcagattgctaatttactcacacttcaaggcgaatcccagccttttgtacggaatgtcatgactcttaaatcatgttctcccattgtcggagtggatgtaatgtcatttgacacagagcgagatattctacttgcttggagggatttaatacgtgaggcagatcctgatattataattggatacaatatctgcaaatttgatctgccatatcttattgagagagctgaagttctcaagatagtggagtttccgctacttggtcgaatcagaaatagccgtgtccgtgttcgtgataccaccttcaactcaaggcaatatggtatgcgtgaaagtaaagatgtaactgtggagggaagggtacagtttgatcttctgcaggctatgcaaagggattacaagctgagttcttattcattgaactctgtatctgcacattttctaggggagcaaaaagaggatgttcatcattcaatcatatctgatcttcaaaatggaaactcagagacccgaaggcgtcttgcagtttattgcttgaaggatgcttatcttccacaaagactgttagataaattgatgtacatctacaactacgtagagatggcgagggtcacaggagttcccatttcttttctgctctcgaggggacagagcattaaggtcctctcacagttactgaggaaagcaaaacagagaaaccttgttataccaaacataaagggccaaagttctgggcaagatacctttgagggtgcaactgttttggaggcaagggctggattttatgagaagcccattgcaactttggactttgcttctctgtatccatccatcatgatggcccataacctatgctactgcactttggtcccccctgaggatgtccgtaaactcaacttgcctgcagaaagcctctacaaaaccccgtctggtgaaatatttgtgaaaccagagttgcaaaagggtatacttcctgaaatccttgaagaactgttggctgctcgaaaaagagcaaaagcagatttgaaggaagcaaaggacccattcgaaagggcggttcttgatggtcgtcagcttgccctaaaaataagtgcaaattcagtttatggttttactggtgctactgttggtcaattgccctgtttagagatttcttcgagtgttacgagctacggtagacagatgattgagcacacaaagaagcttgttgaagataaattcacaacacttggaggctatgagcataatgcagaggtgatttatggagatactgattctgtgatggtacagtttggtgtttctacagtcgaggacgcaatgaaattggggagagaagctgcagagtatattagtggaacatttattaagcccatcaagctagagtttgagaaagtttactttccatacctactgatcagcaagaagagatatgctggtttgtactggacaaatcctgagaaatttgacaaaatggacacaaaaggtattgaaacagttcgaagggacaactgtttattggtaaagaacctggtgactgaatgccttcataaaatactagtggaccgagatgttcctggtgcagtccaatatgtcaagaataccatatctgatctattaatgaaccgtgtggacttgtcccttctggttataacaaagggtttgacaaaaacaggagaagactatgctgtaaaagctgcccatgtggagcttgctgagaggatgcggaagagggatgctgctactgcaccaactgttggcgaccgggttccttatgttataataaaagcagcaaaaggggcaaaggcatatgagaagtcagaagatccaatttacgttctggataataacattccaatagatcctcagtactaccttgagaaccaaattagcaaaccactgttgagaatattcgaaccaattctgaagaacgcgagcagagaactgcttcatggaagtcataccagagctgtttcaatctcaactccttcaaatagcgggataatgaaatttgcaaagaaacaactgacttgccttggatgcaaagcagttataagtggtcccaaccaaacactttgctcacattgcaagggaagggaagcagagttatactgcaaaacagtagcaaatgtttctgatctggagatgctcttcgggaagctatggacgcagtgccaggagtgccaaggctccctacaccaggacgttctgtgcaccagtcgggactgccctattttctaccggcggaggaaggcacagaaggacatggctgaagctagggtgcagcttgatcgttgggacttctgagtcctgtcaatgcttcgagaacttgcatttttctccctccgccaacttgtgagggtgttatcgtgaatggtgcgctgccgctaagatcacatgattgcatcatgatacatgatgggccagggctacggagggagatcggtagggtttgctctgagttcgaatggggtttgaggtaggcttgttgtatggttaagagattctctatggttaatgcgtgcgtctgcttagtttgtagccactatcaaccatgacagatggttgattgctgcctccctgattgtgccggactgctgatgcgtaagtagaagtagaaaaactatcttctaagttggtcaggattttatgtagcaatgtctatcggcatgtttttgtaatttgtcctgctcaattatatttgagaaaatattaaaaaatcatgtgt

SEQ ID NO: 3849 - DNA, 4011 bp, Gossypium raimondii
gggaatatccctcttctcctctcccaaacccccctccatttcccatcactctccctttctttactccaaaacgacaccaaatcatgaacaagggcggcaacccacggaagaggccaccaccgccttcttcacaccagccatctccggcttcgaagcaccaagcgacgactccgacgcctcccccaccgtcgacggaagaagatttcgtcgacgaagatgtcttctttgacgaaacccttatgggggaagaagacgtggaatccctaattctacgcgacttcgaggaacgtcaagctctcgcttctcgtctttccaagtgggctcgccctcctctctctgatgcctacatttcccagtctcgtagcattgttttccaacaattggagattgattatgtgattggagagagtcataaaggtttgctgcctgattcttctggtcaagctgccattatccgaattttcggggttactggagaaggacatagcgtttgttgtcttgttcatggatttgagccgtatttctacattagctgccctccaggaatgggtcccgatgatatctcacattttcatcaaacgcttgagggtaggatgaaggagatgaacagaaacagcaaggtaccgaagtttgttcgacgtattgaattggttcagaaaagaagtattatgtattaccagcaacaaaagtctcaaccttttctcaagattgtagtggcattgccaacaatggttgctacctgtcgtggcattcttgatagaggcatacaaattgatggccttggtatgaagagcttcattacatatgaaagcaatgttctttttgcactgcgtttcatgattgattgcaatattgttggtggtaattggattgagataccggctggtaaatataagaagacagcgaagaatatgtcctactgccaattggagtttgattgcttgtattcagatttgattagccatgcccctgagggggaattctcaaagatggctccatttcgcatattgagttttgatatagagtgtgctggtcgcaaaggtcattttccagagccttctcatgatcctgtaatccaggtagcaaatctagttactttgcaaggagaagatcagccattcattcgtaatgtcatgacccttaagtcatgctccccaatagttggtgttgatgtaatgtcttttgatacagaaaaagaagtcttgcttgcttggagggaatttatccgtgaagtggaccctgatattataattggatataacatttgcaagtttgatttgccatatcttattgagagagcacaaacacttggaatagcagagtttccgatacttggccgcatcaggaatagtagggttcgtgtaaaagatacaacattttcttctagacagtatggaactagggagagcaaagaagttactgtggaggggagagttcaatttgatttgctccaggctatgcaaagggactacaaactaagttcttattcattgaattcagtttcagcacactttctatctgagcagaaagaggatgttcaccattcaataatatcagatcttcagaatggaaatgctgagactaggaggcgtcttgctgtctattgtttgaaggatgcttaccttccccaaaggcttttggataaactaatgtatgtttacaattatgttgagatggctcgtgtcacaggtgtgcctatatcttttcttctttctagaggacaaagcatcaaggtactttctcaacttcttaggaagtcgaagcagaagaaccttgttattccaaatgtcaaacaagcaggatctgaacagggaacgtttgaaggtgcaactgtgttggaagcgaaagcaggattctatgaaaagccaattgcaacactggattttgcgtctttgtatccatcaattatgatggcatataatttatgctattgcacattggtgactcctgaagatgttcgcaaactcaacctcccaccagaatgtgttaacagaactccgtctggtgaaacatttgttaaaccagagctacagaaggggatacttccagaaatattggaagagctattagctgctcgtaaacgagcaaaagctgatttgaaggaagcaaaggatccacttgagaaagctgttctagatggccgacagctggccttgaaggtaagtgcaaattctgtatatggatttacaggagctactgttggtcagttaccatgtttagagatttcttcgagtgttacaagctatggtcgccaaatgattgagcacaccaagaagcttgttgaagataaatttacagtgctaggaggctatgaacacaatgctgaggttatatatggggacacagattcggtgatggtacaatttggtgtgtctgatgtagaagcagcaatgaacttggggagagaagctgcagaacacatcagtggaacttttacaaaacccatcaagctagagtttgagaaggtttattatccctatcttttgattagcaagaaaagatatgctggtttattttggacaaatccacaaaagtttgacaaaatggacactaaaggcatcgaaactgttcgaagagacaattgtttattggtcaaaaaccttgtaactgaatgcctgcacaaaatactgattgatagagatattcctggtgcagttcaatatgtcaagaataccatttcagatcttctcatgaatcggatggatttgtcacttttggttattactaagggtctgacaaaaactggagatgattatgaggtaaaagctgctcatgttgaacttgctgaacgtatgcgcaagcgagatcctgcgactgctccaaatgttggggatcgggtgccttatgtcattattaaagctgcaaaaggcgccaaggcttatgagaggtcagaggacccaatctatgtgctagaaaataacatccccatagatcctcaatattaccttgaaaatcaaattagcaagccacttttaagaatttttgagcccattttaaagaatgctagcaaggaacttctccatgggagtcacacaagatccatttccatatcaactccgtcaaacagtggaataatgaaatttgcaaagaaacaacttagttgtattggctgcaaagcgctaatttgcaattcagatcgaacactctgttcacactgcaagggaagagaggcagaactttattataaaacagtttctcaagtgtcagaactagaggagctttttgggaggctatggacacagtgccaagagtgtcaaggctctcttcaccaggatgtgctctgcactagtcgggattgtccaatattttaccggagaaagaaagcacagaaagatatggtagaagccaagcggcagttggaccggtggaacttttaagtctataacaggttgttttcagctgctcaataaacgcatcttcccgttaatgagcatttcacaggctgtgtatggatcccctggtatctcaacaattgagtcaagaaaacctctagagtgtttctatcccaaagtttaaagttaaagattagaaaccaggcggagcttctcttttttgaaataaagaaagttgaaaatctggacataaagctttatcagttaagattcttcagttttcctttaaagcttctgttcctcaatgtctttacaaattgcaggttttggcttgtgcaatgctgagcgatgtcagcatgttctgaggtctattttcaattttgctgtatcacggtttgcagtggtccatgtaatgctaatgtgctattatctataatcttttccgtatttcagtgcacaaaatctctactttgtatcattacatgcattaagttggtgggtaggcgatgctgcaacgtgttgtattccctttacctaatatgatacatatatattcaccttgtttttactagatttgataatttgtatgtatgtctagtcacatcataaattattaaatatgtcaacatcttaaaaatgaatactatgtttatttatatataaaaaaaggtagttacct

SEQ ID NO: 3850 - DNA, 3566 bp, Eucalyptus grandis
atgagcgcttccaccaggaaacgccctcccccggcggcgcacccttccccggcggcccacccgccgaagcaccaggccaccgcgccgccgccgccgcagcagccggccccgaggccgcccctcgaggaggaattcctcgacgaggacgtctacctcgacgaaaccctaatccccggcgacgacgaccacgacgaggagtacctcatcctccgcgacatcgaggagcgccagggcctcgcctcgcgcctctccaagtgggcccgccctcccctctccgacggctacctgtcgcagtcgaagaacgtcgtttatcagcaattggagatcgattacgtgatcggggagagccacagggaactcttgcctgatcgttccgggcctgccgcgattattcgtattttcggggtcacgagggaagggcatagtgtttgctgcaatgttcatgggttcgagccgtacttctacattagttgtcctccgggaatgggcccagatgatatttcccgttttcatcaagttctcgagggaaggatgagagatgcaaacaggaatagcaaagtgcctaagtatgttagacgtatagaaatggtgcagaaaagaagtattatgtattatcagcagcaaacttctcatccttttctcaagatcgtggttgcattgccaacaatggtgaccacatgccgtggcattcttgacagaggtattcagattgatgggttgggtatgaagagcttcatgacatacgaaagcaacatcctttttgcacttcgttttatgattgaccgcaatgttgttggaggcaattggattgaagtacctgctggaaagtaccgaaggacagccaaaaagttgtcttattgccagttggagttcgattgcttgtactctgaactcattagccattccctggaaggtgaattctctaagatggctcctttccgtattttgagttttgacattgagtgtgctggtcgaaaaggtcattttccagagcctaaccatgatcctgtcatccaggtggccaatctagtcaccttgcagggagagagccagccgtttgtgcgaaatgtgatgaccctgaagtcatgctctcctatagttggtgttgatgtcatgtcatttgacacggaaagagaagtcctgctagcttggagggatttaatcagggaagtcgaccccgatattataatagggtataacatctgcaagtttgatctgccatatcttattgagagagctgaagctttgggcattcctgaatttcctatattgggccgtgtgaggaatagcagggtccgtgtcagagatacaactttttcctcaaggcagcatggaacaagggaaagtaaagaagtcaccattgaagggagggttcaatttgacttgttccaggctgtgcaacgagattataaactaagttcttattcgttgaactctgtttcggcacacttcctttctgagcagaaagaggatgttcaccattcaattatatcagatcttcaaaatggcaatgcggaaacgaggaggcggcttgctgtatattgtttgaaggatgcttatctcccacagcggttgctggataaactgatgttcatttacaattatgtggagatggcaagggtcactggcgttcctatatcttttcttctttcccgggggcagagcattaaggttctttcccaacttcttaggaaggcaaaacagaagaaccttgttatcccaaatatgaaacaggcaggatccgagcaaggaacatatgagggtgctacagttctggaggccaaggcaggtttctatgaaaagccaattgcgacgttggattttgcttctctgtatccatcaataatgatggcctataatttgtgctattgcacactggttactcctgaggatgttcgtaagctcaacctcccaccagagtgtgttaatagaactccgtctggtgaaacatttgtcaaatcgagtctgcaaaagggaatcttgccagagatccttgaagaactactggctgctcgtaaaagagcaaaggcagacctgaaggaggcaaaggatccacttgaaagagccgtgcttgatggtcggcagctggctttgaagattagtgcaaattctgtatatgggtttactggagctactattggccagttaccctgccttgagatatcttcaagtgtcacaagctatggtcggcagatgattgagcacacaaaaaagcttgttgaggataaatttactgtgcttggagggtatgaacacaatgcggagattatttatggtgacacagattcagtaatggtgcaatttggtgtacctacagtggaagaagcaatgaaattgggaagagaagccgctgattacattagtggaactttcatcaagcccatcaaactagagtttgagaaggtctactatccatatttgttgatcagcaagaagagatatgctggcctttattggacaagtccagagaaatttgacaaaatggatacaaaaggcatcgaaactgtcagaagagacaattgcttactggtgaaaaacctggtaactgagtgtcttcataaaatacttattgacagagacattcccaaggcagtgcagtatgtcaagagcactatttcagaccttctcatgaatcgagtggatttgtcccttttagttattacaaagggtttgacaaagtcaggagatgattatgatgtaaaggcagctcatgttgagctggctgaacgcatgcgcaagcgagatgctgccactgctccaactgttggtgatagagtaccttatgtcatcatcaaagctgcaaaaggtgccaaggcttatgaaaaatctgaggatcccatctatgtgctagaaaacaacatcccaattgaccctcaatactatctagaaaatcaaattagcaagccgcttcttagaatcttcgaaccaatcttgaagaatgctagcaaggaacttcttcagggaagtcatacgagatctatttccatctctactccttcaaacagtgggatcatgaaatttgccaagaagcaactaacttgcattggttgcaaagctttgataagcaatacaaacggaactctttgttcacactgcaagggaagggaagctgaattgtattgtaaatcagtatctcaagtctccgagcttgaggagatttttggaaagctttggacacagtgccaagaatgccagggttcgcttcatcaggatgttctttgtacaagtcgggattgtcccatattttaccggaggaagaaggcacagaaagacatggctgaagccaagcggcaattagatagatggaacttctaaatatcgacaggctttgtaatctgtggtggtggacgagaggggatgcatctgtcttcactttgttattagtatggcttcttttgcccaatcttattttgtctttaatatggatggtgaatttgacaacacaggtaatcccatcttaaagatggtaagtgcatgtgtcacgagatgatattttaaatcactacccggcacttagaccacgagtttcttgtatggcctaagtcacccttattagctttcactcc

SEQ ID NO: 3851 - DNA, 3574 bp, Eucalyptus grandis
tcgccgccatgagcgcttccaccaggaaacgccctcccccggcggcgcacccttccccggcggcccacccgccgaagcaccaggccaccgcgccgccgccgccgcagcagccggccccgaggccgcccctcgaggaggaattcctcgacgaggacgtctacctcgacgaaaccctaatccccggcgacgacgaccacgacgaggagtacctcatcctccgcgacatcgaggagcgccagggcctcgcctcgcgcctctccaagtgggcccgccctcccctctccgacggctacctgtcgcagtcgaagaacgtcgtttatcagcaattggagatcgattacgtgatcggggagagccacagggaactcttgcctgatcgttccgggcctgccgcgattattcgtattttcggggtcacgagggaagggcatagtgtttgctgcaatgttcatgggttcgagccgtacttctacattagttgtcctccgggaatgggcccagatgatatttcccgttttcatcaagttctcgagggaaggatgagagatgcaaacaggaatagcaaagtgcctaagtatgttagacgtatagaaatggtgcagaaaagaagtattatgtattatcagcagcaaacttctcatccttttctcaagatcgtggttgcattgccaacaatggtgaccacatgccgtggcattcttgacagaggtattcagattgatgggttgggtatgaagagcttcatgacatacgaaagcaacatcctttttgcacttcgttttatgattgaccgcaatgttgttggaggcaattggattgaagtacctgctggaaagtaccgaaggacagccaaaaagttgtcttattgccagttggagttcgattgcttgtactctgaactcattagccattccctggaaggtgaattctctaagatggctcctttccgtattttgagttttgacattgagtgtgctggtcgaaaaggtcattttccagagcctaaccatgatcctgtcatccaggtggccaatctagtcaccttgcagggagagagccagccgtttgtgcgaaatgtgatgaccctgaagtcatgctctcctatagttggtgttgatgtcatgtcatttgacacggaaagagaagtcctgctagcttggagggatttaatcagggaagtcgaccccgatattataatagggtataacatctgcaagtttgatctgccatatcttattgagagagctgaagctttgggcattcctgaatttcctatattgggccgtgtgaggaatagcagggtccgtgtcagagatacaactttttcctcaaggcagcatggaacaagggaaagtaaagaagtcaccattgaagggagggttcaatttgacttgttccaggctgtgcaacgagattataaactaagttcttattcgttgaactctgtttcggcacacttcctttctgagcagaaagaggatgttcaccattcaattatatcagatcttcaaaatggcaatgcggaaacgaggaggcggcttgctgtatattgtttgaaggatgcttatctcccacagcggttgctggataaactgatgttcatttacaattatgtggagatggcaagggtcactggcgttcctatatcttttcttctttcccgggggcagagcattaaggttctttcccaacttcttaggaaggcaaaacagaagaaccttgttatcccaaatatgaaacaggcaggatccgagcaaggaacatatgagggtgctacagttctggaggccaaggcaggtttctatgaaaagccaattgcgacgttggattttgcttctctgtatccatcaataatgatggcctataatttgtgctattgcacactggttactcctgaggatgttcgtaagctcaacctcccaccagagtgtgttaatagaactccgtctggtgaaacatttgtcaaatcgagtctgcaaaagggaatcttgccagagatccttgaagaactactggctgctcgtaaaagagcaaaggcagacctgaaggaggcaaaggatccacttgaaagagccgtgcttgatggtcggcagctggctttgaagattagtgcaaattctgtatatgggtttactggagctactattggccagttaccctgccttgagatatcttcaagtgtcacaagctatggtcggcagatgattgagcacacaaaaaagcttgttgaggataaatttactgtgcttggagggtatgaacacaatgcggagattatttatggtgacacagattcagtaatggtgcaatttggtgtacctacagtggaagaagcaatgaaattgggaagagaagccgctgattacattagtggaactttcatcaagcccatcaaactagagtttgagaaggtctactatccatatttgttgatcagcaagaagagatatgctggcctttattggacaagtccagagaaatttgacaaaatggatacaaaaggcatcgaaactgtcagaagagacaattgcttactggtgaaaaacctggtaactgagtgtcttcataaaatacttattgacagagacattcccaaggcagtgcagtatgtcaagagcactatttcagaccttctcatgaatcgagtggatttgtcccttttagttattacaaagggtttgacaaagtcaggagatgattatgatgtaaaggcagctcatgttgagctggctgaacgcatgcgcaagcgagatgctgccactgctccaactgttggtgatagagtaccttatgtcatcatcaaagctgcaaaaggtgccaaggcttatgaaaaatctgaggatcccatctatgtgctagaaaacaacatcccaattgaccctcaatactatctagaaaatcaaattagcaagccgcttcttagaatcttcgaaccaatcttgaagaatgctagcaaggaacttcttcagggaagtcatacgagatctatttccatctctactccttcaaacagtgggatcatgaaatttgccaagaagcaactaacttgcattggttgcaaagctttgataagcaatacaaacggaactctttgttcacactgcaagggaagggaagctgaattgtattgtaaatcagtatctcaagtctccgagcttgaggagatttttggaaagctttggacacagtgccaagaatgccagggttcgcttcatcaggatgttctttgtacaagtcgggattgtcccatattttaccggaggaagaaggcacagaaagacatggctgaagccaagcggcaattagatagatggaacttctaaatatcgacaggctttgtaatctgtggtggtggacgagaggggatgcatctgtcttcactttgttattagtatggcttcttttgcccaatcttattttgtctttaatatggatggtgaatttgacaacacaggtaatcccatcttaaagatggtaagtgcatgtgtcacgagatgatattttaaatcactacccggcacttagaccacgagtttcttgtatggcctaagtcacccttattagctttcactcc

SEQ ID NO: 3852 - DNA, 3857 bp, Cajanus cajan
ctccactccctccctctcccaattccgatgaagaaaaacggctcccggaagcgcgcgccgccgccgtcgcaacccccgccggcgaagcatccctcgatgactcaggaagaagagttcatggacgaagacgtgttcctggacgaaaccctcctttccgccgacgaagagtccctcattctccgcgacatcgagcagcgccaggccctcgccacgcgcctctccaagtggacgcgtcctcctctcgacgccgactacgtcgtccaatctcgcagcgtcgttttccagcagctggagattgattacgtgatcggagagagtcacaaggagttgctgccgaactcgtctggacctgctgccgttatcagaatatttggagttactaaggaaggacacagtgtttgctgcaatgttcatgggtttgagccatatttctatgtctgttgcccacctggaatgggtccagatgatatctcccgttttcatcaaactcttgagggaaggatgagagaagccaatagaaacagtaatgtgggaaaatttgttcgccgcattgaaatggtgcagagaaggagtattatgtactatcaacaatccaattcccaaccctttctcaaaattgtagttgcacttccaacaatggttgccagctgtcgtggcatacttgacaggggtattcagcttgatggtctgggaatgaagagcttcttgacttatgaaagcaatgtactttttgcccttcgcttcatgattgattgtaacatagttggtggaaattggattgaagttccagctggaaaatataataagacagcaagaagcttgtcttactgccagttagagtttgattgcttgtattccgaattgattagtcatcctccagaaggggaatattcaaagatggctccattccgcatattgagttttgacattgagtgtgctggtcgtaaaggtcattttcctgagcctactcacgatcctgttatccagattgctaatttggttactttacaaggagaggaccagccattaattcgtaatgtgatgacccttaaatcatgttctcctatcgttggtgttgatgtgatgtcatttgatacagaaagagaagtcctgctagcttggagggattttattcgtgaagtggatccagatattattattggatataacatctgcaaatttgacttaccatatcttattgagagagctgcgaatctgaagatagcagaatttccaattctgggccgtatcaggaacagtagagttcgagtaaaggatacaactttctcgtcaaggcagtatgggaccagggaaagtaaagaagttactgtagaagggagagttcagtttgatttactccaggttatgcaaagagactacaaattaagttcttattcattgaattctgtgtcagcccacttcctttctgagcagaaagaggacgttcatcattcaattatatctgatcttcagaatggaaatgcagaaactcggaggcgccttgctgtgtattgtttgaaggatgcatatctccctcagcggcttttggataaattgatgttcatttacaattatgtggagatggctcgagtaacaggtgtcccaatttcttttctactttccaggggccaaagcattaaggttctttctcaacttcttaggaaggcaagacagaagaatcttgtccttcctaatgtcaaacaggctgggtctgaacaaggaacatttgaaggtgccactgtattggaggcaagggcgggattttatgaaaaacctattgctactttagattttgcatccttgtatccatctattatgatggcctataatttatgttattgcactctggtgactccagaagatgctcgcaagcttaacatccctccagagtctgtgaacagaactccatctggggaaacatttgttaaatcaaatttgcagaagggaatacttcctgaaattcttgaagagctattaacagcccggaaaagggcaaaagcagacttgaaggaggcaaaagatccccttgagaaggcagtgctagatggtagacagctggccctgaaaattagtgcaaattccgtgtatgggtttacaggggctaccattggtcagttaccatgtctagagatatcatcaagtgtaacaagctatggtcgacaaatgattgagcacacaaaaaaactcgtggaagataaatttacaacacttaatggctatgaacacaacgctgaggtaatatatggagacacagattcagtcatggtacaatttggtgtgtctgccgtagaagaggcaatgaacttggggagagaagctgctgaatatattagtggaactttcacaaaacccatcaaactagaatttgagaaggtttactatccatatctcttgatcagcaagaagagatatgctggtttgttttggacaaaaccagacaactttgacaaaatggacactaaaggtattgaaacagttcgaagagacaattgtttattggtcaaaaacctggtgaacgattgccttcacaaaatactgatcgacagagacattcctggggcagttcagtatgtcaagactgcaatttcagatcttctcatgaatcgcatggatttatcacttctggtcattacaaagggtttaacgaagacaggagatgattatgaagtaaaggcagctcatgttgaacttgctgaaaggatgcgcaagcgagatgctgccactgctccaaatgttggagatagagtaccttatgttattgttaaagctgcaaaaggtgcaaaggcatatgagagatcagaggatcctatctatgtgctagagaacaacataccaatagatccccaatactatcttgagaatcaaattagcaagccaattctgagaatttttgagccaattctgaagaatgctagcaaggaacttctccatggaagccatacaagatctatttctatttctaccccgtcaaacagtggcatattgaaatttgctaagaaacagcttacgtgcattggttgtaaagctttacttagcaatggtcatcacactctctgttcacattgcaaaggaagggaagctgagctgtactgtaaaacagtagctcaagtgtctgatctggagatgctttttgggaggttgtggacacagtgtcaggagtgccaaggttcacttcatcaggatgttctctgcacaagtcgggattgtccaattttctaccgacggaaaaaggcacagaaagatatggccgaagcaaggtcgcaattggaccgatggaacttctaagattttgttaaggtatcgttaaatttgctagttttgggaaggagaacctctaggacaagctcttgtgaccgtatttctaccactggaggagatacatgtagccaagagcctagcttttggttcagttcatgtgcagaatttgcgttgcggatctcggaagccaatggacgctccgcaatcctgacatttataagtgagagtaaacccagaatttgctaatcgaaagattcgtgtggaatcctcgaatgagaatttagttatcggatgacatcagcagtaactactggactattttgatgttcacaaaaatatagttcgatgcaaagcagtcttttcatgtcagtgagatgagatttgtagatgcttccctagagagtaagagggtgttctaaaacaattagtcgagtgagtttttatcatatcatagtaattgacatttgcctcatgttccgataatgttttggtgcgtgattaatataacagtttcaaccaacacaagtcagattgctagtttattttgtatataaatataacaagacactttgtggaaggcagtgtttttgcgtaaataa

SEQ ID NO: 3853 - DNA, 3285 bp, Citrullus lanatus
cactctctgccaaaaaaaagagcaatgaacaacggcagcgctcggaaaagtcgaccaccgccgcagcatccatcgccggctccgccgaccaagcaccaggcgctttctcaagaggaagatttcgtcgacgaagatgtcttcctcgacgagaatcttctcgatgaggacgctctcatcctccgcgacatggaggagcgtcaggcccttgcttcccgactctccaagtgggctcgtccacctctttcccaggaatacttgtcccagtcgaagagcatcgtgtttcagcaattggaaattgattacgtgatcggggaaagtcacagagaactgttgccgaatttgtctggccctgccgctattcttagaatttttggggttacgagggaagggcatagtgtatgctgccacgttcatggatttgaaccatacttctatatcagttgtcctccaggcatgggtcctgatgatatctctctttttcaccgaactcttgaggctagaatgaaggaggtaaataggaacagcaaagcacctaactttgtgcgtcgcattgaattggtgcaaaagagaagtattatgtactaccagcagcagacttctcaaccatttcttaaaattgtagttgcactgccaacaatggtcaccagctgccgtggtattcttgatagaggcgtacaaattgatggctttggtatgaaaagcttcatgacatatgaaagcaatgtgctttttgccctacgttttatgattgactgcaatgttgttggtggaaactggattgaggttcctgtgggaaaatataagaaaactgttagaaatttatcatattgccaattggagtttgattgcctatattcagacttgattagccatgccccagaaggggaattttctaaaatggctccatttcggatcttgagttttgatattgagtgtgcagggcgtaaaggccattttccggagccgacccaggatcctgtgattcaggtggcaaacctagttactttgcagggagagaaccaaccatttattcgcaatgtcatgacccttaactcttgctctcctatcgcgggcgttgatgtcttatcatttgatacagaacgtgaagtattgctggcttggagggatctaattcgtgaagcagaccctgatataataattggatataacatttgcaaattcgatttgccatatctaatcgagagagctgaggcactgaaaataccagaatttcccatattgggtcgcatcaggaacagcaaagttcgtgtcaaagatacaactttttcttcaagacagcttggaacaagggagagtaaagaaataacggtggaaggaagagttcaatttgatttacttcaggctatgcaacgggattataaattaagttcgtactcgctgaattctgtctcttcacatttcctttctgaacagaaagaggatgtccaccattcaataatatcggatcttcaaaatggtaatgcagaaacacggagacggcttgctgtttattgtttaaaggatgcgtatcttccacaacggcttttagataaactgatgttcatttacaattatgtggagatggctcgagtaactggtgttcctatttcttttcttctttcgagagggcaaagcatcaaggtactctctcaactccttaggaaggcaaaacagaaaaacctcgttattccaaatgctaaacatgcaggatctgatcaaggaacctatgagggtgctactgttttggaagcgagggctgggttctatgaaaagcccattgctacgctggattttgcatctctatatccatccatcatgatggcatataatttatgttattgcactctggttactccagaagatgctcgcaagctaaacctgccccctgaacatttcaacaaaaccccatctggtgagatatttgtcaagccagagttgcagaaggggatacttcctgaaatattagaagaactattgactgctcggaaaagagcaaaggcagatttgaaggaagcgaaggatccttttgagaaggctgtgttggatggtcgacagctagctctgaagataagtgcaaattctgtgtatgggtttacaggagctactgttggtcagttgccatgtatagagatatcatcaagtgttacaagctatggtcgacaaatgattgaacacacaaagaagcttgtggaagataaatttacaacgcttgggggatatgagcacaatgctgaggtaatctatggtgacacagattctgttatggtacaatttggtgttcccagtgtagaagcagcaatgatcttgggaagggaagcagctgactatatcagtggtactttcataaaacctatcaagttagagtttgagaaggtatattatccatatctgttgattagtaagaagagatacgctggtttattttggactaatccaaataagtttgacaagatggataccaaaggcattgaaacagttcgaagagataattgcttattggtgaaaaaccttgtaaatgagtgcttgcacaaaattcttatcgatagagatgtccctggggcagttcaatatgtgaagaacacaatttcagatctgcttatgaaccgtgtggatttatcactcttggttattaccaagggactaacaaaaactggagatgattatgaagtgaaggcagctcatgttgaacttgctgagcgcatgcgtaagcgagatgctgccacagctccaaatgttggcgatcgggtaccttatgtgatcattaaagcagccaaaggcgccaaggcatatgagaggtcagaggatcccatttatgttctagagaatagcataccaatagatcctcagtactatcttgagaatcagattagcaagcctcttctacgaattttcgagcccatcttgaaaaacgctagcaaggaacttctacatggaagtcacacgagatcaatttttatttctactccatcaaacggtggcataatgaaatttgctaagaaacagctaacctgcattggctgcaaggctctactaagcaaggcagacaaaactctctgctcacactgcaaaggaagagaagcggaactttactgcaaagcagttgcaaatgtgtctgatttggagatggtttttgggaggctttggacacagtgccaagaatgccaagggtctcttcaccaagatgtcctctgtacgagtcgagactgtccaatattttatcgtagaaagaaggcacaaaaagacatggctgaagctaaacagcatttggaacgttggagtttctag

SEQ ID NO: 3854 - DNA, 3743 bp, Glycine max
atgagcaacaacgcctcccggaagcgcgcgccgccgcctccgtcccaacctccgccggcgaagcaagccctaatgactcaggaagaagagttcatggacgaagacgtgttcataaacgaaaccctcgtctccgaggacgaagaatccctcattctccgcgacattgagcagcgccaggccctcgccaaccgcctctccaagtggacacgtcctcctctctccgccggctacgtcgcccaatctcgtagcgtcctttttcagcagctagagattgattacgtgattgcagagagtcacagggagttgctgccgaactcgtctggacctgtcgccattatcagaatatttggagttactaaggaaggacacagtgtttgttgcaatgttcatgggtttgaaccatatttctacatctgttgccctcctggaatgggtccagatgatatctcccattttcatcaaactctcgagggaaggatgagagaagccaatagaaacagtaatgtgggaaaattcgttcgccgtattgaaatggtgcagagaaggagtattatgtactatcagcaatccaattcccaaccctttctcaaaattgtagttgcactcccaacaatggttgccagctgccgtggtattcttgataggggtattcaacttgatggtctgggaatgaagagcttcttgacttatgaaagcaatgtactttttgcccttcgcttcatgattgattgtaacatagttggtggaaattggattgagattcctgccggaaaatataagaaaacagcgaaaagcttgtcttactgccagttagagtttgattgcttgtattctgaattgattagtcatgctccagaaggggaatattcaaagatggctccgtttcgcattttgagttttgacatcgagtgtgctggtcgtaaaggtcattttcctgagcctacccatgatcctgttatccagattgctaatttggttactttacaaggagaagaccagccatttattcgtaatgtgatgacccttaaatcatgttctcctatcgttggtgttgatgtgatgccatttgaaacagaaagagaagtcctgctggcttggagggattttattcgtgaagtggaccctgatattattattggatacaacatttgcaaatttgacttgccatatcttattgagagagctttgaacctgaagatagcagaatttccaattctgggtcgtatcaggaacagtagagttcgagtaaaggatacaactttctcatcaaggcagtacggaaccagggaaagtaaagaagttgcagtagaagggagagttcagtttgatttactccaggttatgcaaagagactacaaattaagttcttattcactgaattctgtgtcatcacacttcctttctgagcagaaagaggatgttcatcattcaattatatccgatcttcagaatggaaatgcagaaactaggaggcgccttgctgtgtattgtttgaaggatgcatatctccctcagcggcttttggataaattgatgttcatttacaattatgtggagatggctcgagtaacaggtgtcccaatttcttttctactttccagaggccaaagcattaaggtactttctcaacttcttaggaaggcaaggcagaagaatctggtcattcctaatgccaaacaggctgggtctgaacaaggaacatttgaaggtgccactgtattggaggcaagggctggattttatgaaaaaccaattgctactttagattttgcatccttgtatccatctattatgatggcctataacttatgttattgcactctggtgatccctgaagatgctcgcaagctcaacatacctccagagtctgtgaacagaactccatctggtgaaacatttgttaaatcaaatttgcagaagggaatacttcctgaaatacttgaagagctattaacagcccgtaaaagggcaaaagcagacttaaaggaggccaaggatcccctggagaaggcagtgctagatggtagacagctagccctgaagattagtgccaattctgtgtatgggtttacaggggctaccattggtcagttaccatgtttagagatatcatcgagtgtaacaagctatggtcgacaaatgatcgagcacacgaaaaaaattgtggaagacaaatttacgacagttaatggctatgaacacaatgccgaggtaatatatggagacacagattcagtcatggtacaatttggtgtttctgctgtagaagaagctatgaacttggggagagaagctgctgaatatattagtggaactttcacaaaacccatcaaactagaatttgagaaggtttactatccatatctcttgattagcaagaagagatatgctggattgttttggacaaaaccagacaactttgacaaaatggacactaaaggtattgaaacagttcgaagagacaattgtttattggtaaaaaacctggtgaacgattgccttcacaaaatattgattgacagggacattcctggggcagtccagtatgtcaagaatgcaatttcagatcttctcatgaatcgtatggacttatcacttctagttattacaaagggtttaacgaagacaggagatgattatgaagtaaaggcagctcatgttgaacttgctgaaaggatgcgcaagagagatgctgccactgctccaaatgttggagatagagtaccatatgttattattaaagctgcaaaaggtgctaaggcatacgagaaatcagaggatcctatctatgttctagagaacaacataccaatagatcctcagtactatcttgagaatcaaattagcaagccaattatgagaatttttgagccaattctgaagaatgctagcaaagaacttctccatggaagtcatacaagatctatttctatttctactccggcaaacagtggcatattgaaatttgctaagaaacagcttacctgcattggttgtaaagctttacttggcaatggtcatcacactctctgttcacattgcaaaggaagggaggctgagctttactgtaaaacagtatctcaagtgtctgagctggagatgctttttgggaggttgtggacacagtgtcaggagtgccaaggttcacttcatcaggatgttctctgcacaagtcgggattgtccaattttttaccgacgaaaaaaggcacagaaagatatggctgaagcaaaattgcaattggaccgatggaacttctaagttttgccaaggtcattttttttctcaaattttcttccccctttagtctttgatcttcataatgatttagtcaatgcatgacctgtaggaatttgataggcaccaaactctcaatggacctttggagcctctagctcatgagatgaagaaaggctcaagggaattgttagtgtattcccgtagaaagaaatgaggggtagaaaaggaataagctagggggcagtttgttagaggagagagtgggagagaatcaggggcagtttgttagaggagagagagggagagaatcaggggcaatttccttttcgttatttagtatccgtatggatagctttggaggattgattctgtcttttctgttttcttgggatagagagaacgaacctacggggtgctctatttaggagcttagctttgggacaagggagaccttctcctttgtaattttctgattttcagtataatacagaattctaactttt

SEQ ID NO: 3855 - DNA, 3751 bp, Citrus clementina
aatccctccaatttcagtgcttcactcgtcagacagtcagtccaagccaacaaatgaaccgcagcaacggcagcgcaagaaaacggccaccgccgacgccgaaagaatcttggccaaataaacagcaagcaaccacaccgacaacaccggttatcgacgacgaattcctcgatgaggacgtgttcctcgacgaaaccctactgccggaggatgaagaatcccttattctccgcgacatcgagcagcgtcaggacttcgcttctcgtctggccaagtgggcccgccctcccctatcgtctggctacgtgtcccaatgtcagagcatcatgtttcagcaattggatattgattacgtaattggagatagtaacagagaattgttgcctctttcttctgggtctgctgccatcattcgaatttttggagttacaagggaaggacatagtgtttgttgcaaggttcatgggtttgagccttatttctacattagttgccctcagggaatgggcccagatgacatttcccattttcatcaaattcttgaggggaggatgagagaggctaataggaatagtaaggttccccaatttgttcgacatatcgaaatggtgcagaaaagaagtattatgtattatcagcagcaaaagtctcaaccttttctaaagattgttgttgcattgccaacaatggtagctagttgtcgtggaatcctggatagaggcatacaacttgatggattgggtatgaagagcttcatgacatatgaaagcaatgttctttttgctcttcgtttcatgatagattgcaacatcgttggtggcaattggattgaagtgccggttggaaaatacaggaagacagcgaagactttgtcctattgccagttggaatttgattgcctgtattcagatataattagccatcatcctgaaggtgaattttcaaaaatggctccatttcgcatattgagttttgatattgaatgtgcgggtcgtaaagggcattttccagagcctacccatgatcctgttatacaggtggcaaatctagttactttgcaaggagaaaagcaaccatttattcgtaatgtcatgaccctcaaatcatgtgctccaatcgttggtgtagatgtgatgtcttttgaaacagaaagggacgtcttgctagcttggagggattttatccgtgaagtggaccctgatgttatgattggatataatatctgcaagtttgatttgccctatcttattgagagatctcaaactttgggaatagcagaatttcctatactgggtcgtatcagaaacagcagggttcgagtcaaagatacaactttttcttcaagacaattaggaacgcgggaaagtaaagaagttactgtggaagggagagttcaatttgatttgcttcaggtaatgcaacgggattataaattaagttcttattctttgaactctgtttctgcgcactttctttcggagcagaaagaggatgtccaccattcaattatatctgaccttcagaatggaaatgcagaaactaggaggcgacttgctgtatattgtttgaaggatgcttatctcccacagaggcttttggacaaattgatgttcatttttaactatgttgagatggctcgtgtcactggagttcctatctctttccttctttcgagagggcagagcatcaaggtgctttctcaacttcttaggaaggctaagcagaagaatcttgtaattccaaatgtgaaacaggctggatctgaacaaggaacatatgaaggggcaactgttttggaggccagggcggggttctatgagaagcctattgcaacattggattttgcttctttgtatccatcgattatgatggcgtataatttgtgttacagcactctggtgacgcctgaagatgctcgcaaactcaatcttcctcctgaatgtgtgaacaaaactccatcgggtgaaacatttgttaaatcaaatttgcagaagggaatacttcctgaaattcttgaagaactattagctgcccgtaaaagagcaaaagcagatttgaaggaagcaaaggatcctcttgagaaggctgttctagatggccgacagcttgcattgaagataagtgcaaattctgtatatggatttacgggagctactgtgggtcagttaccctgtatagagatttcttccagcgttacaagctatggccgtcaaatgattgagcacactaaaaagcttgtggaagacaaatttacaacggttgggggctatgaacacaatgcagaggttatatatggggacacggattctgttatggtacaatttggtgtacctactgtagaagcagcaatgaagctggggagggaagctgctgattatattagtggaactttcatcaaacccatcaaactagagttcgagaaggtttactatccgtatctgttgatcagcaagaagagatatgctggtttgtattggacaaaccctgaaaagtttgacaaaatggatacgaaaggcatagaaacagtacgaagagacaattgtttattggttaaaaaccttgtaactgagtgtcttcacaaattattggttgacagagacatccctggggctgttcagtatgtcaagagtaccatttcagatcttctcatgaaccgcatggatttgtcacttttggtgattactaagggtctgacaaagacaggagatgattatgaagtaaaagcagctcatgttgaacttgctgagcgcatgcgcaagcgggatgctgccactgctccaaatgttggggatcgagtaccttatgtcattataaaagctgctaaaggtgccaaggcttatgagaggtcagaggatcctatttatgtgctagaaaataatataccaatagacactcattattatcttgagaaccagatcagcaagcctcttttaagaatctttgagcccattttgaagaatgctagcaaggaacttctcagtggagatcacacaagatcaatttccatctctactccttcaaacagtggcataatgaaattcgccaagagacaactaagttgcattggttgcaaggccctgattagcaatggaactctctgctcacactgcaagggaagagaagctgaactgtattgcaaaactgtttctcaagtacaagagctagaggtgctttttggtaggctgtggacacagtgccaagagtgccagggttctcttcatcaggatgtgctctgcactagtcgggattgtccaatattctatcggaggaaaaaggctcaaaaggacatggctgaagctaaactgcaactagaccggtggaacttctaagattctttgaagggagatgaaacttatccaaatatttgaagttcaaagatcggttcccttcaagctcttacctttctgctttttgctggcatgtatttgcgctttgcttcataaatatttgaccagtgaagcagccctttcagcaaccgtttttgcgacaaggtggactgagttggaaaaccttataattggctagattttgacgaaagatcaaaagaagaatgatgcttaaatttggcaggctctaagttagtaggggtgcgatgattactttcgaatataattgttttataatgcatgctgtaactaaatgatcatctaagtgtttatcaatattaggggttcctatatcctgagttgtgtaaaaattacttttgtatagaaactggatcgtgattttccagcattaaacctctgttatc

SEQ ID NO: 3856 - DNA, 3629 bp, Glycine max
ctccgcctttctctccctcccaattccaatgagcaacaacgcctcccggaagcgcgcggcgccgccgtcgcaacctccaccggcgaagcaagccgtaatgactcaggaagaagagttcatggacgaagacgtgttcttaaacgaaaccctcgtttccgaggacgaagaatccctcattctccgcgacatcgagcagcgccaggccctcgccaaccgcctctccaagtggacccgtcctcctctctccgccgactacgtcgccggaactcgtagcgtcctttatcagcagctggagattgattacgtgattggagagagtcacagggagttgctgccgaactcatctggacctgccgccattatcagaatatttggagttactaaggaaggacacagtgtttgttgcaatgttcatgggtttgaaccatatttctacatttgttgccctcctggaatgggtccagatgatatctcccattttcatcaaactcttgagggaaggatgagagaagccaatagaaacagtaatgtgggaaaattcattcgccgtattgaaatggtgcagagaaggagtattatgtactatcagcaatccaattcccaaccctttctcaaagttgtagttgcactcccaacaatggttgccagctgccgtggtattctggataggggtattcaacttgatggtttaggaatgaagagcttcttgacttatgaaagcaatgtactttttgcccttcgcttcatgattgattgcaacatagttggtggaaattggattgaaattccagctggaaaatataagaaaacagtgaaaagcttgtcttactgccagttagagtttgattgcttgtattccgaattggttagtcatgctccagaaggggaatattcaaagatggctccatttcgcatattgagttttgacattgagtgtgctggtcgtaaaggtcattttcctgagcctacccaagatcctgtaatccagattgctaatttggttactttacaaggagaagaccagccatttattcgtaatgtgatgacccttaaatcatgttctcctatcgttggtgttgatgtgatgtcatttgaaacagaaagagaagtcctgctagcttggagggatttaattcgtgaagtggacccggatattattattggatacaacatctgcaaatttgacttgccatatcttattgagagagctgcgaacctgaagatagcagaatttccaattctgggtcgtatcaggaacagtagagttcgagtaaaggatacaactttctcatcaaggcagtacgggaccagggaaagtaaagaagttacagtagaagggagagttcagtttgatttactccaggttatgcaaagagactacaaattaagttcttattcactgaattctgtgtcatcacacttcctttctgagcagaaagaggatgttcatcattcaattatatccgatcttcagaatggaaacgcagaaactaggaggcgccttgctgtgtattgtttgaaggatgcatatctccctcagcggcttttggataaattgatgttcatttacaattatgtggagatggctcgagtaacaggtgtcccaatttcttttctactttccagaggccaaagcattaaagtactttctcaacttcttaggaaggcaagacagaggaatctggtcattcctaatgccaaacaggctgggtctgaacaaggaacatttgaaggtgccactgtattggaggcaagggctggattttatgaaaaaccaattgctactttagattttgcatccttgtatccatctattatgatggcctataatttatgttattgcactctggtgacccctgaagatgctcgcaagctcaacatccctccagagtctgtgaacagaactccatcgggtgaaacatttgttaaatcaaatttgcagaagggaatacttcctgaaatacttgaagagctattaacagcccgtaaaagggcaaaagcagacttaaaggaggcaaaggatcccctggagaaggcagtgctagatggtagacagctggccctgaagattagtgcaaattctgtttatgggtttacaggggccaccattggtcagttaccatgtttagagatatcatcgagtgtaacaagctatggtcgacaaatgattgagcacacgaaaaaacttgtggaagataaatttacgacacttaatggctatgaacacaatgccgaggtaatatatggagacacagattcagtcatggtacaatttggtgtttctgctgtagaagaggctatgaacttggggagagaagctgctgaacatattagtggaactttcacaaaacccatcaaactagaatttgagaaggtttactatccatatctcctgattagcaagaagagatatgctggtttgttttggacaaaaccagacaactttgacaaaatggacactaaaggtattgaaacagttcgaagagacaattgtttattggtcaaaaacctggtgaacgattgccttcacaaaatattgattgacagggacattcctggggcagtccagtatgtcaagaatgcaatttcagatcttctcatgaatcgtatggacttatcacttctggttattacaaagggtttaacgaagacaggagatgattacgaagtaaaggcagctcatgttgaacttgctgaaaggatgcgcaagcgagatgctgccactgctccaaatgttggagacagagtaccatatgttattattaaagctgcaaaaggtgcaaaggcatatgagagatcagaggatcctatctatgtgctagagaacaacatacccatagatcctcattactatcttgagaatcaaattagcaagccaattctgagaatttttgagccaattctgaagaatgctagcaaagagcttctccatggaagtcatacaagatctatttctatttctacaccgtcaaacagtggcatattgagatttgctaagaaacagcttacctgcattggttgtaaagctttacttggcaagggttatcacactctctgttcacattgcaaaggaagggaggctgagctgtactgtaaaacagtatctcaagtgtctgagctggagatgctttttgggaggttgtggacacagtgtcaggagtgccaaggttcacttcatcaggatgttctctgcaccagtcgggattgtccaattttctatcgacgaaaaaaggcacagaaagatatgggtgaagcaaagttgcaattggacagatggaacttctaagttttgccaagaatttgaccttgcggatctcttcgaaaccaatggacacaaatacaatctggtgtttgccacaatcctgacatttgtaatgtgagtaaaagcccacaatttgtttactgaaagatttgtgtggaatcctcaaatgatagtttttaagttatcggatgacatcaacctggttccaagcagtaactgctgaattattttgatatttaaaaaattatcattcgaggatttagtcagttgatgcaaagcagtcttttgatatggaaatgagggtatactgtaacgtaaggatatgtcaacgggatgagttatagatgtgaggcggtgtctgttacaa

SEQ ID NO: 3857 - DNA, 3296 bp, Prunus persica
cacaaagccatgaacaaaggcataagcagaaaacggccagcgccaacacaacagccgtcaccagcgaacccacccaagcagcacgccacgtcccaagaagatgaatttctggacgaggacgtcttcctggacgaaacccttttcgagactgaagacgacctcattcttcgcgacattgaagagcgccagtcccttgcttcccgcctcaccaaatgggcccgcccgtctatctcccatgcctacagttccgcctcccgaagcatcgcttttcagcaattggagattgattatgttgttggagatagcaatagagaattgttgcctaattggtccgggtccgctgcaattatccgaatttttggggttacaaaggaaggacatagtgtttgctgccatgttcatggattcgagccatatttctatatcagctgtcctccgggaatgggccctgacgatatttccaggtttcatcaaattcttgaggggagaatgggggagatgaatcggaacagtaaggtaccaaaattcattcgccatattgaaatggtgcagaagaggagtatcatgtattaccagcagcaggattctcatcccttcctcaaaattgttgttgctttgccaacaatggtggccagctgccggggtattcttgatagaggcatacaaattgatggtcttggtatgaagagcttcatgacatatgaaagcaatgttctttttgctcttcgtttcatgattgattgcaacatagttggtggaaattggattgaggtccctgctggaagatataagacagcgaagcattcatcgtactgccaattagaattcgattgcctattttcagacttgatcagccatgctccagaaggggaattttcgaagatggctccatttcgcatattgagctttgacattgagtgtgctggccgtaaaggtcattttcctgagcctacccatgatcctgtaatccagattgcaaacctagtgactttgcaaggagagaatcagccatttatccgtaatgtcatgactctcaagtcatgctctcctatagttggtgttgatgtgatgtcttttgatacagaaagagaagtcttgctggcttggagggatttaatccgtgaggtggacccagatgtcataattggatataacatctgtaaatttgatttgccatatctcattgagagagctgagactttgggaatagctgagtttccaatgcttggccgcataaaaaacagcagggttcgggtcaaagatactactttttcttcaaggcagtatggaaccagggaaagtaaagaagtaacagttgaagggagggttcaatttgatttattccaggctatgcaacgagattacaaattaagttcttattcattgaattctgtctcggcacactttctttctgagcagaaagaggatgtccaccattcaataatatctgatcttcagaacggcaatgcagaaactaggaggcgacttgctgtgtattgtctaaaggatgcttacctcccacagaggcttttggacaaactgatgtatatttacaattatgtagagatggctcgagtgacaggtgttcccatatcgtttcttctatccagagggcagagcatcaaggtgctttctcagcttcttaggaaggcaaaacagaagaaccttcttattccaaatgtcaaacaggctggatctgagcaagggacatacgaaggtgccactgttttggaagcaaaagcaggattctatgaaaagccaattgccactttggattttgcatctttatatccatcaatcatgatggcctataatttatgctattgcactttggtgacaactgaggatgctcgcaaactcaacatccctccagaatttgtcaacaaaactccatctggagaaacatttgttaaatccaatttgcagaagggaatacttcctgaaattcttgaagaactactagctgctcgtaagagagcaaaggcagatttaaaggaagcaaaagatccacttgagaaggcagtgcttgatggtcgacaactggccttaaaaataagtgcaaattctgtatatgggtttactggagctactgttggtcagttaccatgcatagagatatcatcaagtgtcacgagctatggtcgacagatgattgagcacacaaaaaatcttgtaaaagaaaaatttaccatacttaaaggctacgaacacaatgctgaggttatatacggggacacagactcagttatggtgcaattcggtgtgtccaccgttgaagcagcaatgaacctggggagagaagctgctgaatacatcagtggaactttcataaaacctatcaagctcgagtttgagaaggtttattatccatatcttctgattagcaagaagagatatgctggtttattgtggacaagtccagataagttcgacaagatggatactaaaggtattgaaacagtacgaagagacaattgcttgttggtcaaaaacctggtaaatgagtgcctgcacaaaatactgattgacagagatattcctggggcagtccagtatgtcaagaatacaatctcagatcttcttatgaatcgcatggatttatcgcttttggttatcactaagggtttgacaaaaactggggatgattatgaagtaaaggcagctcatgttgaacttgctgaacgtatgcgtaagcgagatgctgccactgctccaaatgttggggatcgagtaccttatgtcattattaaagctgcaaaaggtgccaaggcatatgagaagtcagaggaccccatctatgtgctcgagaataacatacccatagaccctcaatactaccttgaaaatcaaattagcaagccacttttaagaatttttgagcccattttgaagaatgctagcaaggaacttcttcatggaagtcacacaagatctatctcaatatctactccctcaaacagtggaataatgaaatttgcaaagaaacaactcacttgtgttggctgcaaagctctaattagcaacgcggatcgaactctttgctcacactgtaagggaagagaagctgagctctattgcaaaacagtggctcatgtgtctgagctagaaacactttttgggcggttatggacacagtgccaagagtgccaaggctctcttcatcaagatgtgctctgcacaagtcgggattgccctatattttataggagaaagaaagcacagaaagacatggctgaagccaaagtgcaattagaccgatggagcttctgacattcgccggacagttagttcttatt

SEQ ID NO: 3858 - DNA, 3366 bp, Cicer arietinum
cacggaagcgtgcggcggcggcaccggcaccgccgcaacaaccaccgacgaaacaggcactgtctcaggaagacgagtttctcgacgaagacgtgttcctggacgaaaccctcatttcggaagacgaagagtccgcaattctccgtgacatcgagcaacgccaggccctagctactcgtctctcaaagtggactcgtcctccactctcccaggactatatctcccaatctcgtagcattctttttcagcagctagagattgattatgtgattggagagagtcataaagaattgctaccgaactcgtctggacctgctgccataattagaatatttggagtaaccaaggaaggacacagtgtttgctgcaaggttcatggttttgaaccatatttttacatcagctgccctcctggaatgggaccagatgatatctctcattttcatcaaatcctcgaggcaaggatgagagaagccaatagaaacagtaatgtaggaaaatttgttcgtcgtattgaaatggtgcagagaaggagcatcatgtattatcagcaaataaattcccatccctttctcaaaattgtggttgcactcccaacaatggttgctagctgtcgtggtattcttgatagaggtattcagcttgatggtcttggcatgaaaaacttcatgacttatgaaagcaatgtactttttgctcttcgtttcatgattgattgcaacatagttggcggaaattggattgaaattcctgctggaaaatataagaagacaacaaaaagcttgtcttactgccagttagagtttgattgcttgtattccgacttgattagtcatgcaccagaaggggaatattcaaagatggctccatttcgcattttgagttttgacattgagtgtgctggtcgaaaaggtcattttcctgagcctacccatgatcctgttatccagattgctaatctagtaactttacaaggagaaggccagccattaattcgcaacgtgatgacccttaaatcatgttcccctattgttggtgttgatgtaatgtcatttgatacagaaagagaagtcctgcttgcttggagggatttcatccgtgaagtagaccctgatattattattggatataacatctgcaaatttgatttgccgtatcttattgagagagctgcggcccttaaaatagcagaatttccaattttgggccgtatcagaaacagtagagttcgagtaaaagatacaactttttcatcaaggcagtatgggaccagggaaagtaaagaagttacagtagaaggaagagttcagtttgatttgctccaggttatgcaaagagactacaagctaagttcctattcattgaattctgtgtcagcacactttctttctgagcagaaagaggatgttcatcattcaattatatctgatcttcagaatggaaatgcagaaactagaaggcgccttgctgtctattgcttgaaggatgcatatctcccccagcggcttttggataaattgatgttcgtttacaattatgtggagatggctcgagtaacaggtgtcccgatttcctttctactttccaggggccaaagcatcaaggtgctttctcaacttcttaggaaggcaaaacaaaaaatctagtcattcctaatgccaagcaggcagggtcagaacaaggaacatttgaaggtgccactgtattggaggctaaggctggattttatgaaaagccaattgctactttagattttgcatccttgtatccgtctattatgatggcatataatctatgttattgtacactggtgacccctgaaaatgctcgtaagctcaacatccctccggagtcagtgaacagaactccatctggtgaaacatttgttaaaccaaatttacagaagggcatacttcctgaaattcttgaagagctattagcagctcgtaaaagggcaaaagcagacttaaaggaggcaaaggatccccttgagaaagccgttctagatggcaggcagttggccctaaagattagtgcaaattctgtgtatgggtttacaggggcaactattggtcaattaccttgcttagagatatcatcaagtgtaactagctatggtcgacaaatgatcgagcacactaaaaagcttgtggaagataaatttacaacgcttaatggctaccaacacactgctgaggtaatatatggagacacagattcagtcatggtacaatttggtgtttctgctgtagaagaggctatgagtttggggagagaagctgctgaatatatcagtggaactttcacaaaacctatcaaactagagttcgagaagatttactatccatatctcctgattagcaagaagagatatgctggtttgttttggacaaaaccggacaattttgacaaaatggacactaaaggtattgaaacagttcgaagagacaattgcttgttggtcaaaaacttggtaaacgactgtcttcacaaaatactgattgacagggacattcctggggcagtccagtatgtcaagaatgcaatttcagatcttctcatgaaccggatggatttatcactcctggttattacgaagggtttgacaaagacaggagatgattatgaagtaaagacagctcatgttgaacttgctgaaaggatgcgtaagcgagatgctgctactgctccaaatgttggagacagagtaccttatgttattattaaagctgccaaaggtgccaaggcttatgagaaatcagaggatcctatctatgtgctcgagaacaacataccgatagatcctcagtactatcttgagaatcaaattagcaagccaattctaagaatttttgagccaattctgaagaatgctagcaaggaacttctccacggaagccacacacgatctatttctatttctactccgtcaaacagcggtataatgagatttgcccagaaacagtatacttgtattggttgcaaagctttacttagcaaaggagatcgcactctttgtgcacattgcaaaggaagggaagccgaattgtactgtaaaacagtggctcaagtttcggacctagagatactttttgggaggttgtggacacagtgtcaggagtgccaaggttcacttcatcaggatgttctctgcacaagtcgggattgcccaattttttatcgacgcaaaaaggcacagaaagatatggctgaagcaaggttgcaattggacagatggaacttctaacttctaaggctttttctaggcatatttaaattcagagttgtggcagctaaaggaaaatatctggagatggaatcctacagtgtgttcatgttgaccgaatttgtcttcccttcatgtag

SEQ ID NO: 3859 - DNA, 3806 bp, Theobroma cacao
acaaaatccctccattttcactctctctctctctctctctctctctctctatgcagaacgacaccgaatcatgaacaacggcggcaactcaaggaagcgaccaccgccgccgtcgcaacgccaaccatttccggcaacgaagcaccaagtgacatcgccagcgcctcccccactgccgacggaagaagatttcgtcgatgaagatgtcttccttgaggaaaccctcatgggggaagaagacgttgaatccttaatcctccgggacgttgaggaacgtcaagctctcgcttctcgtctttccaagtgggcccgccctcctctctctggtgcctacacttcccagtcttgtagcatcgttttccagcaattggagattgattatgtgattggagagagtaacaaagatttgctgcctgattcttctggtcccgctgccattatccgaatttttggggttacaagagaaggacacagtgtttgttgtcttgttcatggatttgagccttatttctacattagctgccctccaggaatgggccctgatgatatatctcgttttcaacaaacccttgaggggaggatgaaggagttgaacagaaatagtaaggtaccaaagtttgttcgacgagttgaattggttcagaaaaggagcattatgtattaccagcgacaaaagtctcaaccttttctcaagattgttgtggcattgccaacgatggttactagttgtcgcggcattcttgatagaggtatacaaattgatggccttggtatgaagagcttcatgacatatgagagcaatgttctttttgcacttcgtttcatgattgattgcaacatcgttggtggtaattggattgaaataccggctggcaaatataagaagaccgcaaagaacttgacctactgccagttggagtttgattgcttgtattcggagttgattagtcatgccccagagggggatttctcaaagatggctccatttcgcatattgagttttgacattgagtgtgctggtcgcaaaggtcattttcccgagcctactcatgatcctgttatccaggtggcaaatctagttactttgcaaggaaaagatcaaccattcatccgaaatgtcatgacccttaagtcatgctctccaatagttggtgttgatgtcatgtcttttgatacagaaaaagaagtcttgcttgcttggagggaatttattcgtgaagtagaccctgatattataattggatacaacatttgcaagtttgatttaccatatcttattgagagagcacagacattgggaatagcagaatttcctatacttggccgcatcaggaatagtagggttcgtgtaaaagatacaacgttttcttcaagacagtatggaactagggagagcaaagaagttaccgtggaagggagagttcagtttgatttgcttcaggttatgcagcgtgactacaaactaagttcttattcactgaattcagtttcagcacactttctttctgaacagaaggaggatgtccaccattcaataatatcagatcttcagaatgggaatgctgagactaggaggcgtcttgctgtgtattgtttgaaggatgcttaccttccccagaggctcttggataaactcatgtttatttacaattatgtggagatggctcgtgtcacaggtgtccctctctcttttcttctttctagagggcaaagcatcaaggtactttctcaacttcttaggaagtctaagcagaaaaaccttgttattccaaatgtgttggaagcaaaggcagggttctatgaaaagccaattgcaacactggatttcgcatctttgtatccatcaattatgatggcatataatttatgttattgcacactggtaacacctgaagatgttcgcaaattcaacctcccaccagaatgtgttaacaaaactccatctggtgaaacatttgttaaaccaaatctgcagaaggggatacttccagaaatcttggaagagctattaggtgctcgtaaacgagcaaaagcagatttaaaggaagcaaaggatccactagagaaagctgttttagatggtcgacagctggccttgaagataagtgcaaattctgtatatggatttacaggagctactgtcggtcagttaccatgtttagagatttcttcaagtgttacaagctatggtcgacaaatgattgagcacaccaaaaaacttgttgaagataaattcacagtgctaggaggctatgaacacaatgctgaagttatatatggggacacagattcagtgatggtacaatttggtgtgcctgatgtagaagcagcaatgaacttggggagagaagctgcagaatacatcagtggaaccttcacaaaacccatcaaactagagttcgagaaggtttattatccctatcttttgatcagcaagaaaagatatgctggtttattttggacaaatccacaaaagtttgacaaaatggacactaaaggcattgaaactgttcgaagagacaattgtttattggtcaaaaaccttgtaaatgaatgccttcacaaattattgatcgatagagacattcctggtgcagttcaatatgtcaagaatactatttcagatcttctcatgaatcgaatggatttatcacttttggttattactaagggtcttacaaaaactggagatgattatgaggtaaaagccgctcatgttgaacttgctgaacgcatgcgcaagcgagatgctgctactgctccaaatgttggtgatcgggtgccatatgtcattataaaagctgcaaaaggcgccaaggcttatgagaggtcagaggacccaatctatgtgctagaaaataacatccccatcgatcctcaatactatcttgaaaatcaaattagcaagcctcttttaagaatttttgagcccattttgaagaatgccagcaaggaacttctccatggaagtcacacaagatccatttccatctcaactccttcaaacagtggaataatgagatttgcaaagaaacaacttagttgcattggctgcaaggcactaattaggtatctaacattacaccatattgagttttccctcagcaatacagatcgaacactctgttctcactgcaagggaagagaggcagaactttactataaaacagtttctcaagtgtcagagctagaggagctttttgggaggctatggacacagtgccaagagtgccaaggctctcttcaccaggatgtgctctgcactagtcgggattgtccaatattctaccggagaaagaaagcacagaaagatatggtagaagccaagcggcagttggacagatggaacttttaagactcttcaaggttgttttcagttgtccagtaaatgcattttcctcaatcaatgagcatttcatgacctgcgaatagataagcaggatatcccaaacaatctagtcatgaaaaaaggtgaagctagagtgatctatcctgaactttgatgcaaaggattaggagcaggaggagctttcttttttggaagttgatggagatggaactctagatagatcatcctttgtaatatcttaaatttgtccttgtaccgcttcatcgaagtgtgaaatttgcactagctttaccacttatgcagtcacacattagcttttacaattttgcaagtggactgtggttgacggctgtatatgttgaaaagttcctttgaagcttatgttcctctaggtttcgatacttgcaggctttgacttgtaaaatgttgagcaatgtaagaaatttcaaagtttcat

SEQ ID NO: 3860 - DNA, 3362 bp, Cucumis sativus
caatgaacaacggcaacgctcggaaaagtcgaccgcccccgcaccacccatccccggccccaccgccaaagcaccaggcactttctcaagaggaagatttcgtcgacgaagatgtcttcctcgacgagagtcttctcgatgaggacgctcttatcctccgcgacattgaggagcgtcaggcccttgcttcccggatttcgaaatgggctcgtccacctctttcccaggattatctgtcacagtcgaagagcatcgtgttccagcaattggaaattgattacgtgatcggggaaagtcacaaggaactgttgccgaatttgtctggcccagccgctattcttagaatttttggggttacgagggaaggacatagtgtatgctgccatgttcatggatttgaaccatacttctatatcagttgtccttcaggcatgggtcctgatgatatctctctttttcaccgaactcttgaggctagaatgaaggaggtaaataggaacaataaagcacctaactttgtacgtcgcattgagttggtgcaaaggagaagtattatgtattaccagcagcagacttttcaatcgtttcttaaaattgtagttgcactcccaacaatggtcaccagctgccgtggtattcttgatagaggcatacaaattgagggctttggtatgaaaagcttcatgacgtatgaaagcaacgtgctttttgccctccgttttatgattgactgcaatgttgttggtggaaactggattgaggttcctgttggaaaatataagaaaactgttagaagtttatcatattgccaattggagttcgattgcttatattcagacttgatcagccatgccccagaaggggaattttctaaaatggctccatttcggatattgagttttgatattgagtgtgcagggcgtaaaggccattttcctgagcctacccaggatcctgtgattcaggtggcaaacctagttactttgcagggagaggatcaaccttttgttcggaatgtcatgacccttaacacttgctctcctatcgcgggtgttgacgtcttatcatttgatacagagcgtgatgtattgctggcttggagggatctaattcgtgaagtagaccctgatataataattggatacaacatctgcaaattcgatttgccatatctaatcgagagagctgaggcactaaaaataccagaatttccattattgggtcgcatcaggaacagcaaagtccgtgtcaaagatacaactttttcttcaagacagcttggaacaagggagagtaaagaaataacggtggaagggagagttcaatttgatttacttcaggttatgcaacgagattataaattaagttcatattcgttgaattctgtctcttcacatttcctttctgaacagaaagaggatgtccaccattcaataatatcggatcttcaaaatggtaatgcagaaacaaggagacgtcttgctgtgtattgtttaaaggatgcgtatcttccacagcggcttttagataaactgatgttcatttacaattatgtggagatggctcgagtaactggtgttcctatttcttttcttctttcaagagggcaaagcatcaaggtactctctcaactccttaggaaggcaaaacagaaaaaccttgttattccaaatgctaaacatgcaggatctgatcaaggaacctatgagggtgctactgttttggaagcaagggctgggttctatgaaaagcccattgctacactggattttgcctctctatatccatccatcatgatggcatataatttatgttattgcactctggtgactccagaagacgcttgcaagctaaacctgccccctgaacatttcaacaaaaccccatctggtgagatatttgtcaagccaaatttacagaaggggatacttcctgaaatattggaagaactattgacggcacggaaaagagcaaaggcagatttgaaggaagcgaaggacccttttgagaaggctgtgttggatggtcgacagctagcgctgaagataagtgcaaattctgtgtatgggtttacaggagccaccgttggtcagttgccttgtttagaaatatcatcaagtgtgacaagctatggtcggcaaatgattgaacacacaaagaagcttgtggaagataaatttacaacgcttgggggatataagcacaatgctgagatcatcgataatttgattcttctattgcatcaatccatatttcatcgattatcttatagaattcagtattttatggttttaggtaatctatggtgatacagattccgttatggtacaatttggtgtgcccagtgtagaagcagcaatggtcttggggagggaagcagccgactatatcagtggtactttcataaaacctatcaagttagagtttgagaaggtatattatccatatctgttgattagtaagaagagatatgctggtttattttggactaatccaaacaagtttgacaagatggataccaaaggcattgaaacagttcgaagagataattgcttattggtgaaaaaccttgtaaatgagtgcttgcacaaaattcttattgatagagatgttcctggggcagtccaatatgtgaagaacacaatttcagatcttcttatgaaccgtgtggatttatcactcttagttatcaccaagggactaacaaaaactggagatgattatgaagtgaaggcagctcatgttgaacttgctgagcgcatgcgtaagcgagatgctgccactgctccaaatgttggtgatcgagtaccttatgttatcgttaaagcagcaaaaggtgccaaggcatatgagaggtcagaggatcccatttatgttctagagaatagcataccgatagaccctcagtattatcttgagaatcagatcagcaagcctcttctacgaatttttgagcccatcttgaaaaacgccagcaaggaacttctacatggaagtcacacaagatcaatttttatctctactccgtcaaacagtggtataatgaaatttgctaagaaacagcttacctgcattggctgcaaggctctactaggcaagtcagacaaaactctctgctcacactgcaaaggaagagaagcggaactgtactgcaaagcggttgcaaatgtgtctgatttggagatggtttttgggaggctttggacacagtgccaagaatgccaagggtctcttcaccaagatgtcctctgtacgagtcgagactgtcctatattttatagaagaaagaaggcacaaaaagacatggctgaagctaaagagcaactggaacgttggaatttttaatatcattgaaaggattt

SEQ ID NO: 3861 - DNA, 3749 bp, Solanum lycopersicum
gcacacagctaaaactccctaaaccctcttctcccaactccggcgaaccaccatgaactccggcaactctaagaagcgatcggcggcagcaacgccgtcgcctcaacagcagcagaaacaccacgcagccatggaagaagaggacctagacgaggatgtatttctcgaagagacattgcttcagtacgaagaagattcacaggtccttcgtgagctcgaagagagcaattccataaaggagaggcttcagaagtggaaacgtccttctctatctcaagcttacatcgctcagacacaaagcatatcgtttcagcagctggaaatcgactacattattgcagagagccataaagaattgctacctaattcttctggtcaggctgccattttaagaatcttcggggtcacaaaggaaggaaatagcgtctgttgtcatgtacatggatttgaaccatacttctatatcagctgccctcctggaatgggccctgacgatatctcccgttttcaccaaattcttgagggtaggatgagagaggcgaataggaacagcaatgcccctaagtttgtccgtcgcattgaagtagttcagaaaagaagcatcatgtattaccaacagcaggcttctcagccttttctcaagattgtagtggcattgccaacaatggttaccagttgccgtggtattctcgatagaggtattcaaattgacgggcttggtatgaagagctttcttacctatgaaagtaatgttctttttgctcttcgcttcatgattgactgcaatattgttggtggcaactggattgaagttccagttgggaaatacaagaaagctgcaagaaatctctcctattgtcaattagagtttgattgtctctattctgacttgataagccattctcctgaaggagaattttcgaagatggctccatttcgcatattgagtttcgatattgaatgtgctggtcgtaaaggccactttccggagcctacacaagatcctgttattcaagtggccaatctggttaccttgcagggacaggatcagccattaattcggaatgtgatgacccttaagtcatgctcaccgatagttggggttgatattatgtcctttgacacagaaaaagaagtattgcgggcttggagggaccttatccgggaggtggaccctgatataataattggatataacatctgcaactttgatttgccatatctcatccggagagctgaagtcttagggatggcagaatttcctgtgcttggacgcatcagaaacagcagggttcgtgtaaaggatgcaaccttttcttcaagacagcatgggacaagggaaagtaaagaaataacaatagaagggagagttcaatttgatttatttcaggctgtgcagagggattataagctaagttcttactcactaaattctgtctcagcacattttctgaatgagcagaaagaggatgtccatcattcaattatatcagatcttcaaaatggcaatgcagaaacgaggcgccggcttgctgtatattgtctaaaggatgcttatctcccacaacggcttttggacaaattaatgttcatttataactatgtggagatggctcgagtcactggtgtacctatatcttttcttctctcaagagggcaaagcattaaggtgctttctcaacttttaaggaaggcgaagcaaaaggatcttgtcataccaaatgcaaaacaggttggatctgaacaaggaacatttgagggggctacggttttggaggcacaggctggtttctatgagaagccaattgcaacattggattttgcatctctatatccatcaatcatgatggcatataatttatgttactgcacgctagtaactcctgaagaggttcgcaaactgaaccttcctccagagtgtgtcaacaagaccccttctggtgaaacgtttgtcaagtcaaccttacagaagggaatacttccggaaattcttgaagaactattgactgctcgtaaaagagcaaaagcagatttaaaggaagccacagaccctcgagtcaaagctgtcttagatggccgtcagctagctttgaagatcagtgcaaattcagtatatgggtttactggagctactgttggtcaattaccatgtctagaaatatcttcaagtgttactagctatggtcgacagatgattgagcacacaaaaaagcttgtggaagacaagtttacagtacttgggggctatgaacacaacgctgaggttatatatggagatacagattctgtgatggtgcagtttggtgtgcctacagtggaagaggctatgaaattgggcagagaagctgctgattacattagcgggacatttatcaaaccaataaaactagaatttgagaagatttattacccatatttgctgattagcaagaagagatatgctggccttctttggacaaatccggacaaacatgacaaaatggatgctaaagggattgaaactgttcgaagggataattgtctcttagtcaagaaccttgtaaccgagtgtctttataaaatactagtagacagagatgttcctggtgctgttcagtacgtcaagaatactatttcagatcttcttctgaaccgcatggatctgtctcttttagttattactaagggtctgacaaaaactggagatgattatgaagtaaaggcagcacatgttgaacttgcagagcgaatgcgcaagcgagatgctgctacagcacctagcattggtgatagagtaccttatgtaatcattaaagctgcaaaaggggccaaggcatatgaaaagtcagaagaccctatatacgtgttagagaacaacatacctatagatcctcaatactatcttgaaaatcaaattagtaagccacttctgaggatttttgagccaatactgaagaatgcaagtaaagagcttcttcacggagatcacacaagatccatctcagttccaaccccttcaaacagtggtattatgagatttgccaagaagcaactcacttgcattggatgcaaaacaccactcagtggctctgatcgaacaatctgcaagcactgcaaaggaagagaggccgaactttattgcagatccgtggctaatgtggctgaactagagaatctatttgggaagctatggacacaatgccaagaatgccaaggctctctccatcaggatgtcctatgcactagtcgagactgcccaatcttttatcggaggaagaaggctcagaaagacatggctgaagctaaaactcaattagatcggtggaacttttaaatttcaatgcctgaagtcttcattgctgcaagtccaaccttccattttgccaagtatcgtaattctcttaactctggtgtggaagcagcataaaagtttgggaattaactgaataactgaaactactatgatgaggtagcacaagtgccttagagaagatgtcgcgattgttcatgagcttcctcaaatccaagaaccattaatatacacgaaacttgtctgcctcgatgagttttaacttccaatcgtttgctagatgaaattcggacaatcttttgtaccttctagctagttgagatgactgtaagtgtagacttgtattgatttagagatataatattgtattctgtacagtcatggctggaggaatgtaatgtattgagttcccttttgctagtaccaattgaatgcaacttctaattaagcgagtgtttga

SEQ ID NO: 3862 - DNA, 3655 bp, Populus trichocarpa
atctcatgtcacgatccctccattttcactctctctcaaaaccccaaaacccaaaaggacaccaccatgaaccgaaacggctccaccagaaaacgcccaccgccaacgccacagccaccgaacccatcaccggcggtgaagcaccaagccatcactcccaccgtcgacgaagaattcctcgatgaagacgtcttccttgacgaaaccctcattgcagaagacgaagagaatctcaataaagaacgtcaagtccttacttctcgtctctcaaaatgggcccgcccgaagttatcagatggctacgtgtcgcaatcgcagagtatcatatttcagcaactcgagattgattacgtgatcggagagacacataaagaacttttgcctgataggtcaggttctgctgctattcttagaatttttggggttactggagaaggacatagtgtttgctgtcttgttcatggatttgagccctatttctacgtcagctgtcctcctggaatgaacccagatgatatctcccattttcataagattcttgaggggaagatgagggaggtgaataggaacactaaagtacccaaatttgtgcgacgaattgaattggtgcataaaaggagcataatgtattatcagcagcagcaatctcatccctttcttaagattgtagttgcattgccaacgatggtctctggctgccggggtatccttgataaaggcatacagattgatggactcggtatgaggagcttcatgacatatgaaagcaatgtcctctttgctctccgtttcatgattgactgcaatgttgttggtggaaattggattgaagtacctgctggaaaatacaaaaagacttcaaagagcttatcaaattgtcaattggagtttgattgcttatattcagaattgatcagccatgctgctgaaggggaattctcaaaaatggccccgtttcgcattttgagttttgatatagagtgtgctggtcgcaaaggccattttcctgagcctacgcatgatcctgttattcaggtggcaaatctagtaactttgcagggggaggaccagccatttgttcgtaatatcatgaccctgaactcatgttctccgatagttggtgtggatgttatgtcttttgatacagagagagaagtcctgatagcttggaaggaatttattcgtgaagttgatccagatattataattgggtataatatctgcaaatttgatctgccatatctcattgagagagctgcaaccttgggaatatcagaatttcctgtcttgggccgcatcaggaacagcagggttcggatcaaagatgcgaccttttcatccagacaatatgggacaagggaaagtaaagaagttacagttgaaggcagagttcaatttgatttgcttcaggtcatgcaacgagattataaactaagttcttattcattaaactctgtttcagcacactttctctctgagcagaaagaggatgttcaccattcaataatatctgatcttcagaatgggaatgcagaaactaggaggcggcttgctgtatattgtttaaaggatgcatatctcccacagcgtctcttggacaaactgatgctcatttacaactatgtggaaatggcccgtgtaactggtgtccctctctcttttcttcttgccaggggacaaagcatcaaggtgctttctcaactgttgaggaaggccaaggaaaaaaacctagttattccgaatgtcaagcaggcaggatctgaacaaggaaaatatgaaggcgcaactgttttggagccaaaagcaggattctatgaaaagccaattgcaacactggattttgcatccctatatccatcaataatgatggcatacaatctatgttactgcactctggtaacacctgaagatgttcgcaaactgaaccttccacctgaatgtatcaataaaactccatctggtgaaacttttgtgaagtcaaatttacagaagggaattctacctgaaattcttgaagaactattaactgctcgaaaaagagcaaaagcagatttgaaggaagcaaaggatccctttgagaaggctgttctagatggtcgccaactggcattgaagattagtgcaaattctgtttatgggtttacaggagctacagttgcccaattgccatgtctagaaatatcctcaagtgttacaagctatggtcgacagatgattgaacacacaaaaaaacttgtggaagacaagtttactatactagggggctacgaacacaatgcagaggttatttatggtgacactgattcagttatggtgcaatttggagttcctactgtagaagcagcgatgaagttgggccgtgaagctgctgagtgtattagtggaactttcatcaaacccatcaagctagagtttgagaaggtttattatccatatctattgattagcaagaagcgatatgctggtttattctggacaaatccagacaaatttgacaaaatggatactaaaggcattgaaacagttcgaagggacaactgtctattggtaaaaaatctggtaactgagtgtcttcacaagatactaatagacagagatgtgcctggcgcggttcaatttgtaaagaacacaatttcagatcttctcatgaatcgcatggatttgtcacttctggttattactaagggtctgacaaagacaggagatgattatgaagtaaaggcagctcatgttgaactagctgaacgcatgcgcaagagagatgctgccactgctccaaatgttggggatcgagtgccttatgtcattataaaaggtgcaaaaggtgccaaggcttttgagaaatcagaggatcccatctatgttctagaaaataacataccaatagacccccaatactatctggaaaaccaaattagcaagccacttttaagaatttttgagcccattttgaagaatgccagcaaggagcttcttcagggaagtcacacaagatctatttccatatctactccttcaacaggtggcattatgaaatttgcaaagaaacagctcacatgcattggctgcaaaacccttcttagcaattcagatcgaactctctgctcaaactgcaaagggagagaagcagagctgtactgcaaatcagtttctcaagtatctgaactagagcaactttttgggaggctgtggacacagtgccaagagtgccaaggctctcttcaccaggatgttctttgcactagtcgggattgcccaatattttatcgtaggaaaaaggcacagaaagatatggctggagccaagacgcaattagatcgatggagcttctaacattctaacaagaggtgttttccgaagttcatgggcaagacggcaatttggcaacatggttttgcactcgtggaaactcttttggtgcagagtccctggataagctgttatcagttttcccgttcaccataaagaacaagatctgagtatgacgaggttcaattttgctggatacaagggaaagatgtgatcggttgttgggggttcaatcaagtatgacaggcatagccttctaatcctgtttgtattaattaatatcagtgattttgtatacaagtggaagtagggcatgtatattttgtattggtcttcatttttatta

SEQ ID NO: 3863 - DNA, 3682 bp, Aquilegia formosa
atgaacaacaagaagcgaactcctccgccatcttcaactccaactcaacaacaaccaccaaaacgatttcaacaaacgatggacgaagatgagatgattgacgaagatgtgtttttagaagaaaccctacttcgagaagaagaagaagctatgattcttcatgatgctgaacaacgtaaacaagctcttgcttctcgtctcactatttggaaaaggccttctctttctccttcttatgtttctcaaaccagcaacattatttttcagcaattggaaattgattatgttattggtgagaggaataaagaattgttgcctaattcttctggtcctgctgctattctcagaatttttggtgtcacaaaagaaggacacagtgtttgctgcaatgttcatggttttgagccatatttgtatatgagttgtcctccaggaatgggccctgacgacgtctctcgtttccatcgaagtctagaggtaaggatcaaagaagattaccgggtcaagaacataaaggctccccaatttgttttaaggatagaaatggtgcataagagaagcattatgtattaccaacagcagcagtctcacctttttctaaagattgtagttgtgttgccaaaaatggtcgcgatttgccgagatatccttgagaagggcatacaaattgatggttttggtacaaagtgttttctgacatatgaaagcaatgttctttttgctcttcgtttcatgattgactgcaatattgttggtggcaattggattgaagtgtgttctggaaaatataagaaggcaacaaagccaatgtcttattgccaactggagtttgattgcctgtactctgaactaaccagccatgctccagaaggggaattttcgaaaatggctccatttcgcatacttagttttgacatagagtgtgctggtcgcaaggggctctttccagagcctacgcatgatcctgttattcaggtggccaatcttgtcactctacaaggagaggaccatccttttgttcgcaacattatgactttgaagtcatgttctcctattgtaggtgtagatgttatgtcgttcgacacggaaagagaagttttgcttgcttggagggattttttccacgaagttgatcctgatatcataattggatataacatctgcaaatttgacttgccttatcttattgagagagcagaggtcttaaaagtagcggagtttcccatcttgggacgcatcaggaatagcagagtccgtgttaatgctaagaccttttcctctagacaatatgggacacgagagagtaaagaaattacaattgaaggcagagttcagtttgatttacttcagtccatgcaaagggattacaagctaagctcatattcactaaactctgtctcagcacactttcttggggaacagaaagaggatgtccatcactcaataatatctgatcttcagaatgggaactccgaaactaggaggcgactggctgtttattgcttgaaggatgcttacctcccacaaaggcttttggacaagttgatgtttgtttataattatgtggagatggctcgtgtcacaggtgttccaatatcttttcttctttcaagaggtcaaagcattaaggttctttcacaactcctgaggaaagcaaaacagaagaatcttgttcttccttgtgtctcaaagcagggatctggagacagtacgtttgaaggtgcaactgttttggaggccaggacaggattttatgagaagccaattgcaaccttggattttgcgtctttatatccgtccattatgatggcttataatctatgttactgcactcttgtaactcctgaagatgtgcgtaaactcaatcttcccccagaatgtgtaaacaaaactccgtctggtgaaacatttgttaaatcagagttgcagaaggggatacttccagaaattcttgaagaacttttggctgctcgtaaaagagcgaaagcagatttgaaggaagcaaaggatccattggagaaggctgtgctggatggtcgacagctggctcttaagatcagtgcaaattctgtatacgggttcacaggagctactgttggccaattaccttgtctagagatctcatctagtgtgacaagctatggacgacaaatgatcgagcacacaaagaagcttgtggaagagagattcactacacttggtggatatgaacacaatgctgaggctaacccttttcatcaggttgtttacggggacactgattcagttatggtgcaatttggcgtacctaccgttgatgcagcaatgactttgggacgagaagccgctgaatatattagtggcactttcattaggcccatcaaactagagtttgagaaggtttactatccatacctgttgattaacaagaagagatatgctggactctattggaccagtcctgataaatttgacaagatggacacaaaaggcattgaaactgttcgaagagacaactgtctactggtgaaaaatttgataactgaatgtcttcacaaaatactaattgaccgtgacattcctggtgccgtgcaatatgttaagaacacaatttctgatcttctaatgaatcgcatggatttatcacttttggttataaccaagggtctgacaaaaacagcagatgattataatgctaaggctgcacatgttgaacttgctgaacgcatgcgcaagcgtgatgctgctactgcacccaatgttggggatcgcgtaccatatgtcattattaaggctgcaaaaggtgctaaggcttatgagagatcagaggatcccatctatgtgctagagaataacatccctatagatgcccagtactaccttgagaatcaaatcagcaagccacttctgagaatatttgagcctattctaaagaatgcaagcaaggaacttctacatggaagtcatacaagagctgtttctatttcaacaccatcaaatagcggcattatgaagtttgctaaaaagcaactctgttgtcttggatgcaaggctttaattagcaactcagaacatactctttgtgcacactgcaagggtagggaagctgaactgtactgcaaaacagtagctaatgtagccgacctagagatcctttttgggaggttatggacgcagtgccaggaatgccaaggatcacttcatcaagatgtgctctgtacaagtcgggactgtccgatattttatcggagaaagaaggcacaaaaggacatggctgaagctagggtgcaattggatcgatggcagttttaaaatctcttgggattgtatatatttgcttctccacaaggccccagctgtttttagaattgctggcatcttatgacaatagtacaactggaagaatttgttctactaggagctcttctatagagttatctggcatgtctggttcggaggtagtagcgcattcttgcagatgttatcgcatttgctcaggggttctaaaccgcacacaagctaaatttgaatttatctgaaactaatttttttaatgggccaagaatgagtttgttgtcgttgtgagtcaatgcaatcacatttgcaaattttgtatgtatgcttgaggtagaagtgtaagttcaaaatgaagaatgaatgattttcggatgaacctttcttttgtttacgagttatattgccc

SEQ ID NO: 3864 - DNA, 3356 bp, Phaseolus coccineus
tccaaccttctctcttccgattccaatgagcgcctcccgaaagcgcgcggcggcgccgccgaaacctccgccgtcgaagcaagccttattgactcaggaagaggacatggacgaagacgtgtttatggagcaaaccctcatttctgaagacgaagagtccatgattctccgcgacatcgagcagcgccaggccctcgctgctcgcctatccaagtgggcgcgtcctccactatcggccgattacgtcaaacaagtcgtttttcagcagctggagattgattacgtgatcggggagagtcacagggagttgctgccgaacttgtctggacctgctgccattatcagaatctttggagttacgaaggaaggacacagtgtttgctgcaatgttcatgggtttgaaccatatttctacatctgttgccctcctggaatgggtccagatgatatctctcattttcaccaaacacttgagggaaggatgagagaagccaatagaaatagtaatgtaggaaaattcgttcgccgcattgaaatggtgcagaggagaagtattaagtactatcagcaatctgattcccagtcctttctcaaaattgtagttgcactcccaacaatggttgccagctgccgtggtattcttgataggggtattcagcttgatggtctgggaatgaagagcttctggacttatgaaagcaatgtactttttgccctacggttcatgattgattgcaacatagtaggtggaaattggattgaaattccagcaggaaaatataagaagatagcgaaaagcttgtcttattgccagttggagtttgattgcctgtattctgatttgattagtcatgctccagaaggggaatattcaaagatggctccatttcgcatattgagttttgacattgagtgtgctggtcgtaaaggtcattttcccgagcctagccatgatcctgttatccagattgctaatttggttactttacaaggagaggaccagccacttattcgtaatgtgatgacccttaaatcatgctctcctattgttggtgttgatgtgatgtcatttgatacggaaagagaagtcctgctagcttggagggatttaattctggaagtggaccctgatattattattggatataacatctgcaaatttgacctgccatatcttattgagagagctgcaaacctgaagatagcagaatttcctattcttggccgtattaggaacagtagagttcgggtaaaggatacaactttctcgtcaaggcagtacgggaccagggaaagcaaagaagttgcagtagaagggagagttcagtttgacttactccaggttatgcagagagactacaaattaagttcgtattcactaaattctgtctcagcacacttcctttctgagcagaaagaggatgtccatcattctatcatatctgaacttcagaatggaaccccagaaactaggaggcgtcttgctgtgtattgtttgaaggatgcatacctccctcagcgacttttggataaattgatgctcatttacaactatgtggagatggctcgagtaacaggtgttccaatttcttttctactttccagaggccaaagcattaaggtactttcacaacttcttaggaaggcaagacagaagaatctggtcattcctagtgtcaaacaggtcgggtctgaacaaggaacattcgaaggtgccactgtattggaggcaagggctggattttatgaaaaaccaattgctacgttagattttgcatccctgtatccatctattatgatggcctataatttatgttattgcacactggtgacttctgaagatgctcgcaagctgaacatccctccggagtccgtgaacagaactccatctggtgaaacatttgttaaagcaaatctgcagaagggaatacttcctgaaatacttgaagagctattaacagcccgaaaaagggcaaaagcagacttaaaggaggcgagggatcccctggagagggcagtactagatggtaggcagctggccctgaaaattagtgcaaattctgtgtatgggtttactggggctaccattggtcagttaccatgtttggagatatcatcgagtgtaacaagctatggtcgacaaatgattgagcacacaaaaaaacttgtgggagataaatttacgacacttaatggctatgagcacaatgttgaggtaatatatggagacacagattcagtcatggtacaatttggtgtttcttctgtagaacaggctatgaacttggggagagaagctgccgaatatataagtggaactttcacaaaacccatcaaactagaatttgagaaggtttattatccatatctattgattagcaagaagagatatgctggtttgttttggacaaaaccagacaactttgacaaaatggacactaaaggtattgaaacagttcgaagagacaattgtttgttggtaaaaaacctggtgaatgattgtcttcacaaaatactgattgacagggacattccgggggctgtccagtatgtcaagaacgcaatttcagatcttctcatgaatcggatggatttatctctgctggttattacaaagggtttaacaaagacaggagatgattatgaagtaaaggcagctcatgttgaacttgctgaaaggatgcgcaagcgagatgctgccactgctccaaatgttggagatagagtaccttatgtaattatcaaagctgcaaaaggtgcaaaggcgtatgagaaatcagaggaccctatttatgttctagagaacaacattcctatagatcctcaatactatcttgagaatcaaattagcaagccgattctgagaatttttgagccaattctgaagaatgctagcagagaacttctccatggagatcatacaagatctatttcaatttctactccgtcaaacattggcttattgaaatatgctaagagaaaccttacctgcattggctgtaaagctgtactaggcaaggatcttcacacagtctgttcacattgcaaaggaagggaagctgagctatactgtaaaacagtatctcaagtgtctgagttggagaagctttttgggaggttgtggacacagtgtcaggagtgccaaggttcacttcatcaagatgttctctgcaccagtcgggattgtccaattttttatcgacgaaaaaaggcacaaaaagatatgtccgaagcaaaatcgcaattggaccggtggagtttttaagttttgccaagtcagttttttctctattttcttccatattcggtcctttgtcttcatactgatctcgaccatgaattgcatccatcccatt

SEQ ID NO: 3865 - DNA, 3538 bp, Eutrema parvulum
tctcccttttccctctcagaccttcaggagctctcactcacgcactaattttttttcttttcttttttcccgctcatctgaaaaagccatgaatagagggggaaactccaaaaagcgaccgcctccgtcgaataacttaccggcggggaagcatcgggcaacgggtaatccgacaccatctccggctgccggaaccctagaagatgaatttgtggacgaggatgtctttatggacgaagaagccctattggtaggccaagaggatgatgaatccctaatccttcgggatatggaggagcgtgaagcggtttccgcacgatcctccacttgggctcgacctcctctttcatccgcttatctctctaattcgcagagtatcattttccagcaattggagattgattatgtaattagggagagtcacaaggagctcttgccggcctcctcagggcaagctgcagtcattaggattttcggagtaaccagagaaggtcatagtgtgtgttgctatgttcatgggtttgagccgtacttttacattgcttgccctcctggaatggggccagacgatatttctcgtttccatcagagtctcgagggaaggatgagggaatccaataaaaatgccaatgttccgaaattcgttcgtcacatagaaatggtgcagaaaagaagcattatgtattaccaacagcaaaaatcccaaagctttctgaagattacagttgcattgccgactatggtggctagctgtcgcggcatccttgatagaggcatacagattgatggattgggtatgaagagcttccaaacatacgagagcaatattgtttttgctctccgtttcatggttgatcgggatgttgtgggaggaaattggatcgaagtgcctactggaaaatataagaaggatgcaagaactttgtcatactgccaattggagttcagttgcctgtactcagatttgatcagtcatgccgcagaaggtgaatactcaaaaatggctcctttccgcgtactaagttttgatatcgagtgtgcaggccgtaaaggacactttccagaggctaagcatgatcctgtgatccagatagcgaaccttgtaactcttcagggagaggatcaaccattcgtacgcaatgtcatgactcttaagtcatgtgctccaatagtaggtgtagatgtcatgtcttttgaaacagaaagagaggtcttactagcttggagggattttattcgtgatgttgatcctgatatcatcattggctataacatctgcaaattcgatttaccatatctgattgagagagctgcaacactgggaatagaggaatttcctcttcttggtcgtgtaaagaacagtagggtccgggtcagggactcaacattttcatcaagacaacaaggaacaagggaaagtaaagagaccacaattgaaggacgatttcagtttgaccttttccaggcaatactcagagactacaaattaagttcttattcgctgaattctgtctcagcacactttctttctgagcagaaagaggatgtccaccattctataataaccgatcttcagaatgggaatgcagaaaccaggaggcgtcttgctgtttattgtctgaaggatgcatatctccctcagaggcttctggacaaactgatgtatatatataactatgtcgaaatggctcgtgtaactggtgtccctatttcctttcttcttgctagaggacagagtatcaaggttctatctcagcttcttaggaaagctaaacagaagaacctggttcttccgaatgctaaacaatcggggtcagaacaaggaacttatgaaggggcaactgttttagaagcaagaacaggtttctatgaaaagccaattgctactctagattttgcttcactgtacccatcaattatgatggcatataatctgtgctactgcaccttggtgacacctgaagatgtatgcaagctgaatcttccacctgagcatatcaataaaactccatcaggggaaacatttgttaagcaaagtttacaaaagggaatacttccagaaattcttgaagagcttattactgcccgtaaaagagctaaagcagatttaaaggaggctaaggatccgcttgagaaggctgttttagatggtagacagttggcattgaagatcagcgcaaattctgtgtatgggtttacgggagccactattgggcagttaccctgcttagagatatcctcaagtgtgaccagctatggtcgtcagatgattgaacaaacgaagaaattcgtagaagataaattcacaacattgggagggtatgaatacaatgcagaggtcatttacggagacacggattcagtcatggtgcaatttggagtatcggatgtagaagctgcaatgaccctggggagggaagctgcagaatatattagtggaacttttatcaaacccatcaaattggagtttgagaaagtatatttcccatatctgctgattaacaagaagagatatgctggtttgctgtggacaaatcctcaaaagtttgacaaaatggacaccaaaggaatcgagacagtacgaagggataattgtttactagttaagaacctcgtgactgagagtcttcacaaaatactaattgatagagatgtgccaggcgcagcagagtatgttaagaatacaatttcggatcttctcatgaaccgtattgacttatcccttttggtgattactaagggtctaactaaatctggagatgattatgaagttaaatcagctcatggtgaacttgccgaacgtatgcgtaagagggatgctgctacagcgccaaatgttggggatcgggtaccctatgttattataaaagctgctaaaggtgccaaggcttatgaacggtcagaagatccgatctatgtgcttgagaataatatccctatagacccaaattactacctggagaatcagattagcaagcctcttcttaggatttttgagccagtcttaaaaaatgctagcaaggaactactccatggaagtcacacaaggtcaatatcaattactactccttcgaacagcggcataatgaaatttgccaagaaacaactaagctgtgttggctgcaaagttccgatcagcaatggaacactgtgcacacgttgcaagggaagagaagccgagttatattgcaaaaacgtgtctcaggtgtcagacctagaggaggtctttgggaggctgtggacccagtgtcaggaatgccaaggctctcttcaccaagatgtcttgtgcaccagtcgagattgtccaatattttaccggagaatgaaagcacaaaaagacatggctgtggccaagcaacaactcgaccgttggagcttttaagttcttagcttcttttttttttcaactggtttctttgctgttgaagtctccttttaattagagagactttgggatgttatgaatcatttgagacctcttttcttttgcttcgttgtacgtagcttttaattaatacagtcggaaagagaattcttc

SEQ ID NO: 3866 - DNA, 3540 bp, Arabidopsis thaliana
tagtctcactttctacttctctcagacctccacgagctcacaaaatcacacacattctcttcttttcccgctcacccaaagccatgaatagatccggtatttccaaaaagcgaccgcctccttcgaataccccaccaccggcgggtaagcatcgagccactggtgattcaacaccatctccggccatcggaaccctagatgatgaatttatgatggaagaggacgtgtttctggacgaaactctcttgtacggcgacgaagatgaggaatccctaatcctccgtgacattgaggagcgtgaatcgcgttcctcggcttgggctcgacctccgctctcccccgcgtatctctcgaattcacagagtatcattttccaacaattggagattgactctataatcgcggagagtcataaggagctgttaccgggttcctcagggcaagctccaatcattaggatgtttggggttaccagagaaggtaacagtgtgtgttgctttgttcatggatttgagccatacttttacattgcttgccctcctggaatggggccagacgatatttctaatttccatcagagtcttgagggaaggatgagggaatccaataaaaatgccaaggtcccgaaatttgttaaacgtatagaaatggtgcagaaaagaagcattatgtattaccaacagcaaaaatcccaaacttttctgaagattacagttgcattgccgactatggtggcaagctgtcgcggcatccttgatagaggcctacaaattgatggattgggtatgaagagcttccagacatatgaaagcaatattcttttcgttctccgtttcatggttgattgtgatattgtcggaggaaattggattgaagtacctactgggaagtataagaaaaatgcaagaactttgtcatactgccaattggagttccattgcctgtactcagatctaatcagtcatgctgcagaaggtgaatactcaaaaatggctccattccgtgtactaagtttcgatattgagtgtgcaggtcgtaaaggacattttccggaagctaagcatgatcctgtaatccagatagcgaaccttgttactcttcagggagaggatcacccatttgtacgcaatgtcatgactcttaagtcatgtgctccaatcgtaggcgtagatgtcatgtcttttgaaacagaaagagaggtcttactagcttggagggatttgattcgtgatgttgatcctgatatcatcattggttataacatctgcaaattcgatttaccttatctgattgagagagctgctacactgggaatagaggaatttcctcttcttggtcgtgtaaagaacagtagggtccgggtcagggactcaacattttcatcaagacaacaaggaataagagaaagtaaagagaccacaattgaaggaagatttcagtttgaccttattcaggcaatacacagagaccacaaattaagttcttattcgctgaattctgtctcagctcactttctttccgagcagaaagaagatgtccaccattctataataactgatctccagaatgggaatgcggaaaccaggaggcgtcttgctgtttattgtttgaaggatgcatatcttcctcagaggcttctggacaaactgatgtttatatataattatgtcgaaatggctcgtgtaactggtgtccctatttcatttcttcttgcgagaggacagagtatcaaggttttatctcagcttcttaggaaaggcaaacagaaaaatctggttcttccaaatgctaaacagtcagggtccgaacaaggaacttatgaaggcgcaactgttttagaagcaagaacaggtttctatgaaaagccaattgcaactttggattttgcttcactgtacccgtcaattatgatggcatataatctgtgctactgcaccttggtgacacctgaagatgtacgcaaactgaatcttccacctgaacatgtcactaaaactccatcaggggaaacatttgttaagcaaactttgcaaaagggtatacttccagaaattctcgaagagcttcttactgcccgtaagagagctaaagcagatttaaaggaggctaaggatccccttgagaaggctgttttagatggtagacagttagcgttgaagatcagtgcaaattctgtctacgggtttacgggagccactgttgggcagttaccatgcttagaaatatcctcgagtgtaactagctatggtcgtcagatgattgaacaaacaaagaaacttgttgaagacaaattcacaacactgggagggtatcaatacaatgcagaggtcatttatggagacacggattcagtcatggtgcaatttggagtatcggatgtagaagctgcgatgaccttggggagggaagctgcagaacacattagtggaacttttatcaaacccatcaaattggagtttgaaaaggtctatttcccatatcttctcattaacaagaagaggtatgctggtttgctatggacaaatcctcaacagtttgacaaaatggacaccaaaggaatcgagacagtacgaagggataattgtttactggttaagaacctcgtgactgagagtcttaacaaaatacttattgatagagatgttccaggggcagctgaaaatgtcaagaaaaccatttcggatcttctcatgaaccgtattgacttgtcacttttggtgattactaagggtctaacgaaaacaggagatgattatgaagttaaatcagctcatggtgaacttgctgaacgcatgcgtaagagggatgctgctacagcgccaaatgttggagatcgagtaccgtatgttatcataaaagctgctaaaggtgccaaggcttatgaacgatcagaagatccaatctacgtgctacagaataatatccctatagacccaaattactacttggagaatcagattagcaagccacttcttaggatttttgagccagtcctgaaaaatgctagcaaggagcttctccatggaagtcacacgaggtcaatatcaatcactactccttcaaacagcggtataatgaagtttgctaaaaaacaactgagctgtgttggctgcaaagttccgatcagcaatggaacactatgcgcaagttgcaagggaagagaagccgagttatattgcaaaaacgtgtctcaagtggctgagcttgaagaggtttttgggaggctgtggacacagtgccaggagtgtcaaggctctcttcatcaagatgtcttgtgcaccagtcgagattgtccaatattttaccggagaatgaaagcacaaaaagacatggctgtagccaggcaacaactcgaccgttggagcttctaataagtatttaaggttgtttttagctctctcttttttccattggtatcgttgctgttacactttccgcttgatttagaacttgtaggtctctttggaatgttataaaaaggacctcttcggcttatttgtacgtagctgttgattaatacaaaaagagaactcttctcgc

SEQ ID NO: 3867 - DNA, 3826 bp, Pinus taeda
atgttagtccgctatagggacatttgcctcagctcagtccaggagcctcctgctacccattttctccttgtcaactatcgcggttacatacacagttacacagagatacagaggggatagccagggcaaagacaaacccttggaaatatcgataccatggaggggaaacggcgtttcgggggtccgccctctgcgtccaatcctccttctaagaggttccagcccgaggaggaggaggaagaattggacgaggatgtgtttttggaagaaacccttttgagagacgaggagctcctgcaggacagcggcgtggagggcctcgcttctcgcctctctaagtggaagagaccgcatttgccttccacctatgttacttctgcctctcaaagcatagagttccagcagttggatattgattacattataggtgaaagtcaccgggagattttgcctcattcaactggacaagcagcaattttgcggatatttggtgtgacacaagaaggttatagtgtatgctgtcttgtacatggttttcaaccatacttttacatcagttgccttgatgggatgagtccagatgacataacaagattccaacaagttttggagggtaggatgcgagaagcaaatagaaatagcaaggttacaaagttcatcactaagattgaaatggttcagaaaagaagtatcatgtactatcaggaacagaaatttcgaacttttcttaaaattgttgttgctcttcctacaatggttgctagctgtagaggtattctagaaaggggcatcacaattgatggattgggttcaagatgcttcactacctatgaaagcaatgttctgtttgcacttcgttttatgattgattgtgatattgttggtggcaactggattgaacttcctccttggtcataccaaagatctcctaggaatatgtcttattgccaaatagaagttgatattctatactctaaattagttagtcattccccagttgggaagtactcaagaatggctccctttagaattcttagttttgatattgaatgtgctggtcgaaaagggcattttccagagcccaatcatgatcctgttatccagattgccaatttagttacattgcaaggagaagatcgcccatttgtacgaacgtaatgaccttaaagtcatgttctccaattgttggtgttgacgtaatgtcatttgataatgaaagagaggtgttgcttgcatggagggattttattcgcgaagttgatcccgatctgatcattggttataatatatgcaagttcgacttgccatatctcatagagagggcagagacattgaaaataacagagttccctttcctgggccgtattagaaatagtcgtgttcgtgtgagggacacctccttctcatcaaggcaatatggtacacgagagagcaaggaagcaacgattgaaggcagagttcagtttgatttatttcaggtgatgcagagagattacaagctcagttcgtattcattaaattctgtttcagcacactttcttggtgagcagaaagaagatgtacatcattctatcatttctgatttgcacaatgggaatccagagacaaggagaaggcttgctgtatattgtctgaaggatgcttatcttccacagcggctcttggataaactgatgtttatatacaattatgtagagatggctcgtgttaccggtgttcctttgtcatttttgctttccaggggtcaaagcatcaaggttttatctcagatactaagaaaatcaaggcaaaagaatcttcttgtgccaaatattaaaggccaaggctctggacaggagacttttgaaggtgcaacggttttggaggcaaaatcaggtttctacgaaaaaccaattgcaactctggactttgcgtccttgtatccatcaatcatgatggcatataatctttgttattgcagcttggtgaggtcagaggacattgcaaaattcaatctccagccggagtgtgtaaataaaacaccatcgggtgagacttttgtgaagccaactttacagaagggcatattaccagagatcctagaagagttactggctgccaggaaaagagccaaggcagacctaaaggaggctaaagatccttttgaaaaggctgtcttggatggccgacaattggctttgaagatcagtgcaaattcagtttatgggtttactggtgccactgttgggcaattgccctgtttggagatttcatcgagtgtgacaagctatggccgtcaaatgatagagcatacaaagaggctagttgaagaaaggttcacaatagttggcggttaccaatacaatgctgaggttgtatatggagatacagattcagttatgatacagtttggtgtaccaaatatagaagaggccatgacgctagggagggaagcctcagattatattagtggtacatttacaaagcctattaaactagaatttgaaaaaatatactacccatacttgttgatcagcaagaaaagatatgctgggttgttgtggacaaagccagatgcttatgacaaaatggatactaaaggcattgaaacagtgcgaagggacaattgcctgctggtgaagaacttggttacagagtgccttcacaaaatactcattgatcgtgacatacctggtgcagtgcagtatgtcaagaacactatttctgacttgttaatgaacagaatggatttgtcacttttggtgataacgaagggtctgacaaagactggagatgactatgcagtcaaggcagcacatgtggaactagctgagcgcatgcggaagagggatgctgcaactgctccaactgtgggtgatcgtgttccatatgtcatcataaaggctgcaaaaggtgccaaggcatatgagaaatctgaggatccaatttacgtactggagaataacatccctattgatccacaatattatctggagaatcaactgagcaagccgctgttgagaatatttgagcccattttgaagaatgcaagcaaggagcttcttcatggtagtcacacacgagcagtttccatatcaactccttcaaatagtggaattatgaaatttgccaagaaacaactcagttgtattggttgtaaaacacctatcagcaaagacgatcagacactttgttcacattgcaaaggaagagaagcagaattgtatcagaaaacagttgcaaatgtgagggaattagaaatgctctttggtaaactatggacacaatgtcagcggtgccaaggctctctgcaccaagatgttctttgcacgagtcgtgactgcccaatattttatcgtaggaagaaagctcagaaagacctaactgaagcagaggtgcaactagagcgctggcagttttgaggatgctgcctgtgtagcttataatttttgtattatcaaatatttttgttttcctgaattttctctagtgtatgtttctctgatttaatggaccagggaatttatttggtccctgaatcaggatgagcatagtttatttattgtacagtaattgtcaagtccttgttatttaatgttaaccagtttgatatatcttttctccttgcaaatgagatggagaaaaagtcaaaatggatacatacttcccaaggcacaccctataaatgcaatgtgcacgcatatcccaaattttaggagagcacacactataaaacatagatctgcaggcttacatatgtatatccagacatgcatatagttgaatggatggatggatggataggtagatagagatggatacacaggtagattggcaggagcaaatc

SEQ ID NO: 3868 - DNA, 4058 bp, Arabidopsis lyrata
tagtctcactttctacttctctcagacctccacgagctcacaaaatcacacattgtcttcttttcccgctcgcccaaagccatgaatagagccggtaattccaaaaagcgaccgcctccttcgaataccccaccggcggtgaagcatcgagccactggtaattcaacaccatctccggcaatcggaaccctagatgatgaatttatggtggacgaggacgtgtttctcgacgaagctctcttgtacggcgacgaagatgaggaatccctaattctccgggacattgaggagcgtgaatcgcgttcgtcggcttgggctcgacctccgctctcacccgcttatctctcgaattcccagagtatcattttccaacaattggagattgactctataatttcggagagtcataaggagctgttaccgggttcctcagggcaagctccaatcattaggatgtttggggttaccagagaaggtaacagtgtgtgttgctttgttcatggattcgagccctacttttacattgcttgccctcctggaatggggccagacgatatttctaagttccatcagattcttgagggaaggatgagggaatccaataaaaatgccaaggtcccgaaatttgttcggcgtatcgaaatggtgcaaaaaagaagtattatgtattaccaacagcaagaatcacaaacttttctgaagattacagttgcattgccgactatggtggcaagttgtcgcggcatccttgatagaggcttacaaattgatggatttggtatgaagagcttccaaacatatgagagcaatattattttcgttctccgtttcatggttgactgcgatattgtcggaggaaattggattgaagtacctactgggaaatataagaagaatgcaagaactttgtcatactgccaattggagttccattgcctgtactcagatctaatcagtcatgctgcagaaggtgaatactcaaaaatggctccattccgtgtactaagtttcgatattgagtgcgcaggtcgtaaagggcactttccggaggctaagcatgatcctgtaatccagatagcgaaccttgttactcttcagggagaggatcacccatttgtacgcaatgtcatgactcttaagtcatgtgctccaatcgtaggcgtagatgtcatgtcttttgaaacagaaagagaggtcttactagcttggagggatttgattcgtgatgttgatccggatatcatcattggttataacatctgcaaattcgatttaccttatctgattgagagagctgcaacactgggaatagaggaatttcctcttcttggtcgtgtaaagaacagtagggtccgggtcagggactcaacattttcatcaagacaacaaggaataagggaaagtaaagagaccacaattgaaggacgatttcagtttgaccttattcaggcaatacacagagaccacaaattaagttcttattcgctgaattctgtctcagctcactttctttccgagcagaaagaggatgtccaccattctataataactgatctccagaatgggaatgcggaaaccaggagacgtcttgctgtttattgtctgaaggatgcatatctccctcagaggcttctggacaaactgatgtttatatataattatgtcgaaatggctcgtgtaactggtgtccctatttcctttcttcttgctagaggacagagtatcaaggttctatctcagcttcttaggaaagctaaacagaagaatctggttcttccaaatgctaaacagtcagggtccgaacaaggaacttacgaaggcgcaactgttttagaagcaagaacaggtttctatgagaagccaattgcaactttggattttgcttcactgtacccgtcaattatgatggcatataatctgtgctactgcaccttggtgacacctgaagatgtacgcaaactgaatcttccacctgaacatgtcactagaactccatcaggggaaacatttgttaagcaaagtttgcaaaagggtatacttccagaaattctcgaagagcttcttaccgcccgtaaaagagctaaagcagatttaaaggaggctaaggatcctcttgagaaagctgttttagatggtagacagttggcgttgaagatcagtgcaaattctgtctacgggtttacgggagccactaatgggcagttaccatgcttagaaatatcctcaagtgtaactagctatggtcgtcagatgattgaacagacgaagaaacttgtggaagacaaattcacaacattgggtgggtatgaatacaatgcagaggtcatttatggagacacggattcagtcatggtgcaatttggagtatcggatgtagaagctgcaatgaacttggggagggaagctgcagaacatattagcggaacttttatcaaacccatcaaattggagtttgaaaaagtctatttcccatatctgctcattaacaagaagagatatgctggtttgctatggacaaatcctcaacagtttgacaaaatggacaccaaaggaatcgagacagtacgaagggataattgtttactggttaagaacctcgtgactgagagtcttaacaaaatacttattgatagagatgttccaggcgcagctgaaaatgttaagaaaaccatttcggatcttctcatgaaccgtattgacttgtcacttttggtgattactaagggtctaacgaaaacaggagatgattacgaagttaaatcagctcatggtgaacttgctgaacgcatgcgtaagagggatgctgccacagcgccaaatgttggagatcgagtaccgtatgttatcataaaagctgctaaaggtgccaaggcttatgaacgatcagaagatccgatctacgtgctccagaataacatccctatagacccaaattactacttggagaatcagattagcaaaccacttcttaggatttttgagccagtcctgaaaaatgctagcaaggagcttcttcatggaagtcacacgaggtcaatatcaatcactactccttcaaacagcggcataatgaaatttgctaagaaacaactgagctgtgttggctgcaaagttccgatcagcaatggaacactatgcgcaagttgcaagggaagagaagccgagttatactgcaaaaacgtgtctcaagtggctgagctagaagaggtttttgggaggctgtggacccagtgccaggagtgtcaaggctctcttcatcaagatgtcttgtgcaccagtcgagattgtccaatattttaccggagaatgaaagcacaaaaagacatggctgtagccaggcaacaactcgaccgttggagcttctaagttttttttagcttcgattgtttctttgctcttgtaagtttccgtttcattagatcacttcttttgcttcttggtgcgtagctgttgattattactgtcagaaagaaaactcttctcgcattcttttgtcaagttaagaattttcggttattacaaactacgacagcacatgattttaggtttttattattcttctggttgaactattcaatatggtacacaaaagtatggacatggagcttagctgcctaaaccatatgggcttttgcctcatcgagtcaagtgtacagccttatccttgttgttattggttgtctgcaaagtgggcatgttgtgacaacaactccgcattccttgcatgtcgtgtgaccgcagctaaaagccatgtccttaggattcgtcaagcaaattgggcatactggcactgtagcaggaaccattctgtcacttttctctgcagtttctgtcatcggatttggcaccgatctaacagcattgtcacgctctataacctccggtggtggcgggagtggcttgtggtgcagatgggaactgcgcactggttttctattaagacttaatgtggccttgtattgaaaagggatctccatgagagctgcgagcgcaaaagcagcctcctttttagccgcatctttatgctctgacattagctttgtgaagtttacaaactg

SEQ ID NO: 3869 - DNA, 3360 bp, Mimulus guttatus
catgagcgccaccggcaatccacggaaacgcgcggctccgccgccgccgaagaatccggccgcaactccatcccctcaactgaagcaccaggcgacgatggaggaagaggagttagacgaggacgtcttcttcgaggaaaccctacttcagtacgaggaggaagactcgcagcgccgcgccctatccgaccgtcttgccaagtggaagcgtcccgcgctttccccttcatacatttcccagtctcagaacatcgtatttcagcagttggaaatggattatgttgtcggggatagccacaaggaacttctgccgagttcttcaggcctggccgcaattatacggatttttggggtcactaaagaaggacatagtgtttgctgtttcgtgcatggattcgagccatatttttacatcaactgcccttcaggaatgggtcctgatgatatctcccgtttccataaaattcttgagggtaagatgagtgaatcaaacagaaatactagagttcccaaatttatacgtcgcattgagctcgttcagaagagaagcatcatgcattatcaacagcagaactctcatcccttccttaaaattgtagtggcactgccaacaatggttgcaagctgccgtggtatccttgaaagaggaatacaaattgaaggactgggcatgaagagttttatgacatacgagagtaatgttctttttgctctacgtttcatgattgattgcaacatagtcggaggtaactggatcgaagttcctcgtggaaaacataagactataccaagaagtctcaccaattgtcagttggagtttgattgccttttttcggacttgatcagtcatgcccctgaaggggaattctcaaagatggctccatttcggatattgagttttgacattgagtgtgctgggaggaaaggtcattttcccgagcccagtcaggatcctgttatccagatagccaatctagtaacgttacagggagagggccagccatttgttcagaacgtcatgactcttaagtcatgctcaagtattgttggcgttgatgttatgtcatttgacacggaaaaagaagttctattagcttggagggactttattcgtgaagtggatccagacatcataattggttataacatctgcaaattcgatctgccataccttattcagagagctgatgtattgggaatagctgaatttccaatacttggacgtattcgaaacagcagagtccgcatcaaagatacaactttttcatcaagacaatacgggaccagagaaagtaaagaagttacaattgaggggagagtacaatttgatctgctacaggttatgcaaagggattacaaattaagttcgtattcgctaaattctgtttcttcgcactttctaaatgagcaggatgcttaccttccacaacgccttttggacaagttgatgttcatttataactacgtcgagatggctcgtgtgactggtgttccgctctcgtttctactttccagaggacagagcatcaaggtgctgtctcagcttttaaggaaagcaaagcaaaagagtctaattcttccaaatgtgaaacatcccggatctgaacagggaacttatgagggcgcaactgttcttgaacccagagcaggattctatgagaagcctattgcaactctggattttgcatctttatatccatcaattatgatggcatataacttatgctattgtacactggtaagtcctgaagatgttcataagcttaatttgcctccggagtgcgtcaacaaaactccatctggtgaaacttttgtcaaatcgaatttacagaagggaatactacctgaaattcttgaagaacttttggcagctcgtaaaagggctaaagcagatctgaaggatgcaaaggatcctctcgaaaaagctgtgttggatggtagacaactcgctctgaagataagtgcaaattctgtctatggttttactggagctacagttggtcagttaccttgtttggagatatcttcaagtgttaccagctatggtcgacaaatgattgaacacacgaaaaaacttgtggaagataaattcactgtggttggaggttacgagcacaatgctgaggttatatatggagatacagattcagttatggtgcaatttggtgtgtccacagtggatgaagccatgaatttgggtagggaagctgctgattatattagcggcactttcatcaatcccatgaaactggagtttgagaaagtctactatccatatctactaattagcaagaagaggtatgcgggtctttactggacgaacccacagaaatttgacaagatggagaccaaagggattgaaactgttcgaagggataactgtttgctggtaaaaaacctggtcaccgaatgcctaaataaaatattgatagacagagatgttcccgctgcagttcaatatgtcaagaacacaatctcagatctccttatgaatcgcatggatttatcccttttagttatcaccaagggtctgacaaaaacaggagaagactatgaagtgaaagcagcacacgttgagcttgcagaacgtatgcgaaagagagatgctgctactgctccaaatgtcggtgatcgggtaccttatgtcattatcaaagcagcaaaaggtgccaaggcatacgaaaaatcggaggaccccatctacgttttggaaaacaacattcctatcgaccccaattactacctcgaaaatcaaattagcaagccattgctgaggatcttcgagcccattttgaaaaatgctagtaaagagcttcttcaaggaagtcatacacggtcaatttccatttctaccccgtcaaccggtggcatcatgaagtttgctaaaaagcaacgaacttgccttggatgcaaggctttgattagtaactctgatcatactctatgctcacactgcaaaggaagagaagctgaactttattgcaagtctgtatctaacgttgctgatttagaggagctttttggtcggctatggacgcaatgccaagaatgccaaggctctcttcatcaggatgtgctttgcactagtcgagattgcccaatattttaccggaggaaaaaagcacagaaggatatggcagaggccagggtgcaactagagcgatggaacttctgatcttgtaacaaggttattttacggtgcctcattcgtaaaggacctgttgtttatgatttgtgccgtgttttgtacgtgtcgcggttcttaaacagaggggaaaagcacatgtaaggagatctctcttttttctttgtgaatcttttgtacatatatttttcctttaaaatattattattattgct

SEQ ID NO: 3870 - DNA, 987 bp, Saccharum officinarum
tcgttcgatgcccgtccggtccggaattcccgggcgcgaaaataatccaccgatctcgctgaaaaaagagaaccgagagcaaatgctgtcctccaccacactccggccgctggttccggcggcggcgtcgccgtcgccagcgcacctcaccgcctgctcctcgcctgcgctggggcggcgtgcgccggcggcggcggtggcggtgcgcgcggcgcggaactacgactctatcccgaagcgggagcccttcagctccagccgcagcatcctcgacgagtttctccggctggacaagcccctcgtccagcgcaccaaggaccagatcacagattattgcacgaccactgaaggtgatgaatgttgcagctgttgggatgcttactttgaactgaataaacttgagcaagagctgcccaaagaggaaatctcaaggatggtcaaggactcacagggtgacgtgaagtacctgattgagagcatccatcaccgctcagatttgcggaagaagatggcagagaaagctcgtaattcagtaccatcaagctcccaggggcaaactgcaaagccaaggccattccccgtgcctgatgggataccgaaaacacaggaagagctcgccgaagaagaggaggcgttgatgccagagtctccatacacaaggttgctgagaaggatgggtagataccctgattggtacaccccacgccctgatcatgagactgactgaatcaagtcatccaccatccaagtgtcccttttggaagttttgcagcatgataatctgaagctctttttatggcctgtggtaagattagtgttgcacgtatgcagattaggctgtcctttttctacttactaatgtaaaccggtgtgtagttttattatgctgttcacagccggaacgttcgatatatcttttatcggaggttctgtatactgatgcatctctgtatatgtaccatcgaataaaatcactgtttttttatt

SEQ ID NO: 3871 - DNA, 1078 bp, Zea mays
tacacaatgaaggaccaacgtgcaaaacacagttccatccttatccgttctactttgtcacttgccgacccctctgctttatataagctcgaaatttcgctgacgcgaaaaaaaatcaactgattcgctgaaaaacggagaattgaaagcgaatgctgtctcccaccacactgcggccgctggttccggcggcggcgccagcgcaccttaccgcctgcttcttgcccgcgtcggggcggcgtgcgccggcggcggcggtgcgcgcggtgcggaactacgactccatcccgaagcgggagcccttcacctccaaccgcagcaccctcgacgagttcctccggctggacaagccgctcgtccagcgtaccaaggaccagatcacagattattgcatgaccgtcgaaggtgatgagtgctgcagctgttgggacgcttactttgaactgaataaacttgagcaagagctgcccaaagacgaaatcgcaaggatggtgaaggactcggagggtgacgtgaggtacctgatcgagagcatccatcatcgctcagatttgcggaagaagatagcagagaaatctcgtaattcagtaccatcaggctcccaggggcaaactgcaaagccaaggccgttccccgtgcctgatgggataccgaaaacacaggaagagctcaccgaagaagaggaggcgttgatgccagagtctccatacacaaggttgctgagaaggatgggtagataccctgaatggtacaccccacgccctgatcatgagactgactgaatcaagtcatctaccatccaggtgtcccttttggaagttttgcagcatgataatctgaagctgaagctcgttttatggtatgtggtaatattttagtgttgcacctatgctgctatgcagattagacttgtccttttctacttattaatgaaaaccggtgtgtgcggtttatgctgtaaatacctggagtgttcagaatatgttttgttcgaggttctgtgtactgaagtacggagtactaatgaatttccttgtacataacatcgaataaaatcactgggttttactttggtttc

SEQ ID NO: 3872 - DNA, 900 bp, Pennisetum glaucum
gcgcgaaatccaccgaattcaccgcagaaagtgagagcagatgatgtcttccaccacacttcggccgctggtgccggcggcggcggcgtcgcacctcaccaccggcgccccgcgcgcggctgggcggcgctcggcggcggtggcggcgcgcgcggtgcggaactacgactcgatcccgaagcgggagcccttcagctccagccgcagcatcctcgacgagttcctcaggcaggagaagcccctcgtccagcgcaccaaggaccagatcacagattattgcacgaccacagaaggtgatgaatgttgcagctgttgggatgcatattttgaactgaataaacttgagcaagagctacccaaagatgaaatcgcaaggatggtgaaggattcggagggagatgtgagatacctgattgatagcatccatcaccgttcaaatctacggaagaagatggctgagaaagctcgtgacaccgtctcatcaagctccctgggtcaaacagcgaagccgaggcctttccctgtgcctgacgggttgccgaaaacgcaggaagagcttgcggaagaagaggaggccctgatgccagagtcttcttacacccggttactgagaaggatggggagataccctgattggtacaccccacgccccgatcacgagactgattgaatcaagtcacccaccactacccaatgttccgtttttgaaattttgcggcatgatataatctgaacctctgtggcctctgttatagattagtgttgctgttgaacctatgcagatgcttgttctcccctgcttttgctatttgaactgtataatggtgtctgctttgtgctgtacagctcctagcttcctacggtccagaatagcggcctgttcggttggctgatggctgg

SEQ ID NO: 3873 - DNA, 1039 bp, Panicum virgatum
ctgcttttatatagctctcccgagccaatccactcgcaattctgctactcgaaacccaccgaattcactgcaaaaactgggcgcaatgatgtcttcgaccacactccggccgctggtgccagcggcggcgtcgcacatcaccaccggcgcctcgcccgcggctgggcggcgctcggcggtggcgtcggtgcgcgcggggcggaactacgactcgatcccgaagcgggagaccttcagctccagccgcagcatcctcgacgagttcctcaggcaggagaagcccctcgtccagcgcaccaaagaccagatcacagattattgcacgaccatagaaggtgatgaatgttgcagctgttgggatgcatactttgaactgaataaacttgagcaagagctgcccaaagaggaaatcgcaaggatggtgaaggattcagagggagatgtgaagtacctgatcgatagcatccatcaccgttcaaatctacggaaaaagatggctgagaaagctcgtgatactgtttcatcaagctcccaggggcaaatggcgaagccaaggcctttccctgtgcctgacgggttgccgaaaacacaggaagagcttgccgaagaagaggaagctctgatgccagagtccccttacacaaggttactgagaaggatggggagataccctgattggtacaccccgcgccctgatcatgagaccgactgaatcaagtccattcaccatcttgtggcatgataatctgaagctgtatgtggcccgtggtcagatgtctcagattagtgttgctgttgcacctatgcagattaggttcataggttcttcttccctgcttttgcaatctgaactttataacggtgtctgctttgtgccgtgcagctcttacgtccagcatagcttttattccactctgtattcccattcgaggttctgtgtattggtgcatctatgtatatgtatgtatactgcatatagcctggaataaaatctctgggacccagcgtttctggacacatagcctctttttcgttgggg

SEQ ID NO: 3874 - DNA, 959 bp, Setaria italica
ctttatatagctctcccgagccaatccactcgcaattctgctgcgcgaaatccaccgaaaattcaccgcaaatgatgccttccactacactccggccgctggtgccagcggcggcttcgccggcggcggcgttgacggtgcgcgcggtgcggaactacgactcgatcccgaagcggaagcccttcagttccagccgcagcatcctcgacgagttcctcaggcaggagaagcccctcgtccagcgcaccaaggaccagatcacagattattgcacgaccatagaaggtgatgaatgttgcagctgttgggatgcatactttgaactgaataaacttgagcacgagctacccaaagatgaaatcgcaaggatggtgaaggattcagagggagatgtgagatacctgattgatagcatccatcaccgttcaaatctacggaagaagatggctgagaaaactcgtgctaccgtctcatcaagctccctggggcaatcagcgaagccgaggcctttccctgtgcctgatgggttgccgaaaacgcaggaagagcttgctgaagaagaggaagccctgatgcctgagtcttcttacaccaggttactcagaaggatggggagataccctgattggtacaccccacgccctgatcatgagactgactgaatcaagtcatccaccatcatccaactgtccgttttcgaaattttgcggcgtgataatctgaacctctgtggcctctgatatagattagtgttgatgttgcacctatgcagattaagcttgttcttccctgcttttgctatatgaactgtatgatggtgtctgctttgtgctgtacagctcctacgtccagaatagcttttattccactctttatcccccttcgaggttctgtgtaatgatgcatcattttatatatactggaataaaatctctgggtttcatcagagttcgtggaca

SEQ ID NO: 3875 - DNA, 659 bp, Oryza sativa
aaaaaaaatgctgtcctccaccgctctccggccgctggcgcagcccgccacggccacggccacggccaccgccttctcggcctcccgcacggccgccgcggctgggcggcgcgggtcggcggcgggggtagtggttcgcgcggtgcggaactacgactcgatcccgaagcgggagcccttcagctcgagccgcagcgtcctcgacgagttcctcaggcaggagaagcctctcgtccagcgcaccaaagaccagatcacagattattgcacaaccctagaaggtgatgagtgctgcagctgttgggatgcttactttgaactcaataaacttgagcaagagctacccaaagaggaaattgcaaggatggtgaaggactccgagggagatccgaggtacctgatcaatagcatccatcaccgttcagatctaagaaagaagatggctgagaaatctcataattcactatcatcaaactccctggggcaagctgcgaagccaaggcctttccctgtgcctgacggattgccgaaaacacaggaagagcttgctgaagaacaggaggccctaatgccggagtcctcctatacgaggctactgagaagaatggggagatttcctgattggtatacgcctcgcccagatcatgaaaccgactgaa

SEQ ID NO: 3876 - DNA, 1316 bp, Oryza sativa
gctaatccactcgcctagttccatccttcccaaaatccaccggagaagaagacgattagccggggaccacgccggagaaaaaaaaatgctgtcctccaccgctctccggccgctggcgcagcccgccacggccacggccacggccaccgccttctcggcctcccgcacggccgccgcggctgggcggcgcgggtcggcggcgggggtagtggttcgcgcggtgcggaactacgactcgatcccgaagcgggagcccttcagctcgagccgcagcgtcctcgacgagttcctcaggcaggagaagcctctcgtccagcgcaccaaagaccagatcacagattattgcacaaccctagaaggtgatgagtgctgcagctgttgggatgcttactttgaactcaataaacttgagcaagagctacccaaagaggaaattgcaaggatggtgaaggactccgagggagatccgaggtacctgatcaatagcatccatcaccgttcagatctaagaaagaagatggctgagaaatctcataattcactatcatcaaactccctggggcaagctgcgaagccaaggcctttccctgtgcctgacggattgccgaaaacacaggaagagcttgctgaagaacaggaggccctaatgccggagtcctcctatacgaggctactgagaagaatggggagatttcctgattggtatacgcctcgcccagatcatgaaaccgactgaatcaagtcaccaagcatccatataccgctccttgtgaaaattttgtattggttgccggataattatgatgcctgaagttctgtggtttgggtaatgcactaaggttcagcagcgtggtagctatccaggttagattgctgttgcttgctttactgaatgtataatggcgtgtgttttatgctgttcaggtcttcccctcaggattcagatagctccttccctgtaaactcaagcaatgtcccatgagatagcttgcacaaatttgtctttctgtatatatatgttctggaatagagtttctgaatctgtttcctggagttaatgatcaatcacctgttggatggatgatgaggatttcgatggttgtatcccagttgaacagagtatgcttgcagcacagttttgagttcagagaaaaatacagcgcaggccatgcctaaattgcaggcgatttcacttgtttcatcttggccacggaagaagagaattcagagagcaatcccgttctctcttttgcaggcgattctcgtttgcgtcatttttcaccgacgggcgatgacgtcagcagcgagaaactctt

SEQ ID NO: 3877 - DNA, 1041 bp, Oryza sativa
tagttccatccttcccaaaatccaccggagaagaagacgattagccggggaccacgccggagaaaaaaaaatgctgtcctccaccgctctccggccgctggcgcagcccgccacggccacggccacggccaccgccttctcggcctcccgcacggccgccgcggctgggcggcgcgggtcggcggcgggggtagtggttcgcgcggtgcggaactacgactcgatcccgaagcgggagcccttcagctcgagccgcagcgtcctcgacgagttcctcaggcaggagaagcctctcgtccagcgcaccaaagaccagatcacagattattgcacaaccctagaaggtgatgagtgctgcagctgttgggatgcttactttgaactcaataaacttgagcaagagctacccaaagaggaaattgcaaggatggtgaaggactccgagggagatccgaggtacctgatcaatagcatccatcaccgttcagatctaagaaagaagatggctgagaaatctcataattcactatcatcaaactccctggggcaagctgcgaagccaaggcctttccctgtgcctgacggattgccgaaaacacaggaagagcttgctgaagaacaggaggccctaatgccggagtcctcctatacgaggctactgagaagaatggggagatttcctgattggtatacgcctcgcccagatcatgaaaccgactgaatcaagtcaccaagcatccatataccgctccttgtgaaaattttgtattggttgccggataattatgatgcctgaagttctgtggtttgggtaatgcactaaggttcagcagcgtggtagctatccaggttagattgctgttgcttgctttactgaatgtataatggcgtgtgttttatgctgttcaggtcttcccctcaggattcagatagctccttccctgtaaactcaagcaatgtcccatgagatagcttgcacaaatttgtctttctgtatatatatgttctggaatagagtttctgaatctgtttcctggagtt

SEQ ID NO: 3878 - DNA, 1740 bp, Zea mays
aattgatgtccccaggccgcctccatccaacaccaagccacagccactggtcaccggtacactctgatccgaacaatggacgcgacgcaactgaaccgatcgatggacgccacgccgacgcggctcttccttggcgcgctcctcttcctcgtccccgccgcgctcctcctcctgctccgcgcgcggggcaggcgccgcctccccccgggcccgccgtccctgccgctgctcggcagcgtggtgtggctcaccaactcgcccgccgagatcgagcccctgctgcggcgcctcttcgagcgttacggccccgtcgtggcgctccgcgtcggggcgcgcttgtccgtcttcgtcgcggaccgccgcatcgcgcacgaggcgctcgttgaccgcggcgcgacgctggcggaccgcccggcgctcgcgtcggtcaagttcctcgacgagagcgacaacaccatcacccgcgccagctacgggcccgtgtggcgcctgctgcgccgcaatctcgtcgccgagacgctgcacccgtcgcgggtgaagctcttcgcgccggcccgtgcatgggtgcgccgcgtgctcgtcgagaagctcggggaggccgggcccgacgccgcgccgccccgcgtagtggagacgttccagtacgcgataaactgcctcctcgtgctcatgtgcttcggcgagcgccttgacgagcccgccgtgcgcgcgatcgcttctgcgcagcgggaggcactcatctaccgctccaagaacatgcaggtcttcgccttcctccctgccgtcaccaagcacctcttccgcgctcggctagataaagcgcgggcgctgcggcggcgcgtcaaggagctcttcgttccgcttatcaacgcgcgccgggagtacaagaagcggggagaggaaccgagaagggaaaccacgttcgagcactcgtacgtggacacgctgctcgacatcaagcttcacgaggacggcgatcgcccgctcaccgacgatgagattatcctcctatgctccgagttcctcgacgccggtacggacaccacgtccacagggctgcagtggatcatggccgagcttgtgaaaaacccagccatccaggagaagctctacagcgagatcaaggccgccacagacgacaacaaggaaggggtgtcagaggaggacgtccacagtatgccatacctcaaggcggtgatcctcgagggtctccggaagcacccgccggcccacttcgtgctgccgcacaaggcggcggaggaaatggagatcggcgggtacctgatccccaagggcacagttgtgaacttcatggtggccgagatgggccgggacgagcaggagtggaagaacccgatgcagttctcgccagagcggttcctccccggcggcgatggcgagggcgtggacgtgacgggcaccaaggcgatcaggatgatgccattcggcgtgggccggaggatctgcgcggggcttggtatcgccatgctgcacctggagtacttcgttgccaacatggtgcgggagtacgagtggaaggaggtgcccggcgacgaggtggacttcgccgagaagaacgagttcactgtcgtcatgaagaagccgctgcgcccgcgccttgtgcctaggaggtctcacttgaactagaaatactttacgtccattttctatcctacgttttcctcgttttgtgatgtatataaacatctcatagctataaaaaaaatacggttctacaat

SEQ ID NO: 3879 - DNA, 1726 bp, Sorghum bicolor
cacaacaagccacccgttccagcgccggccggccgcccgccggtacactctgatccgacccaatggacgcgacgcgactcttccttggcgcgctcctcctcctcctccccgccgcattcctcctcctgctccgcgcgcggggcaggcgccgcctccccccgggcccgccgtcgctgccgctgctcggcagcgtggtgtggctcaccaactcgcccgccgagaccgagcccctgctgcggcgcctcttcgagcgttacggccccgtcgtggcgctccgcatcggggcgcggctctccgtcttcgtcgccgaccgccgcatcgcgcacgaggcgctcgtcgaccgtggcgcagcgctggcggaccgcccggcgttcccggagggcaggttcctcggcgaggacgacaacatcatcacccgcgccagctacggtcccgtgtggcgcctcctgcgccgcaacctcgtcgccgagacgctgcacccgtcgcgggtgaggctcttcgcgccggcgcgcgcgtgggcgcgccgcgtgctcgtccacaagctcggcgagcccgggcccgacgccgcgcctcctcgcgtcgtggacacgttccagtacgctatgtttttcctcctcgtgctcatgtgcttcggcgagcgcctggacgagcccgcggtgcacgcgatcgcttccgcgctgcgggagccactcatctaccgctccaagaacatgcaagtcttcagcttcttgccggccgtcaccaagcacctcttccgcgcgcggctcgacaaagcgctggcgatgcggcggcgcatcaaggagctctttctcccgctcatcgacgcgcgccgggagtacaagaagcggccgggaggcgagccgccgaaaggggaaaccacgctcgagcactcgtacgtggacaccctgctcgacatgaagattgaagaggacggcgcccaacgcccgctcaccgacgatgagattatccgcctatgctccgagttcctcaacgccggcacggacaccacgtccacagggctgcagtggatcatggccgagcttgtcaaaaacccagccatccaggagaagctctacaacgagatcatggccgccaccgacgaagacaagcaggaaggggtcgcagaggaggacgtccacaagatgccatacctcaaggcggtgatcctcgaggccctccggaagcacccgccggcccacttcgtgctgccgcacaaggcggcggaggacatggaaatcggcgggtacctgatccccaagggcacgacggtgaacttcatggtggccgagatgagccgggacgagcaggaatggaagaacccgatggagttctcgccggagcggttcctccccggcggcgacggcgagggcgtggacgtgacgggcaccaaggcgatcaggatgatgccgttcggcgtgggccgtagaatctgcccggggcttggcatcgccatgctgcacctggagtacttcgttgccaacatggtgcgggagtacgagtggaaggaggtgcccggcgacgaggtggacttcgccgagaaaaatgagttcactgtcgtcatgaagaagcccctacgcccgcgccttgtgcctaggaggtctcacttgaagtcttgaactagaactactttactatactatgggaattgttattctccatgcacctaaaattaatggttgtttttggtcgacaatcgtgagccgttggatgagaaagcaacgatgca

SEQ ID NO: 3880 - DNA, 2159 bp, Sorghum bicolor
cagctatggaaccttctaccagtcaatgctacggagtacggattagggatggctccccgattctttacttgcaacttcttgctgatgaagaaataataatccgttgcttcccatataaatcgacggccgcaagctgcctccatccacccacaacaagccacccgttccagcgccggccggccgcccgccggtacactctgatccgacccaatggacgcgacgcgactcttccttggcgcgctcctcctcctcctccccgccgcattcctcctcctgctccgcgcgcggggcaggcgccgcctccccccgggcccgccgtcgctgccgctgctcggcagcgtggtgtggctcaccaactcgcccgccgagaccgagcccctgctgcggcgcctcttcgagcgttacggccccgtcgtggcgctccgcatcggggcgcggctctccgtcttcgtcgccgaccgccgcatcgcgcacgaggcgctcgtcgaccgtggcgcagcgctggcggaccgcccggcgttcccggagggcaggttcctcggcgaggacgacaacatcatcacccgcgccagctacggtcccgtgtggcgcctcctgcgccgcaacctcgtcgccgagacgctgcacccgtcgcgggtgaggctcttcgcgccggcgcgcgcgtgggcgcgccgcgtgctcgtccacaagctcggcgagcccgggcccgacgccgcgcctcctcgcgtcgtggacacgttccagtacgctatgtttttcctcctcgtgctcatgtgcttcggcgagcgcctggacgagcccgcggtgcacgcgatcgcttccgcgctgcgggagccactcatctaccgctccaagaacatgcaagtcttcagcttcttgccggccgtcaccaagcacctcttccgcgcgcggctcgacaaagcgctggcgatgcggcggcgcatcaaggagctctttctcccgctcatcgacgcgcgccgggagtacaagaagcggccgggaggcgagccgccgaaaggggaaaccacgctcgagcactcgtacgtggacaccctgctcgacatgaagattgaagaggacggcgcccaacgcccgctcaccgacgatgagattatccgcctatgctccgagttcctcaacgccggcacggacaccacgtccacagggctgcagtggatcatggccgagcttgtcaaaaacccagccatccaggagaagctctacaacgagatcatggccgccaccgacgaagacaagcaggaaggggtcgcagaggaggacgtccacaagatgccatacctcaaggcggtgatcctcgaggccctccggaagcacccgccggcccacttcgtgctgccgcacaaggcggcggaggacatggaaatcggcgggtacctgatccccaagggcacgacggtgaacttcatggtggccgagatgagccgggacgagcaggaatggaagaacccgatggagttctcgccggagcggttcctccccggcggcgacggcgagggcgtggacgtgacgggcaccaaggcgatcaggatgatgccgttcggcgtgggccgtagaatctgcccggggcttggcatcgccatgctgcacctggagtacttcgttgccaacatggtgcgggagtacgagtggaaggaggtgcccggcgacgaggtggacttcgccgagaaaaatgagttcactgtcgtcatgaagaagcccctacgcccgcgccttgtgcctaggaggtctcacttgaagtcttgaactagaactactttactatactatgggaattgttattctccatgcacctaaaattaatggttgtttttggtcgacaatcgtgagccgttggatgagaaagcaacgatgcaaaataggtcacttagccactgcactgttcatcttccacctcacgaccgcacgcaccagctgttcgtcacccccgccacccaccgtggccatggtagggtctcgtgggagctccatgtccgcgagaccataccgtgcctgcttggctgcttcgaccgccttcttccccccttctaccgctgtcatggcaatatgcctatctctcacaacaaatgagctagtagaaaagaatacaacgccgacgccctctttttataccacaagcgattttagttagagcatctcca

SEQ ID NO: 3881 - DNA, 2025 bp, Panicum virgatum
actcacgccacgcggcggcggttaccatcaccggcggcgccggtcaccctgccttatccaaccaggcgattcggcccgcaccagccatggacgcgccccagctcctcctcggggcgctcctcttcctcgtccccgccgcgctcctcctcctcggcctccaccgcgcggggggcaagcgcccgcgcctcccgccgggcccgccgtccctgccgctcctcggcagcgtggtgtggctcaccaactcgcccgccgagatcgagcccctgctgcggcgcctcttcgagcggcacggccccgtcgtggcgctccgcgtcggggcgcgcctctccgtcttcgtcgccgaccgccgcctcgcgcacgcggcgctcgtcgagcgcggcgccacgctggcggaccgcccggcgctcgcgtcggccaggctcctcggcgagaacgacaacaccatcacccgcgccagctacgggcccgtgtggcgcctcctccgccgcaacctcgtcgccgagacgctgcacccgtcgcgggtgaggctcttcgcgccggcccgcgcctgggtgcgccgcgtgctcgccgacaagctcggggaggcagcacccggcgcgccgccgccccgcgtcgtcgagacgttccagtacgccatgttctgcctcctcgtgctcatgtgcttcggcgagcgcctcgacgagcccgcggtgcgcgcgatcgccgccgcgcagcgggagtcgctcatctacatctccaggaacatgaccgtcttcgctttcttcccaccggtcaccaagcacctcttccgcgagcggctggacaaggcgcgggcactgcggcggcgcgtcaaggagctcttcctgccgctcatcaacgcgcggcgcgagtacaggaggcggggcggcgagccgaagacggaaaccacgttcgagcactcgtacgtggacaccctgctcgacatcaagctccacgaggacggcgatcgcccgctaaccgacgatgagatagtcctcctctgctccgagttcctcaacgccgggacggacaccacctccaccgggctgcagtggatcatggccgagcttgtgaagaacccagccatccaggacaagctctaccacgagatcaaagccgccaccgacgacgacaaggaagaggtctccgaggaggacgtccacaacatgccgtacctcaaggcggtgatcctggagggcctccggaagcacccaccgggccacttcgtgctgccgcacaaggcggcggaggacatggagatcggcgggtacctgatccccaagggcactacggtgaacttcatggtggccgagatgggccgggacgagcgggagtggaagaacccgatggagttctcgcctgagcggttcctccccggcggcgagggcgagggcgtcgacgtgacgggcacaaaggggatcaggatgatgccgttcggcgtggggcggaggatctgcgcggggctcggcatcgcgatgctgcacctggagtacttcgttgccaacatggtcagggagttcgagtggcaggaggtgcccggcgaggaggtggacttcgccgagaagaacgagttcaccaccgtcatgaagaagccgcttcgcccgcgcctggtgcccaggaggactcggagtgcgagtgctcactagcaaagtagcagtctaggattactgcgatccaatagcagagtggttctctggtttcttgctgtgtgatgtaaatatctattcagaatactgctcacgctagctgtgaagaattgcagtttcttaaaataatcagcagagatactgcaaagtttgtagcttggcttcatcttcatattgattgtggatgacttcgtgggtatggaaaatcagtaaatcactagcaaaactgtgccagttggacaacagagatgctcttggatagctgaattgttgctgaatttgtcttcagatgctcttgactcacaatttccgtcttgtgagcaatgagaagtttgtagcggacgagcggttcggttgaaatttcctgttcttgtttattttc

SEQ ID NO: 3882 - DNA, 1836 bp, Setaria italica
cgccctgatcagactccgcgaagagcacccacaggcggggatccacaggtaagcacgcgccagacatggacgcgccccagcacctcctcctcggcgcgctcctcttcctcctccccgccgcgctcctactcgtctgcgcgcgggggaagcgcctgcgcctcccgccgggcccgccgtccctgccgcttctcggcagcgtggtgtggctcaccaactcgcccgcagagatcgagcccctgcttcggcgcctcttcgaccggcacggccccgtcgtggcgctccgcgtcggggcgcgcctctccgtcttcgtcgccgaccgccgcctcgcccacgcggcgctcgtcgagcgcagcgccgcgctggcggaccgcccgcggctcgcgtccgtcaggctcctcggcgagaacgacaacaccatcacccgcgccagctacgggcccgtgtggcgcctcctgcgccgcaacctcgtcgccgagacgctgcaaccgtcgcgggtgaggctcttcgcgccggcccgcgcctgggtgcgccgcgtcctcgtcgacaagctcgaggagcccgggcccgacgcggcgccgccccgcgtcgtggagacgttccagtacgccatgttctgcctcctcgtgctcatgtgcttcggcgagcgcctcgatgagcccgcggtgcgcgcgatcgccgccgcgcagcgggagtcgctcatctacctctccaggaacatgaccgtcttcgccttcatcccggcggtcaccaagcacctcttccgcgcccgcctcgacaaggcacgggcgctgcggcggcgcatcaaggagctctacctgccgctcatcaacgcgcggcgcgagtacaggaagcggggcggcgagccgaagaaggaaaccacgttcgagcactcgtacgtcgacaccctgctcgacatcaagctccacgaggatggcgatcgcccgcttaccaacgatgagatcatcctcctctgctccgagttcctcaacgccgggacggacaccacctccaccggtctccagtggatcatggcggagcttgtcaagaacccaaaaatccaagagaagctctacgacgagatcaaagctgccaccaatgacgacaaggaagaggtctccgaggaggatgtccacaagatgccgtacctcaaggcggtaatcctcgagggcctccggaagcacccgccgggccacttcgtgctgccgcacaaggcggcggaggacatggagatcggcgggtacctgatccccaagggtaccacggtgaacttcatggttgccgagatgggccgggacgagcgggagtggaagaacccgatggagttctcgcctgagcggttccttcctggcggcgacggcgagggcgtggacgtgacgggcaccaagggcatcaggatgatgccgtttggcgcgggccggaggatctgcgcgggtctgggcatggccatgctccacctggagtacttcgtggcaaacatggtgcgggagttcgagtgggaggaggtgcccggcgaggaggtggacttcgccgagaagaacgagttcaccaccgtcatgatgaagccgctacgcccgcgccttgtgccgaggaggactcaaaagagtatgagtactcactagctatctagaattaccacgatacgtagcagagtgattctgtagtttcttgcttcgtgatgtaaatagcgatgaagggtactacacaataatagccgtcaagaattacagttcttcaataactggcagggagattgtaatgttcgtagattggtttcatgatttcatcttcgtgttgattgtggatgatttcgcgagtaatggaagatctctagcagac

SEQ ID NO: 3883 - DNA, 1598 bp, Setaria italica
ccagacatggacgcgccccagcacctcctcctcggcgcgctcctcttcctcctccccgccgcgctcctactcgtctgcgcgcgggggaagcgcctgcgcctcccgccgggcccgccgtccctgccgcttctcggcagcgtggtgtggctcaccaactcgcccgcagagatcgagcccctgcttcggcgcctcttcgaccggcacggccccgtcgtggcgctccgcgtcggggcgcgcctctccgtcttcgtcgccgaccgccgcctcgcccacgcggcgctcgtcgagcgcagcgccgcgctggcggaccgcccgcggctcgcgtccgtcaggctcctcggcgagaacgacaacaccatcacccgcgccagctacgggcccgtgtggcgcctcctgcgccgcaacctcgtcgccgagacgctgcaaccgtcgcgggtgaggctcttcgcgccggcccgcgcctgggtgcgccgcgtcctcgtcgacaagctcgaggagcccgggcccgacgcggcgccgccccgcgtcgtggagacgttccagtacgccatgttctgcctcctcgtgctcatgtgcttcggcgagcgcctcgatgagcccgcggtgcgcgcgatcgccgccgcgcagcgggagtcgctcatctacctctccaggaacatgaccgtcttcgccttcatcccggcggtcaccaagcacctcttccgcgcccgcctcgacaaggcacgggcgctgcggcggcgcatcaaggagctctacctgccgctcatcaacgcgcggcgcgagtacaggaagcggggcggcgagccgaagaaggaaaccacgttcgagcactcgtacgtcgacaccctgctcgacatcaagctccacgaggatggcgatcgcccgcttaccaacgatgagatcatcctcctctgctccgagttcctcaacgccgggacggacaccacctccaccggtctccagtggatcatggcggagcttgtcaagaacccaaaaatccaagagaagctctacgacgagatcaaagctgccaccaatgacgacaaggaagaggtctccgaggaggatgtccacaagatgccgtacctcaaggcggtaatcctcgagggcctccggaagcacccgccgggccacttcgtgctgccgcacaaggcggcggaggacatggagatcggcgggtacctgatccccaagggtaccacggtgaacttcatggttgccgagatgggccgggacgagcgggagtggaagaacccgatggagttctcgcctgagcggttccttcctggcggcgacggcgagggcgtggacgtgacgggcaccaagggcatcaggatgatgccgtttggcgcgggccggaggatctgcgcgggtctgggcatggccatgctccacctggagtacttcgtggcaaacatggtgcgggagttcgagtgggaggaggtgcccggcgaggaggtggacttcgccgagaagaacgagttcaccaccgtcatgatgaagccgctacgcccgcgccttgtgccgaggaggactcaaaagagtatgagtactcactagctatctagaattaccacgatacgtagcagagtgattct

SEQ ID NO: 3884 - DNA, 1522 bp, Setaria italica
ctcctcttcctcctccccgccgcgctcctcgtccgcacgcgggggaagcgcccgcgcctcccgccaggcccgccgtcgctgccgctgctcggcaacgtggtgtggctcaccaacacgcccgcagagatcgagcccctgcttcggcgcctcttcgaccggcacggccccgtcgtggcgctccgcgtcggggcgcgcctctccgtcttcgtcgccgaccgccgcctcgcccacgcggcgctcgtcgagcgcagcgccgcgctggcggaccgcccggggctcgcgtcggccaggctcctcggcgagaacgacaacaccatcacccgcgccagctacgggcccgtgtggcgactcctgcggcgcaacctcgtcgccgagacgctgcaaccgtcgcgggtgaggctcttcgcgccggcccgcgcctgggtgcgccgcgtcctcgtcgacaagctcgaggagcccggacccgacgcggcgccgccccgcgtcgtggagacgttccagtacgccatgttctgcctcctcgtgctcatgtgcttcggcgagcgcctcgatgagcccgcggtgcgcgcgatcgccgccgcgcagcgggagtcgctcatctacctctccaggaacatgacagtcttcgccttcatcccggcggtcaccaagcacctcttccgcgcgcggctcgacaaggcacgggcgctgcggcggcgcatcaaggagctctacctgccgctcatcaacgcgcggcgcgagtacaggaagcggggcggcgagccgaagaaggaaaccacgttcgagcactcgtacgtggacaccctgctcgacatcaagctccacgaggatggcgaccgcccgctcaccaacaacgagatcatcctcctctgctccgagttcctcaacgccgggacggacaccacatccaccgggctgcagtggatcatggcagagctcgtcaagaacccaaaaatccaagagaagctctacgtgccaccaatgacgacaaggaagaggtctccgaggaggacgtccacaagatgccgtacctgaaggcggtaatcctcgagggcctccggaagcacccaccgggccacttcgtgctgccgcacaaggcggcggaggacatggagatcggcgggtacctgatccccaagggcaccacggtgaacttcatggtggccgagatgagcagggacgaacgggagtggaagaacccgacggagttctcgccggagcggttcctcccgggcggcgacggcgagggcgtggacgtgacgggcaccaaggggatcaggatgatgccgttcggcgcggggcggaggatctgcgcggggatgggcatggccatgctgcacctggagtacttcgtggcaaacatggtgcgggagttcgagtgggaggaggtgcccggcgaggaggtggacttcgccgagaagaacgagttcaccaccgtcatgaagaagccgctacgcccgcgccttgtgccgaggaggactcaaaagagtatgagtactcactagctatctagaattaccac

SEQ ID NO: 3885 - DNA, 1537 bp, Setaria italica
gcgccgcagctcctcctcggagccctcctcttcctcctccccgccgcgctcctcgtccgcacgcggggcaagcagcgcccgcgcctcccgccaggcccgccgtcgctgccgctgctcggcagcgtggtgtggctcaccaacaccccctccgagatcgagcccctgctgcggcgcctcttccagcggcacggccccgtcgtggcgctccgcatgggggtgcgcctcaacgtcttcgtcgccgaccgccgcctcgcgcacgcggcgctcgtcgaggccggcgcggcgctcgcggaccgcccggcgctcgcgtcggccgggttcctcggcgagggcgacgccaccatctcccgcgccggctacgggcccgtgtggcgactcctgcggcgcaacctcgtcgccgagacgctgcacccgtcgcgggtgaggcagttcgcgccggcccgcgcctgggtgcgccgcgtgcttgccgagaagcttggggagcactccgggggccccgacgcgccaccgccccgcgtcgtggagacgttccagtacgccatgttctgcctcctcgtgctcatgtgcttcggcgagcgcctcgacgagcccgccgtgcgcgacatcgccgccgcgcagcgggaggcgctcatctaccgctctaggaacatgcccgtcttcgccttcctcccggcggtcaccaagcacctcttccgcgcgcggctcgacaaggcccgcgcgctgcggcggcgtgtcgacgagctcttcctgccgctcatcgacgcgcggcgcgagtacaagaacatgaagccgggcggccagccaaggaaggagaccacattcgagcattcgtacgtggataccctgctcgacatcaagctccacgaagacgatggcgaccgcccgctcactgacaacgagatcatcctcctctgctccgagttcctcgacgccgggacggacaccacatccaccgggctgcagtggatcatggcagagctcgtcaagaacccagccatccaggagaggctctacaacgagatcaaggctgccgccgacgacgacgacaaggaagaggtctccgaggaggacgtccacaagatgccgtacctgaaggcggtggtcctcgagggcctccggaagcacccaccggctcacttcgtgctgccgcacaaggccgcggaggacatggagatcggtgggtacctgatccccaagggcgcctcggtgaacttcatggtggccgagatgagcagggacgaacgggagtggaggaacccgacggagttctcgccggagcggttcctcccgggtggcgacggcgagggcgtggacgtgacgggcaccaaggggatcaggatgatgccgttcggcgtggggcgcaggatctgcgcggggatcggcgtcgccatgctgcacctcgagtacttcgtcgccaatatggtgcgggagttcgagtggcaggaggtgcccggccacgaggtggacttcgccgagaagaacgagttcaccgtcgtcatgaagaagccgctgcgcccgcgtctcgtgcccaggaggg

SEQ ID NO: 3886 - DNA, 1866 bp, Setaria italica
ccccaagcacatccaactcgcccattcggctacagcgatgtacataaacgccattggagaagcttaatcgcaccacgcctcccgctaatgccccaccgttgagcgccagccatggacgcgccgcagctcctcctcggagccctcctcttcctcctccccgccgcgctcctcgtccgcacgcggggcaagcagcgcccgcgcctcccgccaggcccgccgtcgctgccgctgctcggcagcgtggtgtggctcaccaacaccccctccgagatcgagcccctgctgcggcgcctcttccagcggcacggccccgtcgtggcgctccgcatgggggtgcgcctcaacgtcttcgtcgccgaccgccgcctcgcgcacgcggcgctcgtcgaggccggcgcggcgctcgcggaccgcccggcgctcgcgtcggccgggttcctcggcgagggcgacgccaccatctcccgcgccggctacgggcccgtgtggcgactcctgcggcgcaacctcgtcgccgagacgctgcacccgtcgcgggtgaggcagttcgcgccggcccgcgcctgggtgcgccgcgtgcttgccgagaagcttggggagcactccgggggccccgacgcgccaccgccccgcgtcgtggagacgttccagtacgccatgttctgcctcctcgtgctcatgtgcttcggcgagcgcctcgacgagcccgccgtgcgcgacatcgccgccgcgcagcgggaggcgctcatctaccgctctaggaacatgcccgtcttcgccttcctcccggcggtcaccaagcacctcttccgcgcgcggctcgacaaggcccgcgcgctgcggcggcgtgtcgacgagctcttcctgccgctcatcgacgcgcggcgcgagtacaagaacatgaagccgggcggccagccaaggaaggagaccacattcgagcattcgtacgtggataccctgctcgacatcaagctccacgaagacgatggcgaccgcccgctcactgacaacgagatcatcctcctctgctccgagttcctcgacgccgggacggacaccacatccaccgggctgcagtggatcatggcagagctcgtcaagaacccagccatccaggagaggctctacaacgagatcaaggctgccgccgacgacgacgacaaggaagaggtctccgaggaggacgtccacaagatgccgtacctgaaggcggtggtcctcgagggcctccggaagcacccaccggctcacttcgtgctgccgcacaaggccgcggaggacatggagatcggtgggtacctgatccccaagggcgcctcggtgaacttcatggtggccgagatgagcagggacgaacgggagtggaggaacccgacggagttctcgccggagcggttcctcccgggtggcgacggcgagggcgtggacgtgacgggcaccaaggggatcaggatgatgccgttcggcgtggggcgcaggatctgcgcggggatcggcgtcgccatgctgcacctcgagtacttcgtcgccaatatggtgcgggagttcgagtggcaggaggtgcccggccacgaggtggacttcgccgagaagaacgagttcaccgtcgtcatgaagaagccgctgcgcccgcgtctcgtgcccaggagggctcacagcacgaggacgagtactcactagctatctagaattatactacggctcaatgtcagagtgattctatggttcttgttttgtgatgtaaatatcgattcagagcattactcagtcgtcagtactcgctagctcccaaaaatgtcgaagtatcttcttcgatgggcaggtttcccttcaagaagaaaatttaccagtgtttcagatgca

SEQ ID NO: 3887 - DNA, 3658 bp, Zea mays
ttcttcttctcttccagaaggcccagccctccaccctccgggcaccagtgcgtgcgccgtcgacttcctctcaccttctcgctcctcgagaacgactccatagcgcaccacaccagcgcggcgacagacagcccgcgaggagaaaaggtagaagaggaggggcagggagagccatacatactcaccggttggattcggtccaatccaatccagccggccgcggcgtgaccagccgatccagagggcgccgaatcgatctgcgggggcggcgcggcgatgcggagggctaccgctggggatcccggtcgccgcgggggatgcgcatgagggcgtccggcccgcgaatcttctggtttggcgggagcccagggggcgcgcaccccggatcggcggcgcgcggcgcgggcaggatcgtgtcggtggggctgcggcagtgaccgcgggcgcgggggagggtgagaagcggcaactagcacttcgagtcgagcgggcgcgatggtgagcggccacatcttccactgccggaagaactcgtggccggcggaggagtacgtcggccggaccgcgctgcagctgttggatttcgatggcggggcgccgccggagcaggcgtggcggaggcggctcaacagccacgcgaacatcctcaaggagttcagtgtcactttcatggaggcaatgaggatgatgagccttggcctgagactatggtcgtatgttcgggaggaggcgtcacatggacggaaagcaccgatcgatccgttcacaaaagagcgctgtaaaccgtcagcttcccagggtgtgccacttggtgggatggggagcggaagcatttcgagaggtttcaggggagagttcaagaattggcacatcatacctggtctttgtgaaagttcgccgatatttgtatctcgagacgggggtaataagaaatactcatcagttttggctcctggacatcatgaaggtctgaagaaaaatagtgactctggaatttcttcatgggactggaatttaagtggtcaacactcgacctatcatgcattgttccctcgggcatggactgtttatgatggtgaacctgatccagaccttaaaatctcatgtcgtcaaatatcacctttcattcctcatgattacaaggatagcagtcttccaacatctgtatttgtgtatactctagtaaacactgggagagatcgtgcaaaagtaagcctgttaatgacatgggcgaattctattggaggtttttcgcataattcaggaggccactacaatgagcccttcataacagccaaggataatccacctgtcacttttgctgttgctgcctgcgaaactcagaatgtgaatgtgacagtcttgccagtgtttggtctttctggagaaaaccatgtttccgcaaaggaaatgtggaacaccatgctacagaatggtcactttgatcgggaaaatttcagtgctggtcccagtatgccttcttctccaggacagaaactctgtgcagctgtctcagcctcaacttgggttgagccacatggtagatgtactgttgtgtttgctctggcttggtcctcacctaaagtaaagtttcaaaaaggatgcacatataacaggaggtacacccaattctacggaacttctgagaaatcggctgttaatttggtacatgatgccttaacaaaatataaactttgggaagaagaaattgagaagtggcaaaaccccatactgaaggatgaaaggcttccagaatggtataagttcactctttttaatgagctttactttctggtagctggggggactgtttggacagatggtcaacccccagcaatcgatgagaaaaagagtcctggttttaatcaccagaagtcctcaaagaggggtactaaagacaccaatcagggatctgttaaagatagacatgtcaacctggcagtggagcaagtacctcatggtggttacatggctaatggtgatgatcacagtgtatccaagttcgcagcagttcatggatcagaaatgcaagaacaaatcaatggactcaagtcagaagagccaattccttacttgatttcaaaggatggccctgaacacgttggcaagtttttgtatctagaaggagtggaatacatcatgtggaacacatatgatgtgcatttctatgcatcttttgctctccttgatttgttcccaaaaatagagttgagtatccaacgtgattttgccaatgctgtgctgtatgaagatcggcgcaaagtaaaatttttggctgatggtacatccggaatccgcaaggttaaaggtgcagtgcctcatgacctcggaacgcatgatccgtggcatgaaatgaatgcatataacatacacgatacaagcaaatggaaagatttgaaccccaaatttgtgctccagatatacagagactttgctgctacaggtgatatgcaattcggtcgagatgtttggcctgcagtctgtgctgctatggactatatggatcagtttgaccgtgatggtgatggtctcattgagaatgatggatttcctgatcaaacctatgatgcttggactgttcatggaatcagtgcttactgtggttgtctttggcttgctgcacttcaagctgcagctacaatggctcatcgccttggggatcggcactttgctgagaagtacaagctcaagtttataaaagccaaagcagtatatgaggcgaagttatggaatgggtcatatttcaattacgacagcggcacaagtagcaacagtagatccattcaggctgatcagctggcaggacagtggtatgctgcctcgtcgggcttgcccccgcttttcgatgagcacaagataagaactgctctgcaaaaaatatttgaattcaacgtgatgaaggttaaaggaggacggatgggagctgtaaatggtatgactccaaagggaaaggtggacgagacatgcatgcaatcacgtgaaatctggactggtgttacatacgctgttgctgcaaatatgctgctccatggaatggagcatcaaggctttacgaccgcagaaggaatttttactgcgggatggtcagaagaaggatatgggtattggttccaaacaccagaaggatggaccacagatgggcattatagatccctcgtatacatgcggcctcttgccatttgggcgatccagtatgcagtttctcctcccaaggctattcttgaggcccccaaagttaacctaatggaccgaatacatatctcccctcacatggtccgagcaattagcgagataagcattagaaaggtagcacccgacaatagatgtttccctagctctgccttccactgtgaatgctgatccgaaggtaaacatgcagctgctgagcaacttgcaaccttttttttggcttttttcggtttctccttgccccccccccccctttcaaggtccaggtgggggggctcaggagttcttttcttggatcagagggcttatccaaaccaccaccaaactcgtgactcaagagagttcatgttgtataattgtacagcaaactgttagtcacataatctttttttttcactttgaaagttttgtgctgttcacttgaatagagctagaaataaaagaactgggaagctggtgtctacggcta

SEQ ID NO: 3888 - DNA, 3719 bp, Setaria italica
cgccggccagtcgatccccgaggggggcccgacgagtcgatccgcggaggcgcggggcgatgaggagcagcgctgccgggtgagcggcgcgtgagggcgtgtcccgcccgcggatcttctggattggttggagcgtggggggcgcgcgcctccgatcggcggcggctggcgtgggcaggatcgcgtgggggagggcggaggtgaggatcggtaggtggcatttggaggagcagcgggcgagatggtgagcggccacatcttccactgccggaagaactcgtggccggcggaggagtacgtcggccggaccgcgctgcagctgttggatttcgatggcggggcgccgccggagcaggcgtggcggcggaagctcaacagccacgcgaacctgctcaaggagttcagcgtcaccttcatggaggcaatgaggatgatgagccttggcctgagactctggtcctatgtacgggaggaggcatcgcatggaaggaaagctccgatcgatccattcacaaaagagcgctgtaggccgtcagcttcacagggtttgccacttggtgggatggggagtggtagcatttcgagaggtttcaggggagagttcaagaattggcacatcatacctggtctgtgcgagagttcgccggtcatggagaaccagttctcgatattcgtatctcgagatggagggaataagaaatactcatcagtgttggcccctggacatcatgaaggtttaaagaaaaacagcgactccggaatttcttcatgggactggaacttgagcggtcaacactcgacctatcatgcattgttccctcgggcatggaccgtttatgatggtgaaccagatccagaccttaaaatctcatgtcgccaaatatcaccattcattcctcatgattataaggatagcagccttccagcagctgtgtttgtgtacacgctagtgaacactgggaaagaccgtgcaaaagtaagcctgttaatgacatgggcgaactctattggaggtttttcacataattctggaggccactacaatgaacccttcattgcggaagatggagtatcaggagtgcttctgcatcacaaaacagctaaggataatccaccagtcacttttgctgttgctgcctgcgaaactcagaatgtaaacgtgacagtcttgccagtgtttggcctttctggagaaaaccatgtttcagcaaaggaaatgtggaataccatggtacaggatggccacttcaatcgggaaaattttagtgccggttccagtatgccttcttctccaggacagaaactctgtgcagctgtctcagcctcaacttgggtagagccacatggtagatgtacagttgtgtttgctctggcttggtcctcacctaaagtaaagttccagaagggatgcacttataacaggaggtacacccaattttatggaacttctgagagatcagctgttaatttggcacatgatgccttaacaaaatataaactttgggaagaaaaaattgagaagtggcaaaatcctatactcaaggatgaaagacttccagaatggtataagttcactctttttaatgagctgtactttctggtagctggggggacagtttggacagatggtcaacccccagcaatcgatgataaagcaaaccctggttcgaatcaacagaagtcctcaaaaaggggtagtaaagacaccaagacagagtctgttaaagatagccatgtcaacctgacagcggagcaagtccctgatagtggtcacatgactaatgatgacgagcgtagtgtatcgaaattcgcagcaattcatgggtcacaaatgcaagaacaaaccaatggaggactcaagtcggaagagccaattccttacttgatttccaaggatggccctgaaaatgttggcaagttcttgtatttagaaggagtggagtacatcatgtggaatacatatgatgtgcatttctatgcatcttttgctctccttgatttattcccaaaaattgagctgagtatccaacgtgattttgccaatgctgttttatatgaagatcggcgtaaagtcaaatttttggctgatggtacatcaggaatccggaaagctaaaggtgctgttcctcatgaccttggaacacatgatccgtggcatgaaatgaatgcatataacatacatgatacaagcaaatggaaagatctgaaccccaaatttgtgctccagatatacagagactttgctgccacaggtgatatgcaatttggcagagatgtctggcctgcagtctgtgctgctatggactatatggatcaattcgatcgtgatagcgatggcctcattgagaatgatggatttcccgatcaaacctatgatgcgtggactgttcatggaatcagtgcttactgtggtggtctctggcttgctgcactgcaagctgctgctacaatggcacatcgtcttggggatcggcactacgctgaaaagtacaagctcaagttcataaaagccaaagcagtatatgaggcaaagttatggaatggatcatatttcaattatgacagcggcacaagtagcaacagcaaatccatccaggctgatcagctggcaggccagtggtacactgcctcatcaggcttgcccccgctttttgatgagcacaagataagaactgctctgcagaaaatatttgaattcaatgtaatgaaggttaaaggaggacggatgggagctgttaatggtatgactccaaagggaaaggtggatgagacgtgcatgcaatctcgtgaaatctggactggtgttacatatgctgttgctgcaaatatgctgctccatggaatggagcatcaaggttttaccaccgctgaaggaatttttactgctggatggtctgaagaaggatatgggtattggttccagacaccagaaggatggaccacagatgggcattatcggtcgctcgtatacatgcggcctcttgccatttgggcaatccaatatgcattatctcctccaaaggcaatccttgaggccccaaaagttaatctaatggaccggatacatatatcccctcacatggttcgagcaattagcgagataagcattagaaaaatagcacctgacaatagatgtttccctagctctgcctttcactgtgaatgctgatacaaaggtaacatgcaactgctgagcaacttacaatcttttcagctttttggtttctccttgccccccttccaaggtccagtggggttcaggagttcttttcttgaatctgagggcatattcaaaccaccacaaaactcagcagctcgaatgagttttgttgtataattgtacagcaaagtgttaatcatataatctttgttttttcacttcgaaaatttcgcggtgccgatgtaaccaatatctgagctgcccggtgtagtgtagctgttgtagggaaacactgtgcatatagagaagtatggctctgttaactaatggagcacgaagcagttcacatgaagaaaagtaaagaacatggcgattctttgtattgtaatcatgtggtgctacgaactcaacactgcaaatgtgtcctggctgatgtgatcgatatgtgtactagaagaattgatgcctgttgtatttatcaggcatcaatcagttaagaaaatgagagttgtctatcgctgcgcctgcgtgcacaacgggggtttgatttgaatttgtg

SEQ ID NO: 3889 - DNA, 3413 bp, Panicum virgatum
ggaggagcgggcgcgatggtgagcggacacatcttccactaccggaggaactcgtggccggcggaggagtacgtcggccggaccgcgctgcagctgttggatttcgatggcggggcgccgccggagcaggcgtggcggcggaagctcaactgccacgccaacctgctcaaggagttcagcatcaccttcatggaggcaatgaggatgatgacccttggcctcagactgtggtcctatgtccgggaggaggcgtcgcatggaaggaaagctccgatcgatccattcacaaaagagcgctgtaggccgtcagcttcgcagggcgtgccgcttggtgggatggggagcggtagcatttcgaggggtttcaggggagagttcaagaattggcacatcatacctggtctttgtgagagtgcaccggtcatggagaaccagttctccatatttgtatctcgagatggggggaataaaaaatactcatcggtgttggctcctggacatcatgaaggtttgaagaaaaaaagtgactccggaatttcttcatgggactggaacttgagtggtcaacactcaacctatcatgcattgttccctcgggcatggacagtttatgatggtgaaccagatccagaccttaaaatatcgtgtcgccagatatcaccattcattcctcatgattacaaggatagcagtcttccgacatctgtgtttgtctacacgctggtgaacactgggaaagatcgtgcaaaagtaagcctgttaatgacatgggcgaactcaattggaggattttcgcataattcaggaggccactacaatgagcccttcattgcggaagacggagtatcgggagttcttctgcatcacaaaacagccaaggataatccaccagtcacttttgttgttgctgcctgtgaaacccagaatgtgaatgtgacagttttgccagtgttcggccttactggagaaaaccatgtttcagcaaaggaaatgtggaataccatggtacagaatggaaatttcaatcgggaaaatttcagtgctggtcccagtatgccttcttcaccggggcagaaactctgtgcagctgtctcagcttcaacttgggtagagccgcatggcagatgtactgttgcatttgctctggcttggtcctcacctaaagtaaagtttcagaaggggtgcacttataacaggaggtacacccaattttatggaacttctgagagatcagctgttaatttggtacatgatgccttaacaaaatataaactttgggaagaagaaattgagaaatggcaaaatcccatactcaaggatgaaagacttccagaatggtataagttcactctttttaacgagctttactttctggtagcggggggtacagtttggacagatggtcaacccccagcaatcgatgagaaagcaagccctggttccaagtcctcaaaaaggggcactaaagataccaaggtggaatctgttaaagatagccatgtcaacatgacagcagagcaagtccctgatagtggtcacatgactaatggtgacgagcgtagtgtatcaaagttcgcagcggttcatgggtcacaaatgcaagaacaaaccaatggaggactcaagtcggaagagcccattccttacttgatttccaaggatggccctgaaaatgttggcaagttcttgtatctagaaggagtggagtacatcatgtggaacacatatgatgtgcatttctatgcatcttttgctctcctcgatctattcccaaaaattgagctgagtatccaacgtgattttgccaatgctgttctgtatgaagatcagcgtaaagtcaaatttttggctgatggtgcatcaggaatccgcaaggttaaaggtgctgttcctcatgaccttggaacacatgatccttggcatgaaatgaatgcatacaacatacatgatacaagcaaatggaaagatctaaaccccaaattcgtgctccagatatatagagactttgctgccacaggtgacatgcaatttggtagagatgtctggcctgcagtctgcgctgctatggactacatggatcaatttgatcgtgatcatgatggcctcattgagaatgatggattccctgatcaaacctatgatgcatggactgttcatggaatcagtgcttactgtggttgtctctggcttggtgcacttcaagctgctgctacaatggcacaccgtcttggggatcggcactttgctgagaaatacaagctcaagtttataaaagccaaagcagtatatgaggcgaagttatggaatggatcatatttcaattacgacagtggcacaagtagcaacagcagatccatccaggctgatcagctggcaggccagtggtacactgcctcatcaggattgcccccgctttttgacgagcataagataagaactgctctgcagaaaatatttgaattcaatgtcatgaaggttaaaggagggcggatgggagctgttaatggtatgactccaaagggaaaggtggatgagacatgcatgcaatctcgtgaaatctggactggtgttacatatgctgttgctgcaaatatgctgctccatggcatggagcatcaaggttttaccaccgcggaaggaatttttattgctggatggtctgaagaaggatatggttattggttccagacaccagaaggatggaccacagatgggcattatcggtcgctcgtatacatgcgacctcttgccatttgggcgatccaatatgcactgtctcctccaaaggcaatccttgaggccccaaaagttaatttaatggaccggatacacatatccccccacatggctcgagcaattagcgagataagcattagaaaaatagcacccgacaatagatgtttccctagctctgcctttcagtgtgaatgctgatacaaaggtaacatgcaattgctgagcaacttgcaaccttttcgtcttttcggtttctccttgcccccgtttccaaggtccagtggaggttcgggagttctttccttgaatctgagggcatatccaaaccaccacaaaaactcagcggcgcgaaagagttgtataattgtacagaaacctgttaatcttataatctttttgttcactttgaaaatcttacggtgccgatgttacaaatatctgagctgccttgtgtagtgtagctgttctagggaaacacagtgcatatagagaagtatggctctatttactaatggagcacgaagcagttcacatggagagaagaactgggcaattctctgtactgtaatcatgtgtcgctacgaagaggtttcagtcctggctgatgtaattcatgtgtactggaagaaatcgatgcatcagttaagaaaatgagagctgtctatggctgcgtgtat

SEQ ID NO: 3890 - DNA, 3914 bp, Oryza sativa
cgaaacatgggcaacggacggactccccggaaattggtacggccacgcaataaatcgcacacgcccgtttgatttcttcttcccccacgcgcgtccgtgctttgcctgcgttctgcctacacacagccgcccttgccgaccgccaccgccgcaaccgcaaccaccttccttttctccaccctcttccttcctcttcccgcggcttcgcctcgcctcgcttcgcttcgcttcgcttcggagtccagcctcctcctccgctgacctcctcgcggtcttctcgtctccgcgtggagcaactgcctcccgcggcggcgcgcgcgggtgggtggagactggagagtcctctccgcgagaggctgcccgcttcggtttggttttgatctggtttggttgaatcgatcgagaggtggggaggggaggggagcagagggcggcatcggatcggaggagggcgcgatgaggaggaggggcggcgctgggggatcggatccgcgcgcatgattgcggcgcggcgcgggaggggatttgttcgtggatcgtgcctccgatcggcgggagttggatcgggggcgtggtggcattgggggtgagacgggatggtgagcggcaacctcttccactgccggaggaactcgtggccggccgaggagtacgtcggccgaaccgccctgcagttgttggacttcgacggcgggtcgcctccggagcaggcatggcggcggcgtctgaacagccacgccaacttactcaaggaattcagcgtcaccttcatggaagcaatgaggatgatgagccttggcctgaggctatggtcgtatgtccgagaggaggcttctcatggaaggaaagctccaattgatccgtttaccaaagagaaatgtaagccgtctgcttcgcagggcgtaccgcttggtgggatggggagtggtagcatttcaagaggtttcaggggagagttcaagaattggcatatcattcctggtttatgtgagacttccccggtcatggagaaccagttttcaatatttgtatctcgcgatggggggaacaaaaagtactcatcggtattgtctcccggacaccatgaaggtttaaagaaatgtaatgactctggaatttcttcatgggactggaacttgagcggtcaacattctacctatcatgctttatttcctagggcatggactgtttatgatggtgaaccggatccagaccttaaaatctcatgtcgtcagatatcaccattcattcctcatgattacaaagatagcagcctcccaacttctgtctttgtgtacactctagtgaacactgggaaagaccgtgcgaaagtgagcctgttaatgacatgggcgaattctatcggaggtttttctcatcactctggaggccattttaatgagcccttcattgcggaggatggagtttcaggagttcttctgcatcacaaaacagcaaaggataatcctccggttacttttgctattgctgcctgtgaaactcagaatgtgaatgtgacagtcttgcctgtatttggcctctctggagaaggccatgattcagccaagcaaatgtgggatagaatgaaacagaacggccactttgaccgtgaaaatttcgaagctggtaccagtatgccttcatcttcaggggagacactttgtgcagctgtctcagcatcaacctgggtagagccacatggtagatgtactgttgtatttggtttggcttggtcctctcctaaaataaagtttcagaagggctgcacatacaacaggaggtacactgaattttatggaacttctgaaagatcagctgttaatttggtacacgatgccttgacaaaatataggatttgggaagaggagattgagaagtggcaaaaccccatactcaagaatgaaaaacttccagaatggtacaagttcacactttttaatgagctttactttctggtagctgggggtactgtttggacagatggccaaccaccagttatcgatgaaaaaccaagtcctggttctaatcaacagaaatcttcaaaaaggggcactagagacactaaacaggaatcagttaaagataaccatgtcaaactgacagcagagcaagtcactaatggtggtgacctggctaatggcgaagagcaaagtgtgtcaaagtatgcagcagtacatggaccacaaatggctaaggcaaccaacggacttgggtcacaagagccaattccatacttgctttccaagaatggccctgaaaatgttggcaaatttttgtacctggaaggagtggaatacatcatgtggtgcacctatgatgtgcatttctatgcttcttttgctctgcttgatctgtttcccaaaatagagttgagtatccaacgtgattttgccaatgctgttctctatgaagacagacgaagaatgaaatttttggctgatggtacttctggaattcgcaaggtcaaaggtgccgttccgcatgacctaggaacacatgatccatggcatgaaatgaatgcgtacaacatacatgatacaagcaaatggaaagatctaaatccaaagtttgtgctccaggtatacagagacttcgctgctacaggtgatatgtcatttggtagagatgtttggcctgccgtctgtgcagtgatggactatatgaatcaatttgaccgtgacggtgatggtctcattgagaatgatgggtttcctgatcaaacctatgatgcttggactgtacacggaattagtgcttactgtggcggtctctggcttgctgcacttcaggctgcagctacaatggctcatcggcttggtgatcggccatttgctgaaaaatacaagctcaaattcatacaagcgaaagcagtatatgaggctaagttatggaatgggtcttacttcaattatgacagtggcacaagcagtaatagccgatctattcaggcggatcagctggcagggcagtggtatgctgcttcttcaggcttgcccccgcttttcgatgagaataaaataagaagtgctctgcagaaaatatttgaattcaatgtaatgaaggttaaaggaggacgattgggagctgtaaatggtatgactcctaatgggaaagtggatgagacatgcatgcaatctcgggaaatctggaccggtgttacatacggtgttgctgcaaacatgctgctccatggaatggagcatcaaggattcaccactgccgaaggaatttttattgctggttggtcagaagaaggatatgggtattggttccaaacaccggaaggctggaccatagacgggcactacaggtcgctcatctacatgcggcctctcgccatttgggcaatgcaatgggcacgttctccacccaaggcaatccttgatgcccccaaggtaaacctgatggacaggatacacctatccccacaaatgatccgggcaatgaacgagattaatgttagaaagatagcacccgacaatagatgtttccctagctctgcatttcgttgtgaatgctgaccacaaaaaaaaaagagaagcaaaatgcaacaactgagtagtaacatacatatatatactttccttttcggcttttccttggccccttacaagtttcagtggggttcatggggttttccttgaaatcagagggcatataaatctacggaaccactaagctcagtagctcacactctcacagctcgaaaagagctcttgttgtataattgtacagtaaactacaaaatcatatcgtcagcatcatctttgctctgcgtcaaaaagttttgtttacagactctttaactgatgtctgagcttccctttgcgggtatcaattccgagaaacacagtgtatatagattttacaatggacattccgtaatataatcgttaagcgagggatttattcta

SEQ ID NO: 3891 - DNA, 3836 bp, Oryza sativa
cttcccccacgcgcgtccgtgctttgcctgcgttctgcctacacacagccgcccttgccgaccgccaccgccgcaaccgcaaccaccttccttttctccaccctcttccttcctcttcccgcggcttcgcctcgcctcgcttcgcttcgcttcgcttcggagtccagcctcctcctccgctgacctcctcgcggtcttctcgtctccgcgtggagcaactgcctcccgcggcggcgcgcgcgggtgggtggagactggagagtcctctccgcgagaggctgcccgcttcggtttggttttgatctggtttggttgaatcgatcgagaggtggggaggggaggggagcagagggcggcatcggatcggaggagggcgcgatgaggaggaggggcggcgctgggggatcggatccgcgcgcatgattgcggcgcggcgcgggaggggatttgttcgtggatcgtgcctccgatcggcgggagttggatcgggggcgtggtggcattgggggtgagacgggatggtgagcggcaacctcttccactgccggaggaactcgtggccggccgaggagtacgtcggccgaaccgccctgcagttgttggacttcgacggcgggtcgcctccggagcaggcatggcggcggcgtctgaacagccacgccaacttactcaaggaattcagcgtcaccttcatggaagcaatgaggatgatgagccttggcctgaggctatggtcgtatgtccgagaggaggcttctcatggaaggaaagctccaattgatccgtttaccaaagagaaatgtaagccgtctgcttcgcagggcgtaccgcttggtgggatggggagtggtagcatttcaagaggtttcaggggagagttcaagaattggcatatcattcctggtttatgtgagacttccccggtcatggagaaccagttttcaatatttgtatctcgcgatggggggaacaaaaagtactcatcggtattgtctcccggacaccatgaaggtttaaagaaatgtaatgactctggaatttcttcatgggactggaacttgagcggtcaacattctacctatcatgctttatttcctagggcatggactgtttatgatggtgaaccggatccagaccttaaaatctcatgtcgtcagatatcaccattcattcctcatgattacaaagatagcagcctcccaacttctgtctttgtgtacactctagtgaacactgggaaagaccgtgcgaaagtgagcctgttaatgacatgggcgaattctatcggaggtttttctcatcactctggaggccattttaatgagcccttcattgcggaggatggagtttcaggagttcttctgcatcacaaaacagcaaaggataatcctccggttacttttgctattgctgcctgtgaaactcagaatgtgaatgtgacagtcttgcctgtatttggcctctctggagaaggccatgattcagccaagcaaatgtgggatagaatgaaacagaacggccactttgaccgtgaaaatttcgaagctggtaccagtatgccttcatcttcaggggagacactttgtgcagctgtctcagcatcaacctgggtagagccacatggtagatgtactgttgtatttggtttggcttggtcctctcctaaaataaagtttcagaagggctgcacatacaacaggaggtacactgaattttatggaacttctgaaagatcagctgttaatttggtacacgatgccttgacaaaatataggatttgggaagaggagattgagaagtggcaaaaccccatactcaagaatgaaaaacttccagaatggtacaagttcacactttttaatgagctttactttctggtagctgggggtactgtttggacagatggccaaccaccagttatcgatgaaaaaccaagtcctggttctaatcaacagaaatcttcaaaaaggggcactagagacactaaacaggaatcagttaaagataaccatgtcaaactgacagcagagcaagtcactaatggtggtgacctggctaatggcgaagagcaaagtgtgtcaaagtatgcagcagtacatggaccacaaatggctaaggcaaccaacggacttgggtcacaagagccaattccatacttgctttccaagaatggccctgaaaatgttggcaaatttttgtacctggaaggagtggaatacatcatgtggtgcacctatgatgtgcatttctatgcttcttttgctctgcttgatctgtttcccaaaatagagttgagtatccaacgtgattttgccaatgctgttctctatgaagacagacgaagaatgaaatttttggctgatggtacttctggaattcgcaaggtcaaaggtgccgttccgcatgacctaggaacacatgatccatggcatgaaatgaatgcgtacaacatacatgatacaagcaaatggaaagatctaaatccaaagtttgtgctccaggtatacagagacttcgctgctacaggtgatatgtcatttggtagagatgtttggcctgccgtctgtgcagtgatggactatatgaatcaatttgaccgtgacggtgatggtctcattgagaatgatgggtttcctgatcaaacctatgatgcttggactgtacacggaattagtgcttactgtggcggtctctggcttgctgcacttcaggctgcagctacaatggctcatcggcttggtgatcggccatttgctgaaaaatacaagctcaaattcatacaagcgaaagcagtatatgaggctaagttatggaatgggtcttacttcaattatgacagtggcacaagcagtaatagccgatctattcaggcggatcagctggcagggcagtggtatgctgcttcttcaggcttgcccccgcttttcgatgagaataaaataagaagtgctctgcagaaaatatttgaattcaatgtaatgaaggttaaaggaggacgattgggagctgtaaatggtatgactcctaatgggaaagtggatgagacatgcatgcaatctcgggaaatctggaccggtgttacatacggtgttgctgcaaacatgctgctccatggaatggagcatcaaggattcaccactgccgaaggaatttttattgctggttggtcagaagaaggatatgggtattggttccaaacaccggaaggctggaccatagacgggcactacaggtcgctcatctacatgcggcctctcgccatttgggcaatgcaatgggcacgttctccacccaaggcaatccttgatgcccccaaggtaaacctgatggacaggatacacctatccccacaaatgatccgggcaatgaacgagattaatgttagaaagatagcacccgacaatagatgtttccctagctctgcatttcgttgtgaatgctgaccacaaaaaaaaaagagaagcaaaatgcaacaactgagtagtaacatacatatatatactttccttttcggcttttccttggccccttacaagtttcagtggggttcatggggttttccttgaaatcagagggcatataaatctacggaaccactaagctcagtagctcacactctcacagctcgaaaagagctcttgttgtataattgtacagtaaactacaaaatcatatcgtcagcatcatctttgctctgcgtcaaaaagttttgtttacagactctttaactgatgtctgagcttccctttgcgggtatcaattccgagaaacacagtgtatatagattttacaatggacattccgtaatataatcgttaagcgagggatttattcta

SEQ ID NO: 3892 - DNA, 3695 bp, Brachypodium distachyon
cccaccacacccgcgaacacagctcagcagcagcaaaaagcacacgacaagcacgcgcgtgaattccactcgagggtttcgtttcgattctcgacttcgtcgtcggccgccgcagcgaatcgaggcgctgaggggcgacgggggctcggatccacgcgggcgcaagggctcatgaggcggcctgctacctgtggatctcctggtttcaccgcagcatcgagttcaggcctctgataggaccgcggccggcgcgtggcggatcgtactggggtgaggaagtagaggttgtggcactagaggacggggtggggggagatggtgagcggccatctattccactgtcgtaagaactcgtggccgccggaggagtacgtgggccgcagcgccttacaactgttggacttagacggcgctgctccgccggagcaggcatggcggcggcgactgaacagtcacgccaacatactcaaggaattcagcgtcacctttatggaagcaatgaaaatgatgagccttggggtgaggctttggtcatatgtccgtgaggaggcttcccatggaaggaaagctcctattgatccattcacaagagagagctgtaagccatcagcttcacagggtgtaccgctcggagggatggggagcggtagcatttcaagaggattcaggggagagttcaagaattggcacatcattcctggtttgtgtgagaattcgccggtcatggagaaccagttttctatttttgtatcacgggatggggggaataaaaaatgctcatcggtattggctcctggacaccatgatggtttaaagaaatatagcgactccggaatttcatcatgggactggaacttgagtggccaacattctacctatcatgcattgttccctagggcctggactgtttatgatggtgaaccagatccagaccttaaaatctcatgtcgccagatatcaccattcatacctcatgattacaaagaaagcagtcttcctacatctgtgtttgtgtacactctagtgaacactgggagagaccgtgcaaaagtaagcctgttaatgacatgggcgaactctattggaggtttttctcatcattcaggaggccacttcaatgagcccttcattggggaggatggagtgtcaggagtgcttctgcatcacaaaacagcaaaggataatcctccagttacttttgctatcgctgcctgtgaaacgcagaatgtgaacgtgacagtcttgcctgtatttggcctttctggagaaaatcatgtttccgcgaaggatatgtgggatatcatgaaaaaggatggccactttaatctggaaaatttcaatgctggctgtagtatgccttcctctcctggggagacactttgtgcggctgtcacagcctctacttgggtggagccacatggtaggtgtacagttgcgtttgctttgtcttggtcctcacctaaagtgaagtttcagaagggatgcacatataacaggaggtacactgaattctatggaacttctgaaagatcatctattaatttggttcatgatgccttaacaaaatatagactttgggaagaagagatcgagaagtggcaaaaccccatactcagggatgaaagacttccagaatggtacaagttcaccctttttaacgagctttactttctggtagctgggggtactgtttggacagatggtcaacctccagcgattgatgagaaaacaaatcctgcttctaaccagcagaaacattcaaaaaagcctataaaagataccaaatcggaatctgttaaagataaccttcccaggccaacagcagagcaagtctttaatggagatgacctgactaatggtggaccacagatgccagaacaaaccaatggacttagggtgcaagaaccagttccttgcatacactccaaggatggccctgaaaatgttgggaaattcttgtacctggagggagtggaatacatcatgtggaatacatatgatgtgcatttctatgcttcttttgctctccttgatttatttcccaaaatagagctgagtattcaacgtgattttgctgatgctgttctgtatgaagatcgccggagagtcaaatttctggctgatggtacctcaggaatccgcaaagtcaaaggtgctgttcctcatgacttgggaacacatgacccctggcatgaaatgaatgcatataacatacacgacacgagtaaatggaaagatctaaatcccaagtttgtactccaggtatacagagactttgctgccacaggtgatatgacgtttggtagagatgtctggcctgcagtctgtgctgcaatggactacatggatcagtttgatcgagatggtgatggtctcattgagaatgatggatttcctgatcaaacctatgatgcttggaccgttcacgggattagtgcgtactgtggttgtctctggcttgccgcacttcaagctgcagctacaatggcccatcgccttggggatcgtccatatgctgaaaagtacaagctcaagttcataaaagctaaagcagtgtatgaggctaagttatggaatggatcttatttcaattatgacagtggtacaagcagcaatagccgatccatccaggctgatcagcttgcaggacagtggtatgctgcatcgtcaggcttgcccccaatttttgacgagcacaaaataagaagtgctctacagaaaatatttgaattcaatgtaatgaaggtaaaaggaggacggatgggggctgtaaatggtatgactcctaaagggaaggtggacgagacatgcatgcaatctcgggaaatctggactggtgttacatacggtgttgctgctaacatgctactccatggaatggagcatcaaggttttatcaccgcggaaggaatatttcttgctgggtggtcagaagaaggctatgggtattggttccaaacaccagaaggatggaccacagatgggcattacaggtcactgatatacatgcgacctcttgctatctgggcgatgcagtgggcattatcgcccccaaaggcgatcctcgaggcacccaaggtaaacctgatggacaggatacacgtatcccctcaagcagcccgagcaatcagcgagataagcattagaaagattgcgcctgataacagatgtatttctagctccacgttccagtgtgaatgctgaccacgggaagaagataacatgcaacaactgagtttataacttcttttgatggattttccttggcccccgccaaggtccagtggggttcagggggttttccttggacaatagggaaagcaagcgttaatctcacagctcgatggagctcttgttgtataattgtacagtaaattgtaaaatcacatcatcggagagtttgcacatccttgtatccgatgtctgagcgtaccagtgttatcagttcactgcatagattacagagaaaggtaccccgccgtcctttatacaagaataactgtgctaacggatctgtgactgcatgacttctggaagaaggttggaaaagagcaacagaattttgcatgagatacaatctttctctagaaacgtcacgaactttgtgcaacgcgccaacgcctgtatatcggatccatcaaattttgtcttttggcatgagatacaacctttctctaaaattcttaataccttgt

SEQ ID NO: 3893 - DNA, 3910 bp, Brachypodium distachyon
cggcggcgggttcacacgtagccacttccttcctcccgtcccccttccaaaagttcagcctccgcttccccttctcatcatcttcctcgctgctgcttctccccaccacacccgcgaacacagctcagcagcagcaaaaagcacacgacaagcacgcgcgtgaattccactcgagggtttcgtttcgattctcgacttcgtcgtcggccgccgcagcgaatcgaggcgctgaggggcgacgggggctcggatccacgcgggcgcaagggctcatgaggcggcctgctacctgtggatctcctggtttcaccgcagcatcgagttcaggcctctgataggaccgcggccggcgcgtggcggatcgtactggggtgaggaagtagaggttgtggcactagaggacggggtggggggagatggtgagcggccatctattccactgtcgtaagaactcgtggccgccggaggagtacgtgggccgcagcgccttacaactgttggacttagacggcgctgctccgccggagcaggcatggcggcggcgactgaacagtcacgccaacatactcaaggaattcagcgtcacctttatggaagcaatgaaaatgatgagccttggggtgaggctttggtcatatgtccgtgaggaggcttcccatggaaggaaagctcctattgatccattcacaagagagagctgtaagccatcagcttcacagggtgtaccgctcggagggatggggagcggtagcatttcaagaggattcaggggagagttcaagaattggcacatcattcctggtttgtgtgagaattcgccggtcatggagaaccagttttctatttttgtatcacgggatggggggaataaaaaatgctcatcggtattggctcctggacaccatgatggtttaaagaaatatagcgactccggaatttcatcatgggactggaacttgagtggccaacattctacctatcatgcattgttccctagggcctggactgtttatgatggtgaaccagatccagaccttaaaatctcatgtcgccagatatcaccattcatacctcatgattacaaagaaagcagtcttcctacatctgtgtttgtgtacactctagtgaacactgggagagaccgtgcaaaagtaagcctgttaatgacatgggcgaactctattggaggtttttctcatcattcaggaggccacttcaatgagcccttcattggggaggatggagtgtcaggagtgcttctgcatcacaaaacagcaaaggataatcctccagttacttttgctatcgctgcctgtgaaacgcagaatgtgaacgtgacagtcttgcctgtatttggcctttctggagaaaatcatgtttccgcgaaggatatgtgggatatcatgaaaaaggatggccactttaatctggaaaatttcaatgctggctgtagtatgccttcctctcctggggagacactttgtgcggctgtcacagcctctacttgggtggagccacatggtaggtgtacagttgcgtttgctttgtcttggtcctcacctaaagtgaagtttcagaagggatgcacatataacaggaggtacactgaattctatggaacttctgaaagatcatctattaatttggttcatgatgccttaacaaaatatagactttgggaagaagagatcgagaagtggcaaaaccccatactcagggatgaaagacttccagaatggtacaagttcaccctttttaacgagctttactttctggtagctgggggtactgtttggacagatggtcaacctccagcgattgatgagaaaacaaatcctgcttctaaccagcagaaacattcaaaaaagcctataaaagataccaaatcggaatctgttaaagataaccttcccaggccaacagcagagcaagtctttaatggagatgacctgactaatggtggaccacagatgccagaacaaaccaatggacttagggtgcaagaaccagttccttgcatacactccaaggatggccctgaaaatgttgggaaattcttgtacctggagggagtggaatacatcatgtggaatacatatgatgtgcatttctatgcttcttttgctctccttgatttatttcccaaaatagagctgagtattcaacgtgattttgctgatgctgttctgtatgaagatcgccggagagtcaaatttctggctgatggtacctcaggaatccgcaaagtcaaaggtgctgttcctcatgacttgggaacacatgacccctggcatgaaatgaatgcatataacatacacgacacgagtaaatggaaagatctaaatcccaagtttgtactccaggtatacagagactttgctgccacaggtgatatgacgtttggtagagatgtctggcctgcagtctgtgctgcaatggactacatggatcagtttgatcgagatggtgatggtctcattgagaatgatggatttcctgatcaaacctatgatgcttggaccgttcacgggattagtgcgtactgtggttgtctctggcttgccgcacttcaagctgcagctacaatggcccatcgccttggggatcgtccatatgctgaaaagtacaagctcaagttcataaaagctaaagcagtgtatgaggctaagttatggaatggatcttatttcaattatgacagtggtacaagcagcaatagccgatccatccaggctgatcagcttgcaggacagtggtatgctgcatcgtcaggcttgcccccaatttttgacgagcacaaaataagaagtgctctacagaaaatatttgaattcaatgtaatgaaggtaaaaggaggacggatgggggctgtaaatggtatgactcctaaagggaaggtggacgagacatgcatgcaatctcgggaaatctggactggtgttacatacggtgttgctgctaacatgctactccatggaatggagcatcaaggttttatcaccgcggaaggaatatttcttgctgggtggtcagaagaaggctatgggtattggttccaaacaccagaaggatggaccacagatgggcattacaggtcactgatatacatgcgacctcttgctatctgggcgatgcagtgggcattatcgcccccaaaggcgatcctcgaggcacccaaggtaaacctgatggacaggatacacgtatcccctcaagcagcccgagcaatcagcgagataagcattagaaagattgcgcctgataacagatgtatttctagctccacgttccagtgtgaatgctgaccacgggaagaagataacatgcaacaactgagtttataacttcttttgatggattttccttggcccccgccaaggtccagtggggttcagggggttttccttggacaatagggaaagcaagcgttaatctcacagctcgatggagctcttgttgtataattgtacagtaaattgtaaaatcacatcatcggagagtttgcacatccttgtatccgatgtctgagcgtaccagtgttatcagttcactgcatagattacagagaaaggtaccccgccgtcctttatacaagaataactgtgctaacggatctgtgactgcatgacttctggaagaaggttggaaaagagcaacagaattttgcatgagatacaatctttctctagaaacgtcacgaactttgtgcaacgcgccaacgcctgtatatcggatccatcaaattttgtcttttggcatgagatacaacctttctctaaaattcttaataccttgtaaacgctaaaattcttatgtacgtgctgttttggtggatcactcggattgccaagttgcatgtaatagtgattctgaaaaaactgtcagtgcacttcatatttcttccttcaca

SEQ ID NO: 3894 - DNA, 3609 bp, Triticum aestivum
gcacgaggcttcgttccttcctcccctctcaaaaagttcagcctccacttcccctcctcgtcatcttcctcgcagctgcgcttctcccaccacacccgccaacacagcttagcagcagcaaaaagtggacctcgagcgagcaagcgcgcaaattccattccagggtttcgcttcgatcagactaggtccaatcgagccagcgcgcgcgggccctcgttagcggccgtgccggatcgattccaagaggacggccgtcgccggcggcggcggatcgaggcgcggagtctctgcgaagagcagcgccgggggctcggatccacgcgctcggaggagctcatgaggcggcctgccacctgtggatctcctggttccgcctcggcctccggttcgggcctctgctaggcggccggggcctgcgacggatcgcgcgggaggtgaggaggaggctgtggcattggagggtgagcggagatggtgagcggccacctattccactgccgtaagaattcgtggccgccggaggagtatgtgggccggaccgccctgcaactgttggacttggatggcgggtcgccgccggagcaggcatggcggaggaggctgaacagtcacgcgaacatactcaaggaattcagcgtcaccttcatggaagcaatgaagatgatgaccctcgggatgaggctttggtcatatgtccgtgaggaggcttcccatggaaggaaagctcccattgatccgtttacaagagagagatgcaagccgtcggcttcacagggtgtgccgctcggagggatggggagtggtagcatttcaagaggattcaggggagagttcaagaattggcacatcattcctggtttgtgtgagaattcgccggtcatggagaaccagttttctatatttgtatcacgagacagtgggaataaaaaatactcatcggtattggctcctggacaccatgaaggcttaaagaaaagtagtgactctggaatttcatcatgggattggaacctgagtggtcaacactctacctaccatgcattgtttcctagggcctggactatttacgatggcgagccagatccagaccttaaaatctcatgccgccagatatcaccattcattcctcatgattacaaggatagcagtcttccggcatctgtgtttgtgtacactctggtgaataccgggagagaccgtgcaaaagtgagcctgttgatgacatgggcgaattccattggaggtttttctcatcattcaggaggccacttcaatgaaccattcattggggatgacggagtgtcaggagtgcttttgcatcacaaaacagcaaaggataatcctccagttactttctctattgctgcctgcgaaactcagaatgtgagcgtgacagtcttgcctgtttttggtctttctggagagaaccatgcttcggcgaaggaaatgtgggataccatgtcaaaggatggccacttcaatcgggaaaatttcaatgctggttgtagtatgccttcttcttcaggggagacactttgtgccgctgtctcggcatcgacttgggtggagccgcatggtaggtgtactgtggcatttgctttggcttggtcctcacctaaagtgaagtttcagaaggggtgcacatataacaggagatacaccgaattttatggaacttctgaaagatcatcatctattcatttggtacatgatgccttaacaaaatatagactttgggaagaagagatcgagaaatggcaagaccccatactcaaggatgaaaaactcccagaatggtacaagttcaccctttttaacgagctttattttctggtagctgggggaactgtttggacagatggtcaacctccagcgtttagtgaaacaagtcctgcttaccaacataaacattcaaagaagggcactaaatcagaatcagttaaagataaccatgtcaagccagcagcagagcaagtcaatgatggagatgacctgcctaatggtgaagagcgaagcgtgtcaatgtatgcagcagttcatggatcacagatgcctgaacaaaccagtggacttaggtcgcaggaaccgattccttatctactttccaaggatggccctgaaaatgtcggtaaattcttgtacctggagggagtggaatacatcatgtggaacacgtatgatgtgcatttctatgcttcttttgctctccttgatttattccccaagatagagctgagtattcaacgcgattttgctgatgctgttctgtatgaagatcggcggagagtcaaatttttggctgatggcacctcaggaatccgtaaagtcaaaggtgctgttcctcatgacctaggaacacatgatccatggcacgaaatgaatgcctacaatatacatgatacaagcaaatggaaagatctaaatcccaagtttgtactccaggtgtacagagactttgctgccacaggtgatatgacatttggtagagatgtatggcctgcagtctgtgcagcaatggactacatggatcagtttgatcgcgattgtgatggtctcattgagaatgatggatttcctgatcaaacctatgatgcttggactgttcacgggatcagtgcctactgtggtggtctctggcttgctgcacttcaagctgctgctacaatggctcatcgtcttggggatcgtccatacgctgaaaagtacaagctgaagtttatgaaagctaaagcagtgtacgaggcaaagttatggaatgggtcttatttcaattatgacagtggtacaagcagcaatagccggtccattcaggctgatcagctcgcaggacagtggtacgccgcatcatcaggcttgcccccaatttttgatgagcacaaaataagaagtgctctgcagaaaatatttgaattcaatgttatgaaggtaaaaggaggacggatgggagctgtaaatggtatgactcccaagggaaaggtggatgagacatgcatgcagtctcgggaaatctggactggtgttacatacggtgttgcagcaaacatgctactccatgggatggagcatcaaggttttatcactgcggaaggaatatttcttgccggctggtcagaagatggatacgggtattggttccaaacaccggaaggatggaccacagatgggcattacaggtcgctggtatacatgcggcctcttgctatctgggcaatgcagtgggcattgtcacccccaaaggcgattctcgaggcacccaaggtaaacctgatggacagaatacatatatcccctcaagcagtccgagcagtcggtgagataggtgttcgaaagatcgcccccgataacagatgtattccgagctccacgttccagtgcgaatgctaaccacgggaagaaggtaacgtgtaacgactgatgagtaaatcatggtttttttccggcttttgcttgctcccctccgagatccagtggggttcaggtttttttttcctttacagtcagagggaatacctatgggacagttaaactcacagctccaaagagctcttgttgtataatttgtacagtgaactattacgtaacatattcaagaagtttgcgaaaaaaaaa

SEQ ID NO: 3895 - DNA, 3084 bp, Elaeis guineensis
ctccgtggagttgtgtagtcgtggtctcggtggaaaattttgtcctttgtctcgattttaaaagggggtcaggatggtgagcggacacctttttctgtgtcgaaaacactcgtggcctgcagaggaatatgttagcagaactacgttgcagttgctcgactttgatggaggtgcgccaccagagcaggcatggaggaggaggccaaatagtcatgctaacatactgaaggaattcagtgtgacatttatggaggcaattagaatgatgcgccttggtgttcgcctttggtcatacgtgagagaagaagcttctcaaggaaggaaagcacccattgatccatttacgcgagaaagatgtaagccctcagcttcccaaggggtaccgcttggaggaatgggaagtggaagcatctcaagaggtttcagaggggagtttaaacattggcagataattcctggttcatgtgaagcgtcacctgtcatgacaaatcagttctctatttttatatctcgagatggaggaaataaaaagtactcttcagttttagctcctggtcatcatgaagggataaagaaatttggtgatcagggcatttcatcatgggactggaatctaagtggtcagcattccacataccatgctttattccctagggcatggactgtttatgatggtgaaccagatcctgacctcaaaatctcatgtcgccagatatcaccatttataccacataattatcatgagagcagtctaccaacatctgtgtttgtgtacaccctagtaaatactggaagggaaagggcaaaagtcagtttgctgatgacctgggcgaattccattggaggagtttctcatcactctggaggccacatcaacgagccattcataggggaagatggagtatctggggtgcttctacatcacaagactgcaaaagataaccctcctgtaacttttgccattgctgcttgtgaaactcagaatgtgaatgtgactgtcttgccaaattttgggctttctggagaaaattgcgttacagctagagacatgtggggcaccatggtgcaggatgggcagtttgatcgtgaatatttcaatgctggccccagtgcgccatctgctccaggaagtacactttgtgcagcagtttcagcctctacatgggtagaaccacatggaagatgcactgttgcattcgctttggcctggtcatctcctaaagtaaagtttcagaagggatgttcatatcacaggagatacacaaaattttatggaacttcagaaagatcggccatcaatttggttcatgatgcattgatggggtataagtgttgggaggaagagattgagaaatggcaagatcctatactcaaggatgaaaagcttccagagtggtacaaattcactctttttaatgagctctactttctggttgccgggggaacagtttggacagatggtgaagctcccgtcagtaatgagaaacaaaatcctggttccaaccgccaaaaatcctcaaaaatagcaaaagaagatgccaatgctgtatctacaaaaagaagccatgtgaatttcgctatggagcagatttcttttgacactggactacacaatggtgatgagaaaatggtcccattgtcttcagcaggagatgattcggaagatagtgacaatttagatagccctgaatctctacaggctggacctcttctacacctgcatgatggtcccgaaaatgttgggaggtttctgtacttggaaggagtagagtatatcatgtggtgtacatatgatgtgcacttctatgcttcttttgctcttctggatctctttccaaaaattgagttaagtattcaacgagattttgcccaagctgttttgtatgaggacaggagaaaagtcaaatttctggctgatggtaactggggaatccgtaacgttaaaggtgccgttccccatgatctaggaacacatgatccatggcatgaaatgaatgcttacaacatacatgatacgagcaaatggaaagatctcaacccaaagttcgtactccaggtgtatagggattttgctgcaactggtgacacgtcatttggaagggacgtctggccagctgttcgagctgctattgattatatggaacaatttgatcgtgatgatgatggtctcatcgagaatgatggtttccctgatcaaacttatgatgcttggacagttcatggcatcagtgcgtactgtggatgtctttggctagctgcactccaagctgcagcagctatggctcatcgccttggggatcattctttttctgaaaagtgtaagattaaatttttgaaagctaaacctgtgtttgaagctaaattgtggaatggatcatacttcaattatgacagtggtacgagtagcaacagccggtctatacaggcagatcaacttgcaggggaatggtatactgcttcatcaggattgccctcacttttcgatgataataaaataagaagcactcttcagaaaatatttgaattcaatgtgatgaaggtgagaggaggacgaatgggggctgttaatggaatgcatcctaatggaaaggttgatgaatcttgcatgcagtcacgtgaaatttggactggggttacctatagtgtggccgctaccatgctgcttcatgggatggagcatcaagcatttaccacggcagaaggtatttttattgcaggctggtccgaagaaggatatgggtattggtttcagacccctgaagcatggactactgatggacactaccgctccctgatgtacatgcgcccacttgcaatatgggcgatgcaatgggccttgtctcctccaaaagcaatcattgaggctcccaaaataaatatgatggacaggatgtatatctctcccctcaatgttagagctgttcatgagatgggtgtgagaaaaattgcacctaaaagtagctgttttggcgatacggtatttcactgtgaatgctgatcagatagaacgtagggtggtgaattcactcgtcaggttcttggctttcctaacccttgaaaagagaagggttgggattttttttt

SEQ ID NO: 3896 - DNA, 1911 bp, Zea mays
aaattagcacaaagcgtcccaaaggaccgaactgtaaattcttaaaatcacgtgcgttcttcagtgttagttctccaccctctccttggcggaaaaccctaaccccctttctcggcgacgatccgacccctaccccatctcccggccgaccccacggcgctctccgccatgccggacgtgcaacctctcgtcagcgacttcgtcctcaagctcaagcgccggaaggtggaggggtcgcacgcggtggcccggcagacggcggagctgctacggtcggttgtgtcgcagcatcggatgggtagcagcgccaaccaggcggccacacttgccgatgccgtacgggctgtgggggagcagctcattgccgccaatcccattgagcttgctgttggaaacattgtgagacgtgttttgcatataataaaggaggaagatatatcttccacagcagttggtatcgaaggtctttctgttactgttgacagtgatgatgaatatgacagcgaacatgatgatcgccctgcattatctgctgctgttcttgctgcacatgctagaaatgcccttcgtgcaccttcattgcagactctgctagaagacattcctgtgagtcctgcaatttcccgcactgcatcatcaactggtgactcagacggaaaaagtaaatcagctggagataagagctcaactagaaaactgaagcatgatgtcatcgcagccattggtgatcttattgatgagattgactcatgctatgagccgatttctgagcaagctgtggaacttattcaccaaaatgaggtaatcctaactctaggtcgttctagaaccgtcaaggagttcctgtatgccgcgaaagaaaagaaacgatcttttcgtgtatttgttgctgaaggtgctccaagatatcagggccatgttctcgcaaaagagctggttgagaaaggtgtacaaactacagttataacagattcagcagtttttgctatgatatctcgagttaacatggtcatcgttggagcgcatgctatcatggcaaatggtggagtcattgcaccagtagggatgaacatggttgcacttgctgctcaaaggcatgctgtgccttttgttgtggttgctggtagtcacaagctgtgtccgttgtatccacacaatccagaagtgttgttgaatgaactcaaatcgccgtctgatttgctcgattttggcgagttctcagattgcatgaatttcagtactcaggatggcagccccttgttaaatgttgtcaacccaacatttgactatgtgccaccgaagcttgtgagcctattcatcactgacactgggggacacagtccatcttatatgtatcggcttattgctgagtattactcagctgatgacctggtagtgagacggaaggcaacatcttgaaggaagacaaaagcgctgcgaagtctccttggtgttctgatcataggatttgcgatcttattggaatcctagtgttcttgtactcgtcatgatctgttgcctgtagagcggtgctgctgtgataagtggaatcacctgtttgtggatccagttactgtcaaactgcaggaaatcgatgcaagcattctcgcgcatcgttgtaaccatggcggcattttaagtataaactgttgaggaatggagcgttacgtcatggaagaattgtttcactataggagaggttcaaatatatgattgactggttgtgtagagggtgtctgtttcttttctggtcataggttaatctgggccttggctggtccaaattttgaatgttataaactccagcaagctgttcgatatgtctatgaagtgttaccatgcacactgatgggtatttgctgagccattttgttttctatatctatcgtatatatatgatagtgctcattt

SEQ ID NO: 3897 - DNA, 3016 bp, Oryza sativa
tgcgaatatgcgatgcagcagcagaggaccaaattgtaaaatttccgcactgttgtagacagcatatctctctcgttccccttttgctctccgaaaaccctaacccctcgccgccgatccggccctcctccgccgctggccgccatgccggacgtgcagccgctcgtcagcgagttcgtcctcaagctcaagcgccgcaaggtggaggggtcccatgccgtggcgcggcagacggcggagctgctgcggtcggtggtgtcgcagcaccggatgggcagcaccaaccaggcggcggcgcttgcggacgccgtccgcggcgtcggggagcagctcatcgccgccaaccccatcgaacttgctgttggaaacattgtgagacgtgttttgcatataataaaagaagaggatatatcttctacagcagttggtattgaaggcctttctgtcaccgctgagagcgatgatgaatatgacagtggaaatgatgatcaccctaccttatctgctgctgtccttgctgcccatgctagaaatgcccttcgggcaccttcattgcagacacttctggaagatattcctgtgagcactgcgctttcacgttccgcatcgtcggctggggactctgatggaaaatctggagataagagctcaaaatctcggaaactcaagcatgatgttattgcagccattggtgatctaattgatgaaattgatacgtgctatgaccagatctctgagcaagccgtggaacatattcaccagaatgaagtaattctaactctaggccgctctagaacggtgaaagagtttctgtatgctgccaaagagaaaaagcgatcttttcgtgtatttgttgctgaaggtgctcccagatataagggtcatgttcttgcaaaagagctggttgagaagggtgtacaaactactgttataacagactctgcagtttttgctatgatctcccgtgttaacatggtcatagttggagcccatgcaattatggcaaatggtggagttattgcaccagtaggaatgaacatggttgctcttgctgctcaaaggcatgctgttccctttgttgtggttgctggcagtcacaagctatgtcctttgtatccacacaacccagaggttttactgaatgaacttaaatcaccatctgatctgctcgactttggcgagttctcaagttgcatgaacttcagtactcaggatggcactcctcttctgaatgttgtcaatccaacgtttgactatgtgccaccaaagcttgtgagccttttcatcactgatacgggagggcacagtccatcatacatgtaccgccttatcgctgagtattactcagctgatgatttggtagtgcggcggaagtcgacatcttcatagaacaaaaaaggcgcactagagtactttagtatgttggcattctgaaggtacaatctaggatgtacacaaatgctgttagagaggttgctgtcctcaatggaatcagctgttttgatctggaagttgaattctgtaattattaccaccgaaccgcaaccaagcattttgagtgtagactgtttgaggctatgggcgtgacggatgcctgattggaacatgaattgtataaactagagaaggaagctacatatgtgatgcagggtgtaaagtgtggatgttttcgagtccgtgcatcctgtgatctgccgagtccaaattttgtctgttcttgagtcccaaatgtttcatgccagtgttaaaagccaaacattgatggacttagctaaagaattttccttatatatgtgtatgtatgttctctaccacggcatatgtgagtttacaagtacagaaaactttagcttgcacattgctaatctctcaatgactcgtttcgtaatcatacaatctagtaccggcaattaggcataaaaaaactgtaaacttggaattcttccattctctttcagatggggatcggatcggatggactgcagcacgtcggactccggcgaggccggcgccgccatcggcggcagcgagaaccgcccgtacgtcgagctcccgctccggagctccttcatcgtcgccagcgcggcgacggtgttccggaagatgccctgctggtctgccatcggagccatcccggcgtcgccggagcatcctttccatgtccggcgatcgccggccatcgccgtcgtcgccacggaggaggtgaagatggcctccatggtggcctcgcagtcgcggacgagcctcgagatgagctccgtcgtgaagaacggctgccggagcaccttctcgatgaacggcagccggaggaggcggccggtgcgcttgtcgtatttcttcaggatcttggccagccctgcaatttcacagatcatcatcaataattcatcaccatgttcagcctctctggctgcgttcgtttcagcatggtcccaacccttatcctttgttatcggcgctgctaaacggtgtgatttttttagaagtttttatacgaaagttgttttaaaaaaatcaaattaatttattttttaaaaaagctaatacttaattaataatgtgctaataaactgttccgtttttcgcgcggagaaagtgggttccaacccagtaaggaacacagcctagtcacttaccgatcgatagggaagacgattagtctataatatttgtggataaacagatcatcatcgtgtctaactataatctatatggataaacagattgtctttaggttgcagttactgttctgtgcaaatgcactgaatgaattttgttgtgtagagaaaattttggctgtaatgtgcagcctgaagatactgttgactcacatggggacggctacgacaagtctcaagttgaacagtgatcaaatcataagaaaattttcaagtcaaaaaatcactgttagtgctacatccgtcctaaaataagtgtagccgtggatatccgtgcccaatgtttgaccgtccgtcttatttaaaaaatttgtaaaaaatttgaaaatatttagtca

SEQ ID NO: 3898 - DNA, 2302 bp, Oryza sativa
gcgatgcagcagcagaggaccaaattgtaaaatttccgcactgttgtagacagcatatctctctcgttccccttttgctctccgaaaaccctaacccctcgccgccgatccggccctcctccgccgctggccgccatgccggacgtgcagccgctcgtcagcgagttcgtcctcaagctcaagcgccgcaaggtggaggggtcccatgccgtggcgcggcagacggcggagctgctgcggtcggtggtgtcgcagcaccggatgggcagcaccaaccaggcggcggcgcttgcggacgccgtccgcggcgtcggggagcagctcatcgccgccaaccccatcgaacttgctgttggaaacattgtgagacgtgttttgcatataataaaagaagaggatatatcttctacagcagttggtattgaaggcctttctgtcaccgctgagagcgatgatgaatatgacagtggaaatgatgatcaccctaccttatctgctgctgtccttgctgcccatgctagaaatgcccttcgggcaccttcattgcagacacttctggaagatattcctgtgagcactgcgctttcacgttccgcatcgtcggctggggactctgatggaaaatctggagataagagctcaaaatctcggaaactcaagcatgatgttattgcagccattggtgatctaattgatgaaattgatacgtgctatgaccagatctctgagcaagccgtggaacatattcaccagaatgaagtaattctaactctaggccgctctagaacggtgaaagagtttctgtatgctgccaaagagaaaaagcgatcttttcgtgtatttgttgctgaaggtgctcccagatataagggtcatgttcttgcaaaagagctggttgagaagggtgtacaaactactgttataacagactctgcagtttttgctatgatctcccgtgttaacatggtcatagttggagcccatgcaattatggcaaatggtggagttattgcaccagtaggaatgaacatggttgctcttgctgctcaaaggcatgctgttccctttgttgtggttgctggcagtcacaagctatgtcctttgtatccacacaacccagaggttttactgaatgaacttaaatcaccatctgatctgctcgactttggcgagttctcaagttgcatgaacttcagtactcaggatggcactcctcttctgaatgttgtcaatccaacgtttgactatgtgccaccaaagcttgtgagccttttcatcactgatacgggagggcacagtccatcatacatgtaccgccttatcgctgagtattactcagctgatgatttggtagtgcggcggaagtcgacatcttcatagaacaaaaaaggcgcactagagtactttagtatgttggcattctgaaggtacaatctaggatgtacacaaatgctgttagagaggttgctgtcctcaatggaatcagctgttttgatctggaagttgaattctgtaattattaccaccgaaccgcaaccaagcattttgagtgtagactgtttgaggctatgggcgtgacggatgcctgattggaacatgaattgtataaactagagaaggaagctacatatgtgatgcagggtgtaaagtgtggatgttttcgagtccgtgcatcctgtgatctgccgagtccaaattttgtctgttcttgagtcccaaatgtttcatgccagtgttaaaagccaaacattgatggacttagctaaagaattttccttatatatgtgtatgtatgttctctaccacggcatatgtgagtttacaagtacagaaaactttagcttgcacattgctaatctctcaatgactcgtttcgtaatcatacaatctagtaccggcaattaggcataaaaaaactgtaaacttggaattcttccattctctttcagatggggatcggatcggatggactgcagcacgtcggactccggcgaggccggcgccgccatcggcggcagcgagaaccgcccgtacgtcgagctcccgctccggagctccttcatcgtcgccagcgcggcgacggtgttccggaagatgccctgctggtctgccatcggagccatcccggcgtcgccggagcatcctttccatgtccggcgatcgccggccatcgccgtcgtcgccacggaggaggtgaagatggcctccatggtggcctcgcagtcgcggacgagcctcgagatgagctccgtcgtgaagaacggctgccggagcaccttctcgatgaacggcagccggagga

SEQ ID NO: 3899 - DNA, 1906 bp, Brachypodium distachyon
ggaacagagagagtacatgtgaaggaggaggaccgaactgtaaattttgtaaacctgcagcgccccgttgaggaatttgtccttctctctgaaaaccctaagccccgccgtcttctccctcgccgccgatcggacccccaaatcctccgcctccgctcccacccgcgcgccgccatgccggacgtgcagcctctcgtcagtgagttcgtcctgaagctcaagcgccggaaggtggaggggtcgcatgctgtggcgcggcagacggcggagcttctgaggtcagtggtgtcacagcaccggatgggcagcactaaccaagcggccgccctcgccgacgccatccgctccgtcggggagcagctcatctccgctaatcccatcgagcttgcagttggaaacattgtgagacgtgttttgcatataataaaagaggaagatatatcttctacagcagttggtatcgaaggtctttctgtaactgttgacagtgatgatgaatatgacagtggaaatgatgaccatcctaccctatccgctgctgttcttgcttcccatgcgagaaatgccctccgtgcaccttcattgcagactctactggacgatattcctgtgagcactgcactttcacgttctgcatcatcaactggggattcagatgggaaaacagctggtgacaagagcttaaaaactcggaaactaaagcatgatgttattgctgccattggcgatcttattgaggagattgatacatgctatgaccagatttctgagcaagccgtggaacttattcaccagaatgaggtgatcctaactttaggtcgttcgagaaccgtgaaggagttcctgtatgctgctaaggagaagaagagatcttttcgtgtatttgttgctgaaggttctccaagatatcagggacatgttcttgctaaagagctggttgagaaaggtgtacagactactgttataacagattctgcaatttttgctatgatctcccgagttaacatggtcatagttggagctcatgcaataatggcaaatggtggagtcattgcacctgttgggatgaatatggttgctcttgctgctcaaaagcatgctgtaccctttgtcgtggttgcaggcagtcataagttgtgtcctttatatccacacaatccggaggttttactgaacgaacttaaatcaccatctgatttgctggactttggcgagttctcaaattgcatgaacttcagtacccaggatggtactccacttctaaatgttgttaatccaacatttgactacgtgccaccgaagcttgtcagtcttttcgtcaccgacactggcgggcacagtccatcatatatgtaccggcttatttctgaatactactcagctgatgatttggtagtacaacggaagtcaacatcttgaaagaacacaagccacattggactactggtgtgtgttaccattatgaagataatctgggacattgtttaaaccgaaatgatgttgccacactcatcgtggttcttcgttttgcctgtagtgtgtaggagattgctcacttgagtggaatcagctgttttccctttgtgtaagtgtaagtactatcaaattgtgcaagtactatcaaattgcaggaggtcaatgcaatcatgctccttgtgaaagttttaatgctgccttttttgggtacttctccgtccaacaaaggatgtctcaactttgactaaatttgaatgcatctatacactaagtcatgtctagatacaaccaaattttgacaaacttgagacatctttcgttggacgtttgttggacggagggagtacaatattgtctggacaattggttgggtcatgaccgattaatgatgaattgtttctttatggggaaaaatggatgaattgtttag

SEQ ID NO: 3900 - DNA, 1594 bp, Brachypodium distachyon
gaggaatttgtccttctctctgaaaaccctaagccccgccgtcttctccctcgccgccgatcggacccccaaatcctccgcctccgctcccacccgcgcgccgccatgccggacgtgcagcctctcgtcagtgagttcgtcctgaagctcaagcgccggaaggtggaggggtcgcatgctgtggcgcggcagacggcggagcttctgaggtcagtggtgtcacagcaccggatgggcagcactaaccaagcggccgccctcgccgacgccatccgctccgtcggggagcagctcatctccgctaatcccatcgagcttgcagttggaaacattgtgagacgtgttttgcatataataaaagaggaagatatatcttctacagcagttggtatcgaaggtctttctgtaactgttgacagtgatgatgaatatgacagtggaaatgatgaccatcctaccctatccgctgctgttcttgcttcccatgcgagaaatgccctccgtgcaccttcattgcagactctactggacgatattcctgtgagcactgcactttcacgttctgcatcatcaactggggattcagatgggaaaactggtgacaagagcttaaaaactcggaaactaaagcatgatgttattgctgccattggcgatcttattgaggagattgatacatgctatgaccagatttctgagcaagccgtggaacttattcaccagaatgaggtgatcctaactttaggtcgttcgagaaccgtgaaggagttcctgtatgctgctaaggagaagaagagatcttttcgtgtatttgttgctgaaggttctccaagatatcagggacatgttcttgctaaagagctggttgagaaaggtgtacagactactgttataacagattctgcaatttttgctatgatctcccgagttaacatggtcatagttggagctcatgcaataatggcaaatggtggagtcattgcacctgttgggatgaatatggttgctcttgctgctcaaaagcatgctgtaccctttgtcgtggttgcaggcagtcataagttgtgtcctttatatccacacaatccggaggttttactgaacgaacttaaatcaccatctgatttgctggactttggcgagttctcaaattgcatgaacttcagtacccaggatggtactccacttctaaatgttgttaatccaacatttgactacgtgccaccgaagcttgtcagtcttttcgtcaccgacactggcgggcacagtccatcatatatgtaccggcttatttctgaatactactcagctgatgatttggtagtacaacggaagtcaacatcttgaaagaacacaagccacattggactactggtgtgtgttaccattatgaagataatctgggacattgtttaaaccgaaatgatgttgccacactcatcgtggttcttcgttttgcctgtagtgtgtaggagattgctcacttgagtggaatcagctgttttccctttgtgtaagtgtaagtactatcaaattgtgcaagtactatcaaattgcaggaggtcaatgcaatcatgctccttgtgaaagtttt

SEQ ID NO: 3901 - DNA, 1485 bp, Avena sativa
ccggccttacgctgcgcgccgccatgccggatgtgcagccgctcgtcagcgacttcgtcctcaagctcaagcgccgtaaggtggagggctcgcatgccgtggcgcggcagacggcggagctgctgaggtcactggtgtcgcagcaccggatgggcagcactaaccaagcggcagctctcgccgacgccatccgcgccgtcggggagcatctcatagcagccaatcccatcgagcttgctgttggaaacattgtgagacgtgtcttgcatataataaaagaagaagacatatcttctacagcagttggtatcgaaggtctttctgttacagctgtcagtgatgatgaatatgatagtggaaatgatgaccgtcctaccttatcggctgctgttcttgcgtcccatgctagaaacactcttcgggcaccttcattgcagaccctcctggatgatattcctgtgagcactgcactttcacattctgcatcatcagctggggattcagatggaaaagctggagataagagcttaaaaactcggaaattaaagcacgatgttattgctgccattggtgaccttattgaggagatagatacatgttatgaccagatatctgagcaagctgttgaacttattcaccaaaatgaggtcatcctaactctaggtcgttcgagaaccgtgaaagagttcctgtatgctgcaaagaaaagaagcgatcttttcgtgtatttgttgctgaaggtgctccaagataccagggacatgttcttgcgaaagaactggttgagaaagggatacagactactgttattactgattcagctgtttttgctatgatctcccgagttaacatggttatcgttggagctcatgcaataatggcaaatggtggagtcatagcaccaatagggatgaatatggttgctcttgctgctcaaaggcatgctgtgccttttgttgtggttgctggtagtcacagttgtgtcctctatatccacacaacccggaggttttactcaatgaacttaaatcaccatctgatttgcttgactttggcgagttctcgaattgcatgaacttcagtactcaggatggtactcctcttctaaatgttgtcaatccaacattcgactacgtgccaccgaagcttgtcagcctctttgtcaccgataccggcggtcatagtccatcatatatataccggcttatttctgagtactattcagctgatgatttggtagtacggcggatgtcaacatcttgaaagaacacaggacacagaggactactctcatgtgttatcattatgaagataatatgggatcttgtttaaacccaaatgatgttcccaaagtcattgcaattcctcattttgcttgtagagttgaagaggctgccctctcggctggtttgccctggaagctcaattgtgtaagtactgttatattgcaggagattaatgcaagcatgctcgttgagaggattt

SEQ ID NO: 3902 - DNA, 1515 bp, Avena sativa
tcccggccttacgctgcgcgccgccatgccggatgtgcagccgctcgtcagcgacttcgtcctcaagctcaagcgccgtaaggtggagggctcgcatgccgtggcgcggcagacggcggagctgctgaggtcactggtgtcgcagcaccggatgggcagcactaaccaagcggcagctctcgccgacgccatccgcgccgtcggggagcatctcatagcagccaatcccatcgagcttgctgttggaaacattgtgagacgtgtcttgcatataataaaagaagaagacatatcttctacagcagttggtatcgaaggtctttctgttacagctgtcagtgatgatgaatatgatagtggaaatgatgaccgtcctaccttatcggctgctgttcttgcgtcccatgctagaaacactcttcgggcaccttcattgcagaccctcctggatgatattcctgtgagcactgcactttcacattctgcatcatcagctggggattcagatggaaaagctggagataagagcttaaaaactcggaaattaaagcacgatgttattgctgccattggtgaccttattgaggagatagatacatgttatgaccagatatctgagcaagctgttgaacttattcaccaaaatgaggtcatcctaactctaggtcgttcgagaaccgtgaaagagttcctgtatgctgcaaagaaaagaagcgatcttttcgtgtatttgttgctgaaggtgctccaagataccagggacatgttcttgcgaaagaactggttgagaaagggatacagactactgttattactgattcagctgtttttgctatgatctcccgagttaacatggttatcgttggagctcatgcaataatggcaaatggtggagtcatagcaccaatagggatgaatatggttgctcttgctgctcaaaggcatgctgtgccttttgttgtggttgctggtagtcacagttgtgtcctctatatccacacaacccggaggttttactcaatgaacttaaatcaccatctgatttgcttgactttggcgagttctcgaattgcatgaacttcagtactcaggatggtactcctcttctaaatgttgtcaatccaacattcgactacgtgccaccgaagcttgtcagcctctttgtcaccgataccggcggtcatagtccatcatatatataccggcttatttctgagtactattcagctgatgatttggtagtacggcggatgtcaacatcttgaaagaacacaggacacagaggactactctcatgtgttatcattatgaagataatatgggatcttgtttaaacccaaatgatgttcccaaagtcattgcaattcctcattttgcttgtagagttgaagaggctgccctctcggctggtttgccctggaagctcaattgtgtaagtactgttatattgcaggagattaatgcaagcatgctcgttgagaggatttaattttacggttttcttttttcttgtcc

SEQ ID NO: 3903 - DNA, 1789 bp, Secale cereale
ggacgtgtccttttctggagtcgccctaacttcttctctctcgaaaccctaagcccctctccctccgccgatccgaccccaaatccgaacgcctctgcatcccggtccaagccgcacgccactatgccggacatgcagccgctcatcagcgacttcgtcctcaagctcaagcgccgtaaggtggaggggtcacatgccgtggcgcggcagacggcggagctgctgaggtcagtggtgtcacagcaccggatgggcagcaataaccaaggggcggctctcgccgacgccatccatgccgtcggggagcatctcatcgcagccaatcccatcgagcttgctgttggcaacactgtgagacgtgttctgcatataataaaagaggaagatatatcttctaccgcagttggtattgaaggtctttctgtgactgctgtcagcgacgatgaatgtgacagtggaaatgatgaccgtcctaccttatccgctgctgttcttgcttcccatgctagaaacgctcttcgggcaccttcattgcagactctcctggatgatattcctgtgagcactgcactttcacattcttcgtcatcagctggggattcagatgggaaaactggagataagagcttaaaaactcggaaactaaaacatgatgttattgctgccattggtgatcttatcgaggagattgatacatgttatgaccagatttctgagcaagctgtcgaacatatccaccaaaatgaggtcatcctaactctaggtcgttctagaactgtgaaagagttcctgtatgctgcaaaggagaagaagcgatcttttcgtgtatttgttgctgaaggtgctccaagatatcagggacatgttcttgcgaaggagctggtcgagaaaggtgtacagactactgttataacagattcagcagtttttgctatgatctcccgagttaacatggttatagttggagtccatgcaataatggcaaacggtggagtcattgcaccagtagggatgaatatggttgctcttgctgctcaaaggcatgctgtaccctttgtcgtggttgctggcagtcataagctgtgtcctttgtatccgcacaacccggaggttttactgaacgagcttaaatcaccatctgatttgcttgactttggcgagttctcaaattgcatgaacttcagtactcaggatggtactcctcttctaaatgttgccaatccaacgtttgactatgtgccaccaaagcttgtcagccttttcatcactgatactggcgggcacagtccatcatatatgtaccggcttatttcggagtactactcagctgatgatttggtcgtacggcggaagtcaacatcttaaaagaacacaaggcacggtggactactcgtgtgttaccattatttatatgaagataatgtggggtcttgttgaagcccaaatgatgttgccacaaccattgcagttcttccttttgcctgtatgtacggttggacggggctgctctcttcagtgtaatcgtctgttttccccgggaagttcaacatcatgctccttgtgataatttaattttgtggcttccttttctgttaagttcaacatcatgctccttgtgataatttaattttgtggcttctttttctgtgtaaacggctgaggcaatgagcgccaagcgcaaccggttaatctatatgaattgtattaactgtagaagctagatacaacatgtgatgcagaatgcagtgttgcagtttgaaggaaagagtagagagctggtttagcacag

SEQ ID NO: 3904 - DNA, 1768 bp, Triticum aestivum
ggtacgtgtccttttctggagttgccctaacttctccttctctctggaaaccctaagccccttctccctcctaagccgccgatccgaccccaaatccgaacgcctctgcctcccggtccaagccgcacgccactatgccggacatgcagccgctcatcagcgacttcgtcctcaagctcaagcgacgtaaggtggaggggtcacatgctgtggcccggcagacggcggagctgctgaggtcagtggtgtcgcagcaccggatgagcagcactaaccaagcggcggctctcgccgacgccatccatgccgtcggggagcatctcatcgcagccaatcccatcgagctcgctgttggcaacactgtgagacgtgttttgcatataataaaagaggaagatatatcttttaccgcagttggtattgaaggtctttctgtgactgctgtcagtgacgatgaatgtgacagtggaaatgatgaccgtcctaccttatccgctgctgttcttgcttcccatgctagaaacgctcttcgggcaccttcattgcagactctcctggatgatattcctgtgagcactgcacttacacattcttcatcgtcagctggggattcagatgggaaaactggagataagagcttaaaaactcggaaactaaaacatgatgttattgctgccattggtgatcttattgaggagattgatacatgttatgaccagatttctgagcaagctgtcgaacatatccaccaaaatgaggtcatcctaactctaggtcgttctagaaccgtgaaagagttcctgtatgctgcaaaggagaagaagcgatcttttcgtgtatttgttgctgaaggtgctccaagatatcagggacatgttcttgcgaaggagctggtcgagaaaggtgtacagactactgttataacagattcagcagtttttgctatgatctcccgagttaacatggttatagttggagtccatgcaataatggcaaacggtggagtcattgcaccagtaggtatgaatatggttgctcttgctgctcaaaggcatgctgtaccctttgtcgtggttgctggcagtcataagttatgtcctttgtatccgcacaacccggaggttttactgaacgagcttaaatcaccatctgatttgcttgactttggcgagttctcaaattgcatgaacttcagtactcaggatggtactcctcttctaaacgttgccaatccaacgtttgactatgtgccaccgaagcttgtcagccttttcatcactgatactggcgggcacagtccatcatatatgtaccggcttatttcggagtactactcagctgatgatttggtcgtacggcggaagtcaacatcttaaaagaacacaaggcacggtggactactcgtgtgttaccattatttatatgaagataatgtggggtcttgttgaagcccaaatgatgttgccacaaccattgcagttcttccttttgcctgtatgtagggttggacggggctgctctcttcagtgtaataggctgtttccccctggaagttcagttgtgtaacatcatgctccttgtgataatttaattttgtggcttctttttctgtgtaaacggctgaggcaatgagcgccaagcgcaaccgtctaatctatatgaattgtattaactgtagaagctagatacagtatgtgacgcagaatgcagtgttgcggtttgaaggaaagagtagagggctggtttagcaaaaaaaaaaaaaaaacga

SEQ ID NO: 3905 - DNA, 1739 bp, Hordeum vulgare
atctccttctgtctcgaaaccctaagccctctcccttccaagccgccgatccgcccccctctgccttccggttgaagccgcacgccactatgccggacatgcagccgctcatcagcgacttcgtcctcaagctcaagcgccgtaaggtggaggggtcacatgccgtggcgcggcagacggcggagctgctgaggtcagtggtgtcgcagcaccggatgggcagcactaaccaagcggcggctctcgccgacgccatccatgccgtcggggagcatctcatcgcagccaatcccatcgagctcgctgttggcaacactgtgagacgtgttttgcatataataaaggaggaagatatatcttttactgcagttggtattgaaggtctttctgtgacagctgtcagcgatgatgaatgtgacagtggaaatgatgaccgtcctaccttatctgctgctgttcttgcttcccatgctagaaacgctcttcgggcaccttcattgcagactctcctggatgatattcctgtgagcactgcactttcacattcttcatcatcagctggggattcagatgggaaaactggagataagagcttaaaaactcggaaactaaaacatgatgttattgctgccattggtgatcttattgaggagattgatacatgttatgaccagatttctgagcaagctgtcgaacatatccaccaaaatgaggttatcctaactctaggtcgttctagaactgtgaaagagtttctgtatgctgcaaaggagaagaagcgatcttttcgtgtatttgttgctgaaggtgctccaagatatcagggacatgctcttgcgaaggagctggtcgagaaaggtgtacagactactgttataacagattcagcggtttttgctatgatctcccgagttaacatggttatagttggtgtccatgcaataatggcaaacggtggagtcattgcaccagtagggatgaatatggttgctcttgctgctcaaaggcatgccgtaccctttgtcgtggttgctggcagtcataagctgtgtcctttgtatccgcacaacccggaggttttactgaatgagcttaaatcaccatctgatttgcttgactttggcgagttctcaaattgcatgaacttcagtactcaggatggtactcctcttctaaatgttgccaatccaacgtttgactatgtgcctccgaagctcgtcagccttttcatcactgatactggcgggcacagtccatcatatatgtaccggcttatttcggagtactactcagctgatgatttggtagttcggcggaagtcgacatcttaaaagaacacaaggcacggtggactactcgtgtgttaccatttatatttatgaagataatgtggggtcttgttgaagtccaaatgatgtcgtcacaaccattgcagttcttctttttgcctgtatgtaggttggatgggctgctctcttcagtgtattcgcctgttttcccctggaagttcagttgtgtaacatcatgctccctatgataatttaattttgtggcatgtttttctgtgtaaacggctgaggcaatgagcgccaagcgcaacctttaatcggtgagttgtattaactgtagaagctagatacagtaagtgatgcagaatgcagtgtcacagtttgaagaaaagagtagcgagctgggttagcacagattttgtctgctctgatccaaaaaaaaaaaaaaaa

SEQ ID NO: 3906 - DNA, 1513 bp, Panicum virgatum
gctcgctgatgccgtacgcgccgtcggggagcagctcatcgccgccaatccaatcgagcttgctgttggaaacattgtgagacgtgttttgcatataataaaagaggaggatatatctgctacagcagttggtattgaaggcctttctgttactgttgacagtgacgatgaatatgacaatgaacgtgatgatcgcccttcattgtctgctgctgttcttgctgcacatgctagaaatgctcttcgtgcaccttctttgcagactctcctagaagatattcctgtgagtcctgcaatttcacgcactgcgtcatcaactggggactcagacggaaaaatcagctggagataagagctcaactaggaaactgaagcatgatgtcattgcagccattggtgatcttattgatgagattgactcatgctatgagccgatttctgagcaggctgtggaacttattcaccaaaatgaggtaatccttactttaggtcgttctagaactgtcaaggagtttctgtatgctgcaaaggagaagaagagatcttttcgtgtatttgttgcagaaggtgctccaagatatcagggccatattcttgcaaaagaactggttgagaaaggtgtacaaactactgttataacagattcagcagtttttgctatgatctctcgagttaacatggtcatagttggagctcatgctgtaatggcaaatggtggagtcattgcaccagtagggatgaacatggttgcacttgctgcccaaaggcatgctgtgccctttgttgtggttgctggtagtcacaagttgtgtcctttgtatccacacaacccagaggtgttgctgaatgagcttaaatcaccgtctgatttgctcgacttcggcgagttttcagattgtatgaatttcagtactcaggatggtagtcccctactgaatgttgtcaacccgacatttgactatgtgccgccgaagcttgtgagcctattcatcactgatactggagggcatagtccatcttatatgtaccggcttattgctgagtattactcagctgatgatctggtggtgcgacggaagtcaacagcttgaaggagcagaagagcattctaaaggcaacttcactatgggtgcttttagtgcttattatcacaatcttcgtctgcgccctacagatattgctctctttgttgaaatcgcctattgtgcgttcagttactgtctgggaaatcgatgcaaagcattctcctttcagtagctgtatcgactgcggcattttgggtgtaaactgttgagcaaatgagggtgtgacctgtcatggatggttgtttagctatagaagatacagatatatgattgagtgtagagggtggctgttccatatccgtgcatccaggcctggtttgggccaaattttgtctgttctaaattcaagctgtttcatgtgtatcaagtattattgagcactctgatggaattttctgagcgactaacatacttgcattagattgtgc

SEQ ID NO: 3907 - DNA, 1953 bp, Elaeis guineensis
ttttttttttttttttgggttctgaccaataatttttatgacatcgtaatataatagccgtccccttcttcgatctattgcccctcctctctcctctcctctccgtttctctcaataaagatagaaatctcaaacccctagctagggtttacagttctctatcttctctcgatcagtttgccatcaaaccctctcagccatcgatctttgtgattcttggtgatcgattctcggggccatgccggatgtccaggccctcgtcaatgatttcgttctcaagctcaagagacgcaagatcgaggggtcgcacgcgagcgcgcagcatacggcggagctgctccggtcggtgatctcgcatcagaggatgccgtacacgaaccaggcgggggcgctaatcgatgccgttaaagccgtcggcgagcagcttatcgccgcaaaccctgtcgaacttgctgtggggaacattgtgaggcgtgttttgcatatcatcagagaggaagatctttcttcaactgcaactgcaattgagggactgggcctgtctgctggtagtgatgatgatgatgagggtcaacatgaagatcgcccagcattgtctgctgcagcccttgctgctgctgccagaagcacccttcgtgccccttctttgcaaacccttcttgaagacatacccgattctgctgctgctcctcagcctccttcttcagggggtgattctgaaggaaaagcaaatcagcagataagaacataaggagccggaagctaaagcatgatgtcattgaggctatcaatgaactgattcaagacattgacacctgccatgaacaaatttccgaacaagcagtggagcatattcaccaaaatgaggtcattttaactttgggccgttcaagaacagttaaggaattcctttgtgcagcaaaagagaaaaatcgatcttttcgggtatttgttgctgagggtgctccaaggtatcaggggcatgttcttgcaaaagagctggtcagcaaaggcatacaaaccactgttataactgattctgcggtttttgccatgatttcccgagtgaacatggtgatagtcggagctcatgcaatcatggcaaatggcggagttattgcaccagtaggcataaatatggttgcacttgctgcccaaaggcatgctgtcccatttgttgtggttgctggtagtcacaagttgtgtcccttatacccacataatccagaggttctgctgaatgatctcaaatgcccatctgatttgctggattttggggagttttcagattgtatggattttggtagtcatggtgggtcacctcttcttcatgttgtaaatccagcatttgactatgtgcctccaaagcttgtcagccttttcatcactgatacgggagggcataatccatcttatatgtatcggctcattgcagattattactctgctgatgatcttgtggtgaagcgaagatcaacatcatgaatgcaaatgaagaaatactttgatatcagcatgctctggttctgttaatgacaggaacacttggaattaggctcggtctcaagaagctcaggacagcagaggaaaattttgctaattccatccgatgttggtgcaacaagtcaatggaagcaccatcaagtaaaacattggcattcattcttcgaatctagaaggttttcgatggagttgatgcagcttacttctttagatgattgacagacttgggtttttgatctcgtactagttcagttaaagtgattgtctaaattgtgctgctgtgggtgttccttttctataatgttttatatatgaacgaccattaggtggaaactttatgttgtgaacctatgcatgatgcataccagcagccaaggatttgttagtttaattgatttgcttgtatgtgggagctctatatgaaaattttgaaaatctaagttatatggt

SEQ ID NO: 3908 - DNA, 1423 bp, Setaria italica
gattctgttcttgcagagcttgctgttggaaacattgtcagacgtgttttgcacataataaaagaggaggatatatcttctacagcagttggaatcgaaggtctttctgttactgttgacagtgatgatgaatttgacagtgagcatgatgatcgccctgcattgtctgctgctgtccttgctgcacatgctagaaatgcccttcgcgcaccatcattgcagactctcctagaagatattcccgtgactcctgcaatttcccgcacggcatcatcaactggtgactcagatggaaaaactggagataagagctcaactaggaagctgaagcatgatgtcatcgcagccattggtgatcttattgatgagattgactcatgctacgaaccgatttctgagcaagctgtggaacttattcaccaaaatgaggtaatcctaactctaggccgttctagaactgtcaaggagttcttgtatgctgcgaaagagaagaagcgatcttttcgtgtatttgttgctgaaggtgctccaagatatcagggccatgttcttgcaaaagagttggttgagaaaggtgtacaaactacagttataatagactcagcagtttttgctatgatctctcgagttaacatggtcatagttggagcacatgctataatggcaaatggtggagtgattgcaccagttgggatgaacatggttgcacttgctgctcaaaggcatgctgtgccctttgttgtggttgctggtagccacaagctgtgtcctttgtatccacacaacccagaggtgttactgaatgaacttaagtcgccatctgatttgcttgacttcggcgagttctcagattgcatgaatttcagtactcaggatggcagccccctactaaatgttgtcaatccgacatttgactatgtgccaccaaagcttgtgagcctatttgtcactgatactgggggccacagtccatcttatatgtaccggctcattgctgagtactactcagcagatgatctcgtagtgcaacggaagtcaacagcatgaaggaacacaaaagcattcaacttcgtgttctgaagagctaaagatgttcggattcggttactgtcaaactgagggaaatcaatgcaagcattctccttgcggtacctgtaatggttgcggcgttttgggtgtaaactgttgaggaaatgtggatgtgacctactatggatgaattgttttgactacagaagatacaaatgtatgattgatgtagagggtggctgttccatatccgtgcatcctggtctgggacagtccaaattttgcctgttctaaattccagctgtttcatgtgtatgaagtattcgaatacacactaacggaatttgctgagctatttttcatctttttttaaattgaccatactcatttctag

SEQ ID NO: 3909 - DNA, 1140 bp, Saccharum officinarum
tgatcatcctcctgcagtaccgttccggaattgactggtcgagccacccatgcgttcgcccgtcccagttcccaaacaagaattattggaggacggtgcatgccatgacacccctcgagtgcgacatggctcctgcagcttctcccaagaagcacctctcgcggtcgcggcctctccctcgtcactgctgcttgatgatcttggtccttgcactggcgacgaccgccgcggtggccagcgcgcagctgtcgtcggaggactactacgacgcctcctgccccgccgccctcctcaccatcaggatcgccgtttcgacggccgtgctgctggaccgccgcatgggggcctcccttctccgcctccacttccacgattgcttcgtgcagggttgcgacgcgtcggtgctgctagacgacacggcgagcttcaccggcgagaagggggcggggccgaacgcggggtcgcttcgcggcttcgacgtgatcgacaacatcaagacgctgctggagctgctgtgcccgcagaccgtctcctgcgccgacatcctcgccgtcgccgcccgcgactctgttgcacaactgggaggaccatcgtggtcggttcccttgggcaggagggacgccaccacggcgagcgcgtccctggccaacagtgacctgcccggacctaccagcaacctcaacggcctcctcaacgctttctccaacaagggtttgagcagcaccgacatggttgccctctcaggtgcccacaccgtcggccgggcgcagtgcaagaacttccggccccggatctacaacgacaccgacatcgacgccacctacgcggcgtcgctgcgggccagctgccccgcgcaggccggcggcgccagcgacggcgcgctcgagccgctcgacggctccacgccggacgccttcgacaacgcctacttcggcaacctgctctcccagcgcggcctgctccactccgaccaggcgctcttcggcggcggcggcgcgacggacggcctggtcagcacctacgcgtccagcgccgaccagtgggggagcgacttcgccgcggccatggtcaagatgggcaacattaacccgctcaccggcaccgacggcgagatcagggtcaactgccggagagtgaatt

SEQ ID NO: 3910 - DNA, 1243 bp, Setaria italica
ctgcactgcaggccactcccaaaccagaactaggcagtgactgactgagcgtgacaccaccacttttaccgcgaccatggctcctgcagcttcccgcacgcaccaccaccgctcgctggccttggtcgtcctcgcgctggtggcggccgcaacggccacggtggccggcgcgcagctgtcgtcggaggactactacgacgcctcgtgccccgccgccctcctcaccatccggtccgccgtggcggcggcggtgctgctcgaccgccgcatgggggcctccctcctccggctccacttccacgactgcttcgtgcagggctgcgacgcgtcggtgctgctggacgacgcggggggcttcaccggcgagaagggggcggggccgaacgcggggtcgctgcggggattcgacgtcatcgacaacgccaagatgctgctcgagctcctgtgcccgcagaccgtctcctgcgccgacatcctcgccgtcgccgcccgcgacgccgtcgaacaactgggaggcccatcctggacggttcccctgggcaggagggacgcgacgacggcgagcgcgtccctggccaacagcgacctccccggacccacctccaacctcaacggcctcctcaacgctttctccaacaagggactcagcaccaccgacatggtcgccctgtcaggggcccacaccgtcgggcgggcgcagtgccggaacttccgggcccggatctacaacgacaccgacatcgacgccaccttcgcggcgtcgctgcgggcgagctgcccggcgcaggcgggctcctccagcgacggcgcgctggagccgctggacgggacgtcgccggacgccttcgacaacgactacttcgggaacctgctctcccagcgcgggctgctgcactccgaccaggcgctcttcggcggcggcgccacggacggcctcgtcagggcctacgcgtccgacgccggccgatgggggagcgacttcgcggcggcgatggtcaggatggccagcatcggcccgctcaccggcacggacggcgagatcagggtcaactgccggagggtgaattgagtgtgtggatacatcgcgatcgcattgctgattgcgagtggtggtggagtggaagagtgtgtacattctgcagagagccagggatagagttggaatggagtatgtatacgcacatcatatgtataccactattgtttatttattaattattgcaaatacataattacatgtact

SEQ ID NO: 3911 - DNA, 3602 bp, Zea mays
cctcttgtcggtaggtgtccctccctttactccctccgccctcccacagtcccactgcccttctcctcggtccatcgcaagctcctgcggtcctgcctacggccgtacggcggcatccacccttctgccgcatcgtctttctcaagacgctgccccaggtccatcgcgcctagggttcgccgagtccggcggcgctaagataatgagtgggcaccgaaacagtcatggaaagcgctactctgattatactgaaactggaggcggtaagagaagaaatcctggtgatgatacctatgcccctggtcctgatgacactgtgtatcgctacctctgcgcctctagaaaaattgggagtatcattggcaggggtggagaaattgcaaagcagttgaggactgagacccaagctaagatcaggattggtgagagtgtccctggatgtgaagagcgagttattaccatatttagctcaagtcgaagaactaataccatcgatgatgctgaagataaggtttgccctgctcaggatgccctctttagagttcatgagaggcttgccactgatgagagttttggtaacgaagacagcgaagaaatttcacctcaagttactgttcgcctgcttgtgccatcagaccagattggatgcattcttggaaaaggtgggcacatcatccaaggaatccgcagtgagactggtgcgcaaatacgcgtgcttagtaaggatcatatccctgcatgtgccattagtggcgatgaacttctccagatatctggggacatggtagttgtcaaaaaggctctttgtcaagtgtcatctcgcctccataacaacccatccaagtcacagcatcttcttgcatccagcttgacccaaccgtatccagggggtacccaccttggtggttcctctgctgcacctgttgtagggatcactccagtaattcctccttatggaggctacaaaggtgacgtggcaggagattggccctctttataccaaccccgacgggatgagagctctgcaaaggagtttagcttgcgtttactttgtgctgctgcaaatgtggggggtgtaattgggaagggtggtggaattatcaaacagattaggcaggaatctggggctttaattaaagtggctagctccaattcggatcctgacgatgactgcataattacagtttctgcgaaagagttctttgaagatcctgtatctccaacgattgatgctgcagttcgtttgcagcttagatgcagcgagaaaagtgattcagaattggctgagcagtcatatactacacgcttgctggtgtcaacatcacgtattgggtgcctaattggcaaaggtggctcaatcattactgagatacgaagaacatccagagccaatatacgcattctttcaaaagaaaatgtcccaaaggtagcagcagaagatgaagagatggttcagataagtggaggccttgatgttgcaaggcatgctcttgtgcaaatagctacaaggctgaaagccaatttttttgaaagagagggctcgttatctgcatttccatctgtgatcccttaccatcctttgcctgctggtgtttcggtttcggatgaaccaaaatatctaagcagagacactaagcctgttggacattacctatattcaagtgcttttcgtacatcggatgacatgattccttctgacagctatgcaagttatggtggctcccaggcacctggaggaggatatgcggcttacagcggatacagtgcccgctcctctagtagtgggttatctggtcatagttctcttcactatggaaagcatcatggttattaggatttagattgcttgataaagcagccaagacattgaagtttggagcctgcttattggagccccttcccaaaccagatggccaagagagcccaacctggaagcttaggaggactgtgtggatgccatagaccacctgatattcctcacactacattacttatgtcttcttctgggcctatgtttttagccctgccgcaaatgttctgaacctatgtatcgaaaggtcgcatttgagactgcatgtatttgcttgtttggaacctgcttcagcttcagtttagtcgtttttttgaaatacttgtttcctatgtgccacccaaaaaaccaggaatatgttacgcgaaacccccctaaggagctgttacttccctttaccacgaagatgtgggctacttccttctcagtgatatatgtgattgccatcctagataaaaaaaagtagcactagaatcacatggccttaatgaaattagcatcaggaactagatgtaccaaactttgctcctgcctgccaaatttcaccgagttgcacatttttgctttattcatctacccctgccaccaaacactatcggttttatccccctgcttcaatcttggcctgtttggttttaatccaggcagctttgcctggctcttcatgcaattccaggctttggaattttttgtgtacctggggtgtagactgcttagtggcatgctttgaaccaaacaagcagaccccaaaaccattgttgaactgaggttaggtagctgaacatacatatgtacttgttcgattacaatgttgttgcaacacacatgcaagtttatgtttaaactttaaaccattttttgaatgggaacattaagctaatttgaagtagttgttttaagcataagatttctaatttaactggttattatagatatatgtactttggtatgagtagctaatatctaaaactttagaagctgtaacttttttatgactagttggaagttttttggtcatattgatttagatcataatgatccaaaaaacgcgatagagcatgctcacgatcttcctcaacaccttgatctgatgcacatgttccaatgctttattgattaaatgagtattggtgattgaagttgcggttatgtacttgcctgccatgatggggaaaccaaatgacaaagattgaattgttgggaagagtccgcagtcgcaagttttttgaagattcactgttcatctcatgtagatttagaaggttctgaggttattgtgattgatacgagcttagtggtggtaaaggatcattatctaaatgtttattcacaataagttagagctcaattaattttactttaaaaatgaataggaatagagctcgatactaattcgattcaatcattaaatttaatagtgtaaaatctagagctaattatcacctttatacgagcttgaccacctccatgcgtgggagtcttgttaaccagaaatgtgcaggagcatgtgaaaataaccatgcaggtgttgtttatgaaagagtgaattagcctctggactctggagttgcacaacattgttaacgcagaagtgttattagtggaatgactctactatttgtttgtttatttgatgttttgttaaggtgtttcatgtaaatgctaactgtatcaggttttaattagaagattaattttagattatgtaagtttcataagatttgattctgagatattgtggacatgtactctaccgcaatacatggagcagttctttgtggcgttgactgtt

SEQ ID NO: 3912 - DNA, 3597 bp, Zea mays
aaccctcttcgtcgatcggtgtccctagcctccccctgcccggctgtcctcctcgatttcgcaagctcctggttacggcggcatctatcgttccgccgcaagggccgcatcgtctctctcgcgacgctgccccagaccgccgagataatggctggccaccgaaacagtcatggaaagcgccagtctgattttactgaaaatggaggcagtaagagaagaaatcctggcgatgatacatatgcacctggtcctgatgacactgtgtatcgctacctctgtgcctctagaaaaattgggagtatcattggcaggggtggagaaattgcaaagcagttgaggactgagacccaagctaagatcaggattggcgagagtgtccctggatgtgatgagcgagttgttaccatatttagcacaagcaggaaaactaataccatcgatggtgctgaagatgaggtttgccctgctcaggatgccctctttagagttcatgagaggcttgccagtgatgagggtcttgggaacgaagacagcgaagaaatttcacctcaagttactgttcgcttgcttgtgccatcagaccagattggatgcattattggaaaaggtgggcagatcatccaaggaatccgcagtgagactggtgcacaaatacgtgtccttagtaatgatcatatccccgcatgtgccattagtggagacgaacttctccagatatctggggacacggtagttgtcagaaaggctcttcatcaagtgtcatctcgcctccataacaacccatccaagtcacagcatcttcttgcatccagcttgacccaaccttatccagggagcacccaccttggtggttcctctactgcacctgttgtagggatcactccagtaattcctccttatggtggctacaaaggtgatgtagcaggagattggccctctttataccaaccacgaagggatgagagctctgcaaaggagtttagcttgcgtttactttgtgctgctgcaaatgtggggggtgtaattgggaagggtggtggaattatcaaacagattaggcaggagtctggggctttaatcaaagtggctagctccaattcagaccctgatgatgactgcataattacagtttctgcgaaagagttctttgaagatcctgtatctccaacaattgatgctgcagttcgtttgcagcctagatgcagcgagaaaagtgatttagaatcagctgagcagtcatacacaacacgcttgctggtgtcaacatcacgtattgggtgcctaattggcaaaggtggttcaatcattactgagatacggagaacatccagagcaaatgtacgtattctttcaaaagaaaatgttccaaaggtagcagcagaagatgatgagatggttcagatcactggaggccttgatgttgcaagaaatgctcttgtgcaaatagctacaaggctgaaagccaatttctttgaaagagagggctctttatctgcatttccacctgttatcccttaccatcctttgcctgctggtgtttcggatgaaccaaaatatctaggcagagacaccaagcctgttgggcactatctatattcaagtggttttcgtacatcggatgacacgattccttctgacagctatgcaagttatggcggctcccaggcacctggaagaggatatggggcttacagcgggtacagtgctcgctcctctaatagtgggttatctggtcatagttctcttcactatggaaagcgtcatggttattaggatttagattgcttgataaagcagctatctgatggacctgttattttcacctttgccacccctgctcccctcacgtactataaaaacagccaagacattgaagtttggagcctgcttattggagtcccttcccaaaccagatgaccaagagagcccaacctggaagctttgcttaagaggacccgtgtggatgccatagaccaccttatattcctcactacattactttgtcttcctgtgggcctatgtttttagccctgccgcaaatgttctgaacctatgtattgaaaggtcgcatttgagactgcatgtatttgcttgtttgaaacctgattcagtttagtgattttgttgaaacacttgtttcctatatgccacccaaaaagccaggaatatgttactaaaaaaccctagggagctgttacttgcctttccatggaagatgtgggttactttcttctcagtgatgtgtgactgacatcctaaattaaagtaacaccagaaatggcctttttgcatccgacactagatataccaaacttcgctcctccctgccaacatttcactgaattgcacattttgctttattcatctacccctgccatcgaacacactcagtttcacctgcctgcctcaatcttcagggcctgtttggttttagttcagacagctttgcatggctctccttgcaatccaaggctttagattttctgttcctggggtggcaggctttgaaccaaacaggccccaagagcattgttgaactgacgttagctagctgaacacacatctgtacttgttcgattgcaatgctgttgcaacttgctacacatgggcaagtttatgtttaaacattgaagtcatttttttgaacgagaacattaagccaatttgaagtacgttggtgttttaagtataagctttctaacttaatcggttataaatatatactttggtgtgagtagctaatatccgaaactttgggtagctggaactttttttagtcgtattgatttatcacaatgacccaaaaaatgggttagtcatgatcttactgaactctttaacctgatgcatatgttataatgctttattgactaaatgagtattggtgattgaagtcccgataacgtacttgccaacatgctatgatggggaaactatatgccaacggttgaaccatgtgcatgaggctgcagtacgcaaagttttttttgcaggttcactgttcatttcatgtagatttagcaggttgtaagttccactgggcttgattcaagattgattcttcttcatgcccgtgagtcttgttaactaggaatgtgcaggaacatgcaaagggtaaaccatatgcaggtattgtttatggatgagaatggattagcctacggagttgcacaacattgttaaccttcgaaatgttgttagcggaatggttactattcgttcattgaatcttctgccaatctgttttatgtaaatgctgtatcggattttgatgagcaaattctattgcagtgcctggaacgattgtggttttggcatagtaagtttcataagatttgattctgagatgtcctgaacactattctattgcagtgcctggaacagtgctctctctttctgacctaggacaggtagtgttgctgatccgggtagtgtaccgtagcactgcactgtccgtcatccatctatctatcgagtcaaactgcagctgaacctgacctgaacttgtgcagggttcagggtgctccgatgaaagtatcctgaatctttacaggtttcagggcgctctgatgaaaaatatatgcattatcattaaca

SEQ ID NO: 3913 - DNA, 3223 bp, Setaria italica
cggtgcggctcggcccggcccaccacgcactgcgcatccgccccagagcaagacccacgaactccaataaatcccgtcgtgcgttattcctccatcggctttccttcctccccttccttgctctcctcgatccctcgccgccgctggtccggcttcgtatttctcgcaggtcctcgcggaacggagtccatcggcgcccaagatggctggtcaccgaaacagtcatggaaaacggcactctgattatgctgaaaacggaggtggtaagagaagaaatcctggtgatgattcctatgctcctggtcctgatgatactgtgtatcgctacctctgtgcctctagaaaaattgggagtatcattggccgtggtggagagattgcgaagcagttgagggccgagactcaagctaagattagaattggcgagagtgttcctggctgtgaggagcgagttatcacaatatttagctcaagcagggaaactaataccattgacgatgctgaagataaggtttgccctgctcaggatgctctctttagagttcatgagaggcttgcttctgatgagggtcctgggaatgaagacagtgaagaagttttacctcaagttactgttcgcttgcttgtgccatcagatcagataggatgcattattggaaaaggtgggcatatcatccaaggaatccgcagtgagactggtgcgcaaatacgtgtgcttagtaatgatcatatcccagcatgtgccattaatggtgatgaacttctccagatatccggggatgccgtagttgtcagaaaggctcttcatcaagtgtcatctcgcctccatgacaacccatctaagtcacagcatcttcttgcatccagcttgacccaaccttatgcagggagctcacaccttggtagctcatcttctgcacctgttgttgggattactcctgtaattcctgcttatggaggatacaaaggtgaggtggcaggagattggccctctgtgtatcaaccacggagggatgagagctctgcaaaggagtttagtttgcgtttactttgtgctgctgctaacgtgggaggtgtaatcgggaagggtggtggaattatcaaacagattaggcaggaatctggggcttttattaaagtggatagctccaattcaggtgctgaagatgattgcataattacagtttctgcaaaagagttctttgaagaccctgtctctccaacaattgatgctgcaattcgtttgcagcctagatgcagcgagaaaagtgatgcagaatcagcagaaccatcatacacaacacgtctgttggtgtctacatcacgtattgggtgtctaattggcaaaggtggttcgatcattactgagatacggagacattcaagagcaaacatacgcatcctttcaaaggaaaatgttccaaaggtagccgcagaagatgaagagatggttcagatcagtggaggccttgatgttgcaagacatgctcttctgcaaatagctgcaaggctgaaagccaatttcttcgaaagagagggtgctttatctgcatttccacctgtgatcccttatcatcctttgcctgctggtgtttcggatgaaccaaagtatctaagcagagacactaagcctgttgggcattatctatattcaagtggttttcgaggatcagatgatatgattccttctgacagctatggaagttatagcagctcccaggcacctggtggaggatatggggcttacagtgggtacagtggccgctcaaccaacagtgggttatctggtcacagttctcttccctatggaaagcgtcatggttattaggacctagatttgttgaataaaacagctatcttctgatggacctgttcttttcacctttgcccccctgctcccctcccgcactaaaaacagccaagacaatgaagtttggagcctgcttattggagcccccttcccaaaccagatgaccaagagtattgcccaacctggaagctttgcttaggaggacctgtctggatgccatagaccatctgattttcctcaaactacattacttatatcttcctccgggcctgtgtttgtagccctgccgtaaatgttccgaacctatgtatttaaggtcgcatttgagtttgcgtgtatttgctcgtttgaaacctgcttcagtttagcgcttttgttgaaatacttttttttcctatgtgccacccaaaagccaggaaggtgttacttgaaaaacaaactagggagatgttacttggcattctgtgagatgcaggttacttctcagagatgtgactgttatccttaaaagtaacactagaaccacatgccattcttgaaagtagagaccgcatataccaaacttgttcctgttagccaacatttcacaagatgattgcactgctgcaacttgcaacatccttatgatactcaatgagcttgaaatgtgctataggatggaaaacatttttatgtatttcaatgtgatgttttgaagtttaagtttttacttggttatagattttatatattttggtgtgaatagctaagatcttaactgtagatagctggaaacttagcatgcatagatcacaatgatcttgaaatgcactagcgcatctcatgatcttattgagtcttgtaacctcgctctcatgcatatgttgttctgattcttaaataagtgttgctgatttagtggtagtcatgcacttgtcctgtcgggtgaactgtatgctaaaatctagctaagtgaaggtaccagttttagatcacaggaggcgggggtaccagttttagaacacaggaagtggttcatggggtgaaggcacagccccaatgttttgcaggttgacaatgtattttatctagaagcttaaagtttacaggactaggtaaccttatgaagcatgaactccttggtatctacagtaggaatcttgttaactcatgatggtgcaggaacatacaaaaggtaagcagctaatagctattgcaggctttgtaaggctgaaaggaactagccctggagttgcacataattgctaccatactgtgcctgcgtagctcacattgtatcttctacatgtcattagagggacaactgttgtacgtctgtatgcaagttctgatggttttatactttgatcagcaaagtttgtgttaataatgaattcagtttggtgttataccattcgattatctggtctgtgt

SEQ ID NO: 3914 - DNA, 2100 bp, Panicum virgatum
gttctcctcgatccctcgccgccgctggtccggctccatccatcgtcccaaccgcttcgtctttctcgcgcagctgtcgcaggtccccctagcgcctagagtttgctgagtccgtcggcccaagataatggctggacaccgaaacagtcatggaaaacggcactctgattatgctgaaaatggaggtggtaagagaagaaatcctggtgatgattcctatgctcctggtcccgatgatactgtgtatcgctacctctgctcctctagaaaaattgggagtatcattggccgcggtggagagattgcaaagcagttgaggaccgagactcaagctaagattaggattggcgagagtgttcctgggtgtgaagagcgagttatcacaatatttagctcaagcagggaaactaatactattgatgatgctgaagataaggtttgccctgctcaggatgctctctttagagttcatgagaggcttgcttctgatgagggtcctgggaatgaagacagtgaagaagttgtacctcaagttactgttcgtttgcttgtgccatcagaccagattggatgcattattggaaaaggtgggcatatcatccaaggaatccgcagtgagactggtgcgcaaatacgtgtgcttagtaatgatcatatcccatcatgtgccattaatggtgatgaactcctccagatatcccggggatgctgtagttgtcagaagggctcttcgtcaagtgtcatctcgcctccatgacaacccatctaagtcacagcatcttcttgcatccagcttgacccaaccttatgcaggaagctcccaccttggtagttcctccactgcacctgttgttgggattactcctgtaattcctgcttttggaggatacaaaggtgatgtggcaggagattggccctctatacctcggagggatgagagcgctgcaaaggagtttagcttgcgtttactttgtgctgctgtgaatgtgggaggtgttattgggaagggtggtggaattatcaaacagattaggcaggaatctggggcttttattaaagtggatagctccaattcaggtgctgaagatgattgcataattacagtttctgcaaaagagttctttgaagatcctgtctctccaacaattgatgctgcagttcgtttgcagcctaggtgcagtgagaaaagtgatgcagaatcagcagagccatcatacacaacacgcttgttggtgtctacatcacgtattgggtgcctaattggcaaaggtggttcaatcattactgagatacggagaacaacaagagcaacgatacgcattctttcaaaggaaaatgttccaaaggtagcagcagaagatgaagagatggttcagatcagtggagggcttgatgttgcaagacatgctcttgtgcaaatagctacaaggctgaaagccaatttctttgaaagagagggtgctttatctgcatttccacctgtgatcccttatcatcctttgcctgctggtgtttctgatgaaccaaagtatctaagcagagacactaagcctgttgggcattttctatattcaagtagtttccgtgcatcagatgatatgattccttctgacagctatggaagttatagcagctcccaggcacctggaggtggatatgtggcttacagtgggtacagtggccgctcaaccagcagtgggttgtctggtcatagttctcttccctatggaaagcgtcatggttattaggatctagatttgttgaataaaacagccaagacaatgaagttcggagcctgcttattggagccccttcccaaaccagatgaccaagagtattgcccatcctggaagctttgcttaagaggacctgtctggatgccatagaccattgattttcctcacactacattacttatatcttccaccgggcctgtgtttgtagccctaccataaatttccaaacctatgtattgatgaaggtcgcatttgagattgcgtgtatttacttgtttgagacctgcttcagtttagcggcttttgttgaaattgaaatacttgtttaccatgtgccaccctaaagccaggaagatgctgcttg

SEQ ID NO: 3915 - DNA, 2912 bp, Setaria italica
attcctatgctcctggtcctgatgatactgtgtatcgctacctctgtgcctctagaaaaattgggagtatcattggccgtggtggagagattgcgaagcagttgagggccgagactcaagctaagattagaattggcgagagtgttcctggctgtgaggagcgagttatcacaatatttagctcaagcagggaaactaataccattgacgatgctgaagataaggtttgccctgctcaggatgctctctttagagttcatgagaggcttgcttctgatgagggtcctgggaatgaagacagtgaagaagttttacctcaagttactgttcgcttgcttgtgccatcagatcagataggatgcattattggaaaaggtgggcatatcatccaaggaatccgcagtgagactggtgcgcaaatacgtgtgcttagtaatgatcatatcccagcatgtgccattaatggtgatgaacttctccagatatccggggatgccgtagttgtcagaaaggctcttcatcaagtgtcatctcgcctccatgacaacccatctaagtcacagcatcttcttgcatccagcttgacccaaccttatgcagggagctcacaccttggtagctcatcttctgcacctgttgttgggattactcctgtaattcctgcttatggaggatacaaaggtgaggtggcaggagattggccctctgtgtatcaaccacggagggatgagagctctgcaaaggagtttagtttgcgtttactttgtgctgctgctaacgtgggaggtgtaatcgggaagggtggtggaattatcaaacagattaggcaggaatctggggcttttattaaagtggatagctccaattcaggtgctgaagatgattgcataattacagtttctgcaaaagagttctttgaagaccctgtctctccaacaattgatgctgcaattcgtttgcagcctagatgcagcgagaaaagtgatgcagaatcagcagaaccatcatacacaacacgtctgttggtgtctacatcacgtattgggtgtctaattggcaaaggtggttcgatcattactgagatacggagacattcaagagcaaacatacgcatcctttcaaaggaaaatgttccaaaggtagccgcagaagatgaagagatggttcagatcagtggaggccttgatgttgcaagacatgctcttctgcaaatagctgcaaggctgaaagccaatttcttcgaaagagagggtgctttatctgcatttccacctgtgatcccttatcatcctttgcctgctggtgtttcggatgaaccaaagtatctaagcagagacactaagcctgttgggcattatctatattcaagtggttttcgaggatcagatgatatgattccttctgacagctatggaagttatagcagctcccaggcacctggtggaggatatggggcttacagtgggtacagtggccgctcaaccaacagtgggttatctggtcacagttctcttccctatggaaagcgtcatggttattaggacctagatttgttgaataaaacagccaagacaatgaagtttggagcctgcttattggagcccccttcccaaaccagatgaccaagagtattgcccaacctggaagctttgcttaggaggacctgtctggatgccatagaccatctgattttcctcaaactacattacttatatcttcctccgggcctgtgtttgtagccctgccgtaaatgttccgaacctatgtatttaaggtcgcatttgagtttgcgtgtatttgctcgtttgaaacctgcttcagtttagcgcttttgttgaaatacttttttttcctatgtgccacccaaaagccaggaaggtgttacttgaaaaacaaactagggagatgttacttggcattctgtgagatgcaggttacttctcagagatgtgactgttatccttaaaagtaacactagaaccacatgccattcttgaaagtagagaccgcatataccaaacttgttcctgttagccaacatttcacaagatgattgcactgctgcaacttgcaacatccttatgatactcaatgagcttgaaatgtgctatagcatggaaaacgtttttatgtatttcaatgtgatgttttgaagtttaagtttttacttggttatagattttatatattttggtgtgaatagctaagatcttaactgtagatagctggaaacttagcatgcatagatcacaatgatcttgaaatgcactagcgcatctcatgatcttattgagtcttgtaacctcgctctcatgcatatgttgttctgattcttaaataagtgttgctgatttagtggtagtcatgcacttgtcctgtcgggtgaactgtatgctaaaatctagctaagtgaaggtaccagttttagatcacaggaggcgggggtaccagttttagaacacaggaagtggttcatggggtgaaggcacagccccaatgttttgcaggttgacaatgtattttatctagaagcttaaagtttacaggactaggtaaccttatgaagcatgaactccttggtatctacagtaggaatcttgttaactcatgatggtgcaggaacatacaaaaggtaagcagctaatagctattgcaggctttgtaaggctgaaaggaactagccctggagttgcacataattgctaccatactgtgcctgcgtagctcacattgtatcttctacatgtcattagagggacaactgttgtacgtctgtatgcaagttctgatggttttatactttgatcagcaaagtttgtgttaataatgaattcagtttggtgttataccattcgattatctgctctagtaacgcataataaaatagaagctacaatataagcttaacacag

SEQ ID NO: 3916 - DNA, 2831 bp, Pennisetum glaucum
ggtggtaggagaagaaatcctggtgatgattcctatgctcctggtcctgatgataccgtgtatcgctacctctgtgcctctagaaaaattgggagtatcattggccgtggtggagagattgcgaagcagttgaggactgagactcaagctaagattagaattggtgaaagtgtccctggctgtgaagagcgagttatcacaatatttagctcaagcagggaaactaacaccattgacgacatggaagataaggtttgccccgctcaggatgctctgtttagagttcatgagaggcttgcttctgatgagagtcctgggaatgaagacattgaagaagttgcacctcaagttactgttcgcttgcttgtgccatcagatcagataggatgcattattggaaaaggtgggcatatcatccaaggaatccgcagtgagactggtgcacaaatacgcgtccttagtaatgatcatatcccagcatgtgccattaatggtgatgaacttctccagatatccggggatgccgtagttgtcagaaaggctcttcgtcaagtgtcatcgcgcctccatgacaacccatctaagtcacagcatcttcttgcatccagcttgatgcaaccttatgctgggagctcccaccttggtagctcatcttctgcacctgttgttgggattactcctgtaattcctgcttatggaggatacaaaggtgatgtggcaggagattggccctctgtgtatcaaccacggagagatgagagctctgcaaaggagtttagtttgcgtttactttgtgctgctgcgaatgtgggaggtgtaatcgggaagggtggtggaattatcaaacagattaggcaggaatctggggcttttattaaagtggatagctccaattcaggtgctgaggatgattgcataattacagtttctgcaaaagagttctttgaagatcctgtctcgccaaccattgatgctgcaatccgcttgcagcctagatgcagtgagaaaagtgatgcagaatcagctgaaccatcatacacaacacggctgttggtatctacatcacgtattgggtgcctaattggcaaaggtggttctatcattactgagatacggaggtcatcaagagcaaacatacgcatcctttcaaaggaaaatgttccaaaggtagccgcagaagatgaagagatggttcagatcagtggaggccttgatgttgcaagacatgctcttctgcaaatagctgcaaggctgaaagccaatttctttgaaagagagggtgctttatctgcatttccacctgtgatcccttatcatcctttgcctgctggtgtttcggatgaaccaaagtatataagcagagacactaagcctgttgggcattatctatattcaagtggttttcgtggatcagatgatttgattccttctgacagctatggaagttatagcagctcccagccatctggaggaggatatggggcttacagtgggtacagtggccgcacaaccagcagtggttctcttccctatgcaaagcgtcatggttattaggacctagatttgttgaataaaaacaagacaatgaagtttggagcctgcttattggagcccccttcccaaaccagatgaccaagagtattgcccaacctggaagctttgcttaggaggacttgtctggatgccatagaccatctgattttcctcaaactacattacttatatcttcctccgggcctgtgtttgtagccctgccgtaaatgttccaaaccaatgtatttaaggttgcatttgagtttgcgtgtatttgctcgtttgaaacctgcttcagtctagcacttttattgaaatatttttttcccctatgtgccacccaaaagccaggaagatgttacttgaaaaacaaactagggcgatgttactttgcattctgtgagatgcaggttacttttcaaagatgtgactgtcatccttgccattcttgaaagtagagaccacatataccaaactggttcctgttagccatcatttcacaaggcgattgctcagctgcaacttgcaacatccttctgatactcaagtatcaatgaatttgaaatgtgtttatgtatttcaatttgatgttttgaagtttaagtttttacttggttgtagattttatatactttggtgtgaataggtaagatcttaactgtagatggctggaactggaaacttagcatgcatagatcacaatgcctttgaaatgcactagcacatctatcttactgagtcttgtaaactcgctctcatgcatgtggtgttctaatgcttagataagtgttgcttatttagtggtagtaatggcacttgtcctgtcgggtgaactgtatgctgaagtctacctgagtgaaggtaccagttttagagcaaggaaggtggggtgtgccaggttaagatcacaggaagtggttcatggggtgaagccacagccccaatgtattgcaggttgacaatgtattttatctagaaggttaaagtttgcaggactaggtaaccttatcaagtatgaactccttggtagatgcacagtaggaatcttgttaactcatcatggtgcaggaacatacaaaaggtaagcagctaatagctattgcaggctttgtaaggctgaaaggaactagccctggagttgtacgtaactgctaccataccgtgcctgggtactcacattgtatcttctaaatgtcattagattgacaactgttattatttttaaaaaagattgacaactgttgtatgtctgtatgcaagttgttaccgtgttaggatcagcaaagttatttttaata

SEQ ID NO: 3917 - DNA, 3005 bp, Oryza sativa
tcccccttggccgcttccctaggcttggcgtaaaagaaaatctccccgtctcgtcgtctcctccgctccttgcgccatctcgcggctgaacaggggaggggcggcgatctccatccggcgagcggagcaggggaggggaggggatcttgacaatggttggacctgggcataggaacagtcacgggaagcgtcactctgattatgctgaaaatggaggtggcaagagaaggaatcctggtgatgatacatatgctcctggtccagatgatactgtctaccgctatctttgcccttctagaaaaatagggagcatcattgggaggggtggagaaattgctaagcagatgagggccgacactcaagctaagataaggattggtgagagtgtatctggttgtgatgagagagttatcacaatatttagctcaagcagggaaactaataccctagtagatgctgaagataaggtttgccctgcccaagacgctctctttagagttcatgaaaagctatccatagatgatgatattgggaatgaagaaagtgatgaaggtttagctcaagttaccgttcggttgcttgtgccatcagaccagattggatgcattattggaaaaggtgggcatattatacagggaatccgcagtgacactggtgctcatatacgtgttcttagcaatgaaaatctccctgcgtgtgccatcagtggtgatgaacttcttcagatatctggggactcaacagttgtcagaaaagctcttcttcaagtgtcatctcgtctccatgacaacccatctaggtcacagcatcttcttgcatccagcatgacacagccttatccagtgggctcccaccttggtagttcctcaactgcaccagttgtggggattacgcctttaattagttcttatggaggatacaaaggtgatgtggctggagattggccttctatatatcaaccacggagggaggagagctctgcaaaggaatttagcttgcgccttctttgtgctgcatcaaatgtgggaggtgtaattggaaagggtggtggaattatcaaacagattaggcaggagtctggagcctttatcaaagttgatagttcaaatactgaagatgactgcataattactgtttctgcaaaggagttctttgaagatcctgtctccccaacaataaatgctgcagttcatttacaaccaagatgcagtgagaaaactgatccggaatcagcgatcccgtcttacacaacacgcttgttggtgtcgacatcacgtattgggtgcttgattggaaaaggtggttcaatcattactgagataaggagaacatcaagagcaaacatacgtatcctttctaaggagaatgtaccaaaagtagcagcagaagacgaagagatggttcagatcagtggagaccttgatgttgtaagacatgctcttctgcaaataactactaggctgaaagccaatttctttgaaagagaaggtgctttatcaggtttcccacctgtaatcccttaccatcctcttccagttggtgtttctgaagggccaaagtatctaggcagagatactaagcctcttgggcatgattatccatattcaagtggatatcgtggctcagatgatattggccctattgacagctatgcaagttatggcagctcccaggtctctggaggaggttatggggcttatggtggatatagtggtcgttctggcagcagtgggttatctggccctagttcattttcctatggaaagcgacatggttattaggacttagattgacaaatgcaacagccaagacaaaagaatgccaagaccaatgaagtatggagcctgcttattggagccccttcccaaaccagatgaccaagagtatggccccaacctggaagctttgcctaagagggacctgcctggatgccatagaccatcttatttccctagtatacagcatttacttatattttcctctgggactatgttgattccccgtcttacatgttctaaacctatgtattgaaagttcacagttgagacttcctgtatgtgttctcgtgcaacctgcttcatcttagtagttcgtgtggaagaacttggttccctgtttgccaaccaaaagcctagaagttacttgcccttgctttaaggatgtggatcgtgtcatccttcacattcgttcctatctgcacatagttccccagagaaaattgtacctcctcagtgagctcaaaataggctaacataaaacttaagtttacctataaaccaatctcagcatggtcttctagtatcaacctgtctggtaagctatatgactactatggcgatttacagttagctggaagttttcgcttttgctgatttatagatcataaaagccctaacatgcaattgtgcaagccatgctatacatgggatcttgacttgatgtgcacgtgtgctctgatgctcaatctgagtgtgggtaagtttcagagaacctctcaaagttaataactgggttgagattttatcgagttaagagtttcctttgtgttttggagtcttttcctcttctttacccttctcatggaggtgcaggagcatacgccgtgtgctgctactgcagacttgtccactgctatatggaaccactgctggagttgcagaacgttggtgccatgccatgcagggcatttgttagtgtattgctgtagactatgatacattttcgatgtaggcggtaacatggcaaacagtattgtgctgctttcagtatatttcttttttttggccaaatttgtttatgcatgtaaaagcaattctctcaacattgtatttgaacagtttggtcgaattagccgatcattcttatgtactgattgatgtccactgttgttggtgatggactactgagcactttgtagtacgtgattttcatagaccggtgctgttgtgattttcctagacaaatgtagtgttgtggcaattgtatttaaatgaataaagggaact

SEQ ID NO: 3918 - DNA, 2987 bp, Oryza sativa
cttggccgcttccctaggcttggcgtaaaagaaaatctccccgtctcgtcgtctcctccgctccttgcgccatctcgcggctgaacaggggaggggcggcgatctccatccggcgagcggagcaggggaggggaggggatcttgacaatggttggacctgggcataggaacagtcacgggaagcgtcactctgattatgctgaaaatggaggtggcaagagaaggaatcctggtgatgatacatatgctcctggtccagatgatactgtctaccgctatctttgcccttctagaaaaatagggagcatcattgggaggggtggagaaattgctaagcagatgagggccgacactcaagctaagataaggattggtgagagtgtatctggttgtgatgagagagttatcacaatatttagctcaagcagggaaactaataccctagtagatgctgaagataaggtttgccctgcccaagacgctctctttagagttcatgaaaagctatccatagatgatgatattgggaatgaagaaagtgatgaaggtttagctcaagttaccgttcggttgcttgtgccatcagaccagattggatgcattattggaaaaggtgggcatattatacagggaatccgcagtgacactggtgctcatatacgtgttcttagcaatgaaaatctccctgcgtgtgccatcagtggtgatgaacttcttcagatatctggggactcaacagttgtcagaaaagctcttcttcaagtgtcatctcgtctccatgacaacccatctaggtcacagcatcttcttgcatccagcatgacacagccttatccagtgggctcccaccttggtagttcctcaactgcaccagttgtggggattacgcctttaattagttcttatggaggatacaaaggtgatgtggctggagattggccttctatatatcaaccacggagggaggagagctctgcaaaggaatttagcttgcgccttctttgtgctgcatcaaatgtgggaggtgtaattggaaagggtggtggaattatcaaacagattaggcaggagtctggagcctttatcaaagttgatagttcaaatactgaagatgactgcataattactgtttctgcaaaggagttctttgaagatcctgtctccccaacaataaatgctgcagttcatttacaaccaagatgcagtgagaaaactgatccggaatcagcgatcccgtcttacacaacacgcttgttggtgtcgacatcacgtattgggtgcttgattggaaaaggtggttcaatcattactgagataaggagaacatcaagagcaaacatacgtatcctttctaaggagaatgtaccaaaagtagcagcagaagacgaagagatggttcagatcagtggagaccttgatgttgtaagacatgctcttctgcaaataactactaggctgaaagccaatttctttgaaagagaaggtgctttatcaggtttcccacctgtaatcccttaccatcctcttccagttggtgtttctgaagggccaaagtatctaggcagagatactaagcctcttgggcatgattatccatattcaagtggatatcgtggctcagatgatattggccctattgacagctatgcaagttatggcagctcccaggtctctggaggaggttatggggcttatggtggatatagtggtcgttctggcagcagtgggttatctggccctagttcattttcctatggaaagcgacatggttattaggacttagattgacaaatgcaacagccaagacaaaagaatgccaagaccaatgaagtatggagcctgcttattggagccccttcccaaaccagatgaccaagagtatggccccaacctggaagctttgcctaagagggacctgcctggatgccatagaccatcttatttccctagtatacagcatttacttatattttcctctgggactatgttgattccccgtcttacatgttctaaacctatgtattgaaagttcacagttgagacttcctgtatgtgttctcgtgcaacctgcttcatcttagtagttcgtgtggaagaacttggttccctgtttgccaaccaaaagcctagaagttacttgcccttgctttaaggatgtggatcgtgtcatccttcacattcgttcctatctgcacatagttccccagagaaaattgtacctcctcagtgagctcaaaataggctaacataaaacttaagtttacctataaaccaatctcagcatggtcttctagtatcaacctgtctggtaagctatatgactactatggcgatttacagttagctggaagttttcgcttttgctgatttatagatcataaaagccctaacatgcaattgtgcaagccatgctatacatgggatcttgacttgatgtgcacgtgtgctctgatgctcaatctgagtgtgggtaagtttcagagaacctctcaaagttaataactgggttgagattttatcgagttaagagtttcctttgtgttttggagtcttttcctcttctttacccttctcatggaggtgcaggagcatacgccgtgtgctgctactgcagacttgtccactgctatatggaaccactgctggagttgcagaacgttggtgccatgccatgcagggcatttgttagtgtattgctgtagactatgatacattttcgatgtaggcggtaacatggcaaacagtattgtgctgctttcagtatatttcttttttttggccaaatttgtttatgcatgtaaaagcaattctctcaacattgtatttgaacagtttggtcgaattagccgatcattcttatgtactgattgatgtccactgttgttggtgatggactactgagcactttgtagtacgtgattttcatagaccggtgctgttgtgattttcctagacaaatgtagtgttgtggcaattgtatttaaatg

SEQ ID NO: 3919 - DNA, 1741 bp, Avena sativa
ctttttcgcacgagcgagcgacgggacccgctgacgcgtcttcttatcgtcgtctccgttcgccagatctgataccccttctccggcggccgccacgatcatggttgggcctgggcaccggaacagtcatggaaagcggcactctgattatgctgaaaatggaggtggcaagagaagaaatcctggtgatgatacctatgctcctggtccagatgatactgtctatcgctacctctgcgtgtctaagaaaatcgggagtataattgggaggggtggagaaattgccaagcagttgaggaatgaaactcaagctaagattaggattggtgagagtgtccctggctgcgatgagcgagtcataacaatatttagcccaaccgaggagactaatactatcgaagataccgaagataaggtttgccctgctcaagatgctctctttagggttcatgagaagctggctaccgatgatggtcctgtgaatgaagaaaatgaagagggtttagctcaagttacagttcgcttgcttgtgccatctgatcagattggatgcattattggaaaaggtgggcatatcatccaggggatccgcagtgacactggttcacaaatacgtgtgcttagtaatgaacatcttcccgcatgtgctattagtggtgatgaacttctccagatatccggggatccaatggttgttagaaaagctcttctccaagtgtcatctcgcctccgtgacaacccatctaggtcacagcatcttcttgcatccagcttgacccaaccttctcgcgttggtagttcctctactgcaccagttgtagggattacttctatggttagtccatatggaggatacaaaggtgatatggtgggagattggccttctatataccaaccgcggagggaggagagctctgcaaaagagtttagcttgcgtctgctttgtgccccagcgaatgtcggaggtgtaattggaaaaggaggtggaattatcaaacagattaggcaggaatctggagcttttatcaaagttgatagttcaaatctcgaagatgactgcataattacagtttcggcaaaagagttctttgaagatcctgtctctccaactattgatgctacagttcgtttacagccaaaatgcagtgagaaaattgatgcagaatcaggggagccgtcatatacaacacgtttgttggtgtcaacatcacggatagggtgcctgatcggcaaaggtggttcaatcattacagagatacgaagaacatcaagagcaaacatacgtatattttcgaaggagaatgttccaaaagtagcgtctgaagacgaagagatggttcagatcagtggcgaccttgatgttgcaagacatgctcttgtgcaaataactacaaggctgaaagccaacttctttgaaagagagggtgctttatcaggttttccacctgtgatcccgtatcatcctctgcctgctagtgtttctgacgagccaaggtatctaggcagagacaataagcctgtcgggcatgactatctatattcaagtggatatcgtgcatcagacgatatgcctcctcttgaccgttacacaaattatggcagctctcaggtatctggaggcggctatggtggttacagtggatacagtggtcgttctggcagcagcgggttatctggttctacctatctttcatctggaaagcgctatggctattagaatgcaggttgtcgaatacagcag

SEQ ID NO: 3920 - DNA, 2968 bp, Avena sativa
gctagccatctattccgccagacgcgtctacccccgtgttcttctttttcgcacgagcgagcgacgggacccgctgacgcgtcttcttatcgtcgtctccgttcgccagatctgataccccttctccggcggccgccacgatcatggttgggcctgggcaccggaacagtcatggaaagcggcactctgattatgctgaaaatggaggtggcaagagaagaaatcctggtgatgatacctatgctcctggtccagatgatactgtctatcgctacctctgcgtgtctaagaaaatcgggagtataattgggaggggtggagaaattgccaagcagttgaggaatgaaactcaagctaagattaggattggtgagagtgtccctggctgcgatgagcgagtcataacaatatttagcccaaccgaggagactaatactatcgaagataccgaagataaggtttgccctgctcaagatgctctctttagggttcatgagaagctggctaccgatgatggtcctgtgaatgaagaaaatgaagagggtttagctcaagttacagttcgcttgcttgtgccatctgatcagattggatgcattattggaaaaggtgggcatatcatccaggggatccgcagtgacactggttcacaaatacgtgtgcttagtaatgaacatcttcccgcatgtgctattagtggtgatgaacttctccagatatccggggatccaatggttgttagaaaagctcttctccaagtgtcatctcgcctccgtgacaacccatctaggtcacagcatcttcttgcatccagcttgacccaaccttctcgcgttggtagttcctctactgcaccagttgtagggattacttctatggttagtccatatggaggatacaaaggtgatatggtgggagattggccttctatataccaaccgcggagggaggagagctctgcaaaagagtttagcttgcgtctgctttgtgccccagcgaatgtcggaggtgtaattggaaaaggaggtggaattatcaaacagattaggcaggaatctggagcttttatcaaagttgatagttcaaatctcgaagatgactgcataattacagtttcggcaaaagagttctttgaagatcctgtctctccaactattgatgctacagttcgtttacagccaaaatgcagtgagaaaattgatgcagaatcaggggagccgtcatatacaacacgtttgttggtgtcaacatcacggatagggtgcctgatcggcaaaggtggttcaatcattacagagatacgaagaacatcaagagcaaacatacgtatattttcgaaggagaatgttccaaaagtagcgtctgaagacgaagagatggttcagatcagtggcgaccttgatgttgcaagacatgctcttgtgcaaataactacaaggctgaaagccaacttctttgaaagagagggtgctttatcaggttttccacctgtgatcccgtatcatcctctgcctgctagtgtttctgacgagccaaggtatctaggcagagacaataagcctgtcgggcatgactatctatattcaagtggatatcgtgcatcagacgatatgcctcctcttgaccgttacacaaattatggcagctctcaggtatctggaggcggctatggtggttacagtggatacagtggtcgttctggcagcagcgggttatctggttctacctatctttcatctggaaagcgctatggctattagaatgcaggttgtcgaatacagcagctctcttccgatgaaccagtccgtttcacctttcccccctgcccaatcccttactgaaaactgccaagacaaatgaagtatggagcctgcttattggagtccctacccaaaccagatgacatagagtatggcccaacctggaagcttttgcttaagaggacctgtctggatgccataaaccatctgatttccccagtagaatatttacttatattttcctctgggcctgtgtgatgccctgccgtaaatgttctgaacctatgtattgaaagtgacatatgagactatatgtcttgaaacctgcttagtagtttgtgtgagagacttgtcctattctccatccaaaaattaggagttgctacttgcccttgcttaagtgtgtattgcttcattattgatacatattgtctttcttagaagtagtggttcacagtatcccaagacttgtcctatctggaaatagtaatcctgtggtaccactacaatttgcaacttgatatcctgaatatcctcaataagctcaaatgtttcagtacaagatctaatttacctatatagccaattctggcatggagatgattagccgataagtggggcttaacataccatcagtatgcaaatgatcataatatgcccgtggacatgcatgcaaactgatgctcaatcgagtactggcaagtttcaaaattgtgatgatgcattatcacactggataaattgtgttgaattttttccatggtttctggattctaagtttttagtttctttgtgtttggagcctttttttatccatgttaaccagggaggtgcagaagcatacacaatttctgaagctacagaccgttgctggcctactttgcaacgcttaaaatatttcgagcgtacacaattcctggagtcttttctttatccatgttaaccagggagttgctggggaattgttgtattgtgctcctttgatatttgtacttgtctttttagctgtgcactatagaagtaattgtgctcgatttgatcgcttgggcgagtggtgaagctgaacattgttcttcattagttttgttctgttttatcccttggcgtgaagctgaaacattcttttgtatggcatttgcctggctgagcacaatatgtcaatgataatttgaatgatcgttttataatggaattagctccacaatgac

SEQ ID NO: 3921 - DNA, 2088 bp, Brachypodium distachyon
gatcatggttgggcctgggcacagaaacagtcatggaaagcgatactctgattatgctgaaaatggaggtggcaaacgaagaaatcctggtgatgatacctatgctccttgtccagatgatactgtctatcgctacctctgcgcttctaggaaaatcgggagtatcattgggaggggcggagaaattgccaagcagttgaggacagatactcaagctaagattaggattggtgagagtgtccctggctgcgatgagcgagttatcacaatatttagctcaagcagggagactaataccgttgaagatactgaagataaggtttgccctgcccaagatgctctctttagagttcatgagaagcttatcactgatgatggtcctggggacgaagaaaatgaagaaggtttagctcaagttattgttcgtttgcttgtgccgtctgaccagattggatgcattattggaaaaggcgggcatatcatccagggcatccgcagcgacactggttcacatatacgtgtgcttagtactgaacatctccctgcatgtgctattagtggtgatgaacttctccagatatctggggacccattggtagttagaaaagctcttctccaagtatcatctcgtctccatgacaacccatctaggtcacagcatcttcttgcatccagcttgacgcaaccttatccagtgggctcccgccatggtagttcctctactactccagttgtagggattgctcccatggttaatccttatggaggatacaaaggtgatatggttggagattggccttctatataccaaccgcggagagaggagagctctgcaaaagagttcagcttgcgactgctttgtgctgcatcagacgttggaggtgtaattggaaagggaggcggaattatcaaacagatcaggcaggaatctggagcttttatcaaagtggatagttcaagtgcagaagatgactgcataattaccgtttcggcaaaggagttctttgaagatcctgtctctccaacaattgatgccacagttcgtttacagccaaaatgcagcgagaaaactgatccagaatctggtgagccttcatatacaacacgcttgttggtgtcaacatcacagattgggtgtttgatcggcaaaggtggttcgatcattactgagatacgtagaacatcaagagcaaatatacgtatcctttcgaaggagaatgtcccaaaagtagcctctgaagacgaagagatggtgcagattagtggagaccttgaggttgcaaggcatgctcttgtgcaaataactacaaggctgaaagcaaacttctttgaaagagagggtgctttatcaggttttcaacctgtgattccttatcatcctatgcctgctagtatttctgatgagccaaagtatctaggcagggatactaagcctgctgggcatgattatccatattctggtggatatcgtgcatcagaggatatgcttcctgttgacagttatgcaaattatggcagctcccagatctctggaggaggctacggggcatacagtgggtacagtggtcgttccggtagcagtgggttatccggtcctagttatctaacttctggaaagcgctatggttactaggattcagattgtcaagtacaacagccaagacaaatgaagtttggagcctgtttattggagcccctacccaaaccagatgccgagagtttggaccttacggatgccatagactatcctcatagactttatcacttatgttgtcctctgggcctgtgtttgatgccctgccgtatatgttctgaacctgtgtattgaaaggtcacatttgagtctccgtacttgttgtcatgaaagctgtttcaacttagtttgtgtcaggagatcttgtttcccatttgccatccaaaagctaggatattctactttcccttgcttggaaaatgtggtttgcgtcatctttacacataagcgttacttcacctgtgatcaaagatttgttcctatttgcgacatgaggtaccactacaagctaggaatcctgaatatatcctcaatgagctcgaaagtgctaccat

SEQ ID NO: 3922 - DNA, 3326 bp, Brachypodium distachyon
cccgaaccgttatctcctcagcccaggaccgacacctcctcgtctccctcgcatccatcgacaggagctcccccatggcgactcgattccaaccctagctgacccggccgccgcgcgcatctccgtcgctcccatcgggatccatcttcggcgagcccgaactcgttctccggtcatcccgccctcgttctcccgctcgcccgccctcgctcgcccgccctcgccctcgagcccgcccctccaagtgattccgccgccacggggattcgtcgccgccacggagatcatggttggtcctgggcaccggaacagtcatggaaagcgacactcggattattctgaaaatggaggtggcaagagaagaaatcctggtgatgatacctatgctcctggtccagatgatactgtttatcgctacctctgcacttctaggaaaatcgggagtatcattgggaggggcggagaaattgccaagcagttgaggacggatactcaagctaagattaggattggtgagagtgtccctggctgcgatgagcgagtcataacaatatttagctcaagcagggagaccaataccattgaggatactgaagataaggtttgccctgctcaagatgctctctttagggttcatgagaagcttatcgctgatgatggtcctggtgacgaagaaaatgaagaaggtttagctcaagttactgttcgcttgcttgtgccttctgatcagattggatgcattattggaaaaggtgggcatatcatccagggtatccgcagtgacactggttcgcaaatacgtgtgcttagtaatgaacgtctcccagcatgtggtattagtggtgatgaacttctacagatatctggggacccattggtagttagaaaagctcttctccaagtgtcatcccgtctccatgacaacccatctaggtcacagcatcttcaagcacccagcttgatgcaaccttatccagtgggctcccgcaatggtagttcctctactgctccagttgtagggattgctcccatggttagtccttatggaggatacaaaggtgatatggtaggagattggccttctatataccaaccacggagagaggacagctctgcaaaagatttcagcttgcgtctgctttgtgctgcatcggacgttggaggtgtaattggaaaaggaggcggaatcatcaaacagattaggcaggaatctggagcttttataaaagtggatagttcaagtgccgaagatgattgcataattacagtttccgcaaaggagttctttgaagatcctgtctctccaacaattgatgccacagttcgtttacagccaaaatgcagcgagaaaactgatccagaatctggtgagccttcatatacaacacgcttgttggtgtcaacatcacagattgggtgtttgatcggcaaaggtggttcgatcattactgagatacgtagaacatcaagagcaaatatacgtatcctttcgaaggagaatgtcccaaaagtagcctctgaagacgaagagatggtgcagattagtggagaccttgaggttgcaaggcatgctcttgtgcaaataactacaaggctgaaagcaaacttctttgaaagagagggtgctttatcaggttttcaacctgtgattccttatcatcctatgcctgctagtatttctgatgagccaaagtatctaggcagggatactaagcctgctgggcatgattatccatattctggtggatatcgtgcatcagaggatatgcttcctgttgacagttatgcaaattatggcagctcccagatctctggaggaggctacggggcatacagtgggtacagtggtcgttccggtagcagtgggttatccggtcctagttatctaacttctggaaagcgctatggttactaggattcagattgtcaagtacaacagccaagacaaatgaagtttggagcctgtttattggagcccctacccaaaccagatgccgagagtttggaccttacggatgccatagactatcctcatagactttatcacttatgttgtcctctgggcctgtgtttgatgccctgccgtatatgttctgaacctgtgtattgaaaggtcacatttgagtctccgtacttgttgtcatgaaagctgtttcaacttagtttgtgtcaggagatcttgtttcccatttgccatccaaaagctaggatattctactttcccttgcttggaaaatgtggtttgcgtcatctttacacataagcgttacttcacctgtgatcaaagatttgttcctatttgcgacatgaggtaccactacaagctaggaatcctgaatatatcctcaatgagctcgaaagtgctaccataaaatctattttgcctatataactaattttggcatgattctctgaagtagtattagcttttttgcttgtgttgatttagatctgaagtgccttgccatgctgtgggcatgcccatgatcataacgtgccttttgacatgcatgtgttgacctgatgcccaattaagtactactccctccgtcccataattcttgtctcaaatttgccccaaaatggatgtatctattcctaaaaagcgtctagatacatgtaatattttgacaagaattatgggacggagggagtagtagcaagttacaaattgttgttatgcattaccattttggttaaactgtactgaatttgtctgacgtgtggatgaaaattacaattgcgtccacaccttttgacatgcatgtgttgccctgatgcccaattaagtatcagcaagttacagattgttgttatatcattgtgggaaaactgtactgaattcgactgaagtgtagatgacaaaacaggtgcagtcccagctatatcaggttctacatagtttactagatgctaagttttgagtttctttgtgttctggagtctttatccttgttaaccaggaaggtacaggggcatacacaattcctggagctgcagactgttgctgatctactctgcactggtcaaatacttatttcccgtagggcaattgttatcttgtgctttatgtctgtagttatgtatgttgaatttggtcactgctggtgaaattgagcattcgtttgtacgagaatttcctaggtgattatctttctaatgggacttttcgtgattagttatgtctgcataatgacaaaaactttgctgatacggtgaagatgctcaaattggaaaacacaatcctaggttttacctaggtttaggctcttgatgttggggaatagccctacgttctgtttttgtgttattatcaggaacgttag

SEQ ID NO: 3923 - DNA, 2824 bp, Brachypodium distachyon
ttagatcatggttgggcctgggcacagaaacagtcatggaaagcgatactctgattatgctgaaaatggaggtggcaaacgaagaaatcctggtgatgatacctatgctccttgtccagatgatactgtctatcgctacctctgcgcttctaggaaaatcgggagtatcattgggaggggcggagaaattgccaagcagttgaggacagatactcaagctaagattaggattggtgagagtgtccctggctgcgatgagcgagttatcacaatatttagctcaagcagggagactaataccgttgaagatactgaagataaggtttgccctgcccaagatgctctctttagagttcatgagaagcttatcactgatgatggtcctggggacgaagaaaatgaagaaggtttagctcaagttattgttcgtttgcttgtgccgtctgaccagattggatgcattattggaaaaggcgggcatatcatccagggcatccgcagcgacactggttcacatatacgtgtgcttagtactgaacatctccctgcatgtgctattagtggtgatgaacttctccagatatctggggacccattggtagttagaaaagctcttctccaagtatcatctcgtctccatgacaacccatctaggtcacagcatcttcttgcatccagcttgacgcaaccttatccagtgggctcccgccatggtagttcctctactactccagttgtagggattgctcccatggttaatccttatggaggatacaaaggtgatatggttggagattggccttctatataccaaccgcggagagaggagagctctgcaaaagagttcagcttgcgactgctttgtgctgcatcagacgttggaggtgtaattggaaagggaggcggaattatcaaacagatcaggcaggaatctggagcttttatcaaagtggatagttcaagtgcagaagatgactgcataattaccgtttcggcaaaggagttcttcgaagatcccatctctccaacaattgatgctacagttcgtttacaaccaagatgcagtgagaaaactgatccagaatctggtgagccatcttatacaacacgtttgttggtgtcaacatcacggattgggtgcttgatcggcaaaggtggttcgatcattactgagatacgtagaacatcaagagcaaatatacgtatcctttcgaaggagaatgtcccaaaagtagcgtccgaagacgaagagatggttcagatcagtggagacctcgatgttgcaaaacatgctcttgtgcaaataactacaaggctgaaagcgaatttctttgaaagagaggggtcgttatcaggttttcaacctgtgattccttatcatcccttgcctgctagtgttgctgatgagtcaaagtatctaggcagagatgctaagcttgggcatgattatccatactctggtggatatcgtgcatcagaggatatgcttcctgttgacagttatgcaaattatggcagttcccaggtctctggaggacgctacgggacgtacagtggtcgttcgggaagcagtgggttatctggccctagttatctatcttctggaaagcgctatggttactaggattgaggttgtcaaatacaacagccgagacaaatgaagttcggagcttgcttatggagcccctacccaaaccagatgccgagagtacgccccgcctgcaagctttgcctaagttgaccttccggatgccatagaccatcctcatagactatttcacttatattttcctctgggcatgtgtttgatgccctgccgtaaatgttctgaacctatgtatccaaaggtcacattttagtctctgtatttgttgtttgaaacctgtttcagcttagtttttgtcgggagatttcattccctacttccccttgcttgtaacatatgtttagtgccatctttacacacaattgtcattcttagaagcatagttcacctgaggtcaagtataccaagatttgttcctatttacaacatgagatatcacaacaagctaggaattctcaatgagctcaaaatgtgctagcataaaatttaattttccaatatacccaattttggcatgatgctttgaagtattagattttgcttttgttggtttagatctgaaagtgcgttaacatgctgtgggcatgcatgcacataagcagaatgacatgcatgggtttccctgatgctcaattaagtatcaacacaagttgtgttgttatgcattatcattttggataaactgtactgaattgatctgaggtgtggatgacaatacaattgtattcactccttttgacatctatgtgttcccctgattctcaattaagtatctggaagttacaagatgttatgcatcatcatgctggataaactgtactgaattcgtcataacaatacagttgcagtcccagctttatcaggttctacatagtttacataagttagattctaagttttgagtttcttgtgtttggaatctttatccttggttaaccaggaaggtgcaggagcataaacaattccagctgcagaccattgctgatatactttgcaccggttaaatatttatttccagttgggcagctgttgtattgtgctttcatgtttgtaattctcaaatcttgaattcggtcacttatgatgaagctgaacattcgtctgtatgaaaatttcctaggtgatcgctgttttaatgataatttctgtaatcatgtttcagtgagactaatcgtgtttcgttctgtctacatattaatataaagttgctgatatgct

SEQ ID NO: 3924 - DNA, 2217 bp, Triticum aestivum
cttttgtgttagaagttgctggagccttcacccagggtgcaaatcgcttattagcccccttctgttccgtgagactcatcgacttgtcgttctctcctcgtctccgtacgccagatctggtacccttctccggcggccggcgcgatcatggtcgggcctgggcaccggaacagtcatggaaagcggcagtctgattatgctgaaaatggaggtggcaagagaagaaatcctggtgatgatacatatgctcctggtccagatgacactgtctatcgctacctttgcacgtctaggaaaatagggagtataattgggaggggtggagaaattgccaagcagctgaggagcgatactcaagctaagattaggattggtgagagtgtccctaactgcgatgaccgagtcataacaatatttagctcaagcagggagactaataccattgaagataccgaagataaggtttgcgctgctcaagatgctctctttagggttcatgagaagcttgccacagatgatggtcctgtgaacgaagaaaatgaagagggtttaggtcaagttactgttcggttgcttgtgccatctgatcagattggatgcattattggaaaaggtgggcatatcatccagggaatccgcagcgacactggttcacaaatacgtgttcttagtaatgaacaccttcctgcatgtgctactagtggtgatgaacttctcctgataattggggatccgatggtagttagaaaagctcttctccaagtgtcatctcgcctccatggcaacccatccaggtcacagcatctccttgcgtccagcttaacccaaccttttccagcgggatcccgccttggtagttcctctactgcaccagttgtagggattactcctatggttagtccttatggacgatacaaaggtgatatggtgggagattggccttctatataccaacaacggagggaggtgagctctgcaaaagagtttagcctgcgtctgctttgtgctgcggcgaatgtcggaggtgtaattggaaaaggaggtggaattatcaaacagattaggcaagaatctggagcttttatcaaagtggatagttcgagtgctgaagatgactgcataattacagtttcggcaaaggagttctttgaagatcctgtctctccaacaattgatgctacagtccgtttacagccaagatgcagtgagaaaattgatgcagaatcgggggagccatcatatactacacgtttgttggtgtcgacatcacggatagggtgcctgatcggcaaaggtggttcaatcattacggagatacgaagaacatcgagagcaaacatacggatcatttcgaaggaggatgttccaaaagtagcatcggacgacgaagagatggtccagatcagcggagatcttgatgttgcaaggcatgctcttgtgcaaataactacaaggctgaaagccaacttctttgaaagagaaggtgctttatcaggttttccacctgtgatcccatatcaccctttgcctgctagtgtgtccgatgagccaaagtatctaagcagagacaataagtctgctgggcacgattatccatattctagtggatatcgtgcatcagacgatgtgcttcctgttgaccgttatgcaaattatggcagctcccaggtctacggaggcggctatggtgcttacagtggtggttctggcagcagcgggttatctggctctacctatctttcatctggaaaacgctatggctattaaaatgcaggttgtcgaatccaacagctcagctctcttccgatgaacctgtccgtttcacatttgcacccctgcccaatcctttactgaaaacagccaagaccaatgaagtttggagcctgcttattggagcccctacccaaaccagatgactgagagtatggcccaacctggaagctttgcttaagaggacctgtctggatgccataaaccctctgatttccctagtagaatacatttactctttatcttttcctccgggcctgtgtgtgatgccctgccgtaaatgttctgaacctatgtattggaaggtcacatataagattctgtatttgttgtcctaaaacctgcttagtagtttgtatgagagacttggtcccctattcgccatccaaaacttaggagatgctacttgcccttgcatgcaaatatgcattccttcattgatacata

SEQ ID NO: 3925 - DNA, 2094 bp, Zea mays
cgccaagcttctttactcgggagccttttatgtcaaagttggcaaccttccccgagtggccgagttcctcactcagctggggacaccacccggccaccctcacctctcaatatacataccaccaccaccttcatcaacccctgggcctggcactcatagctcgttcgtagcaagagagagagagagaagagtgggaagtctcacgccatcagggagaggggagcgaggatcacatctctcgtagcgcgcgcgaagctatataataatggagggtggccatggccgtgaaggtgctgctgagcctgtgctgcgtgggggcgtgcggcctcgccgtgtacctctaccacatcctctggctcgtgccgcagaaggtcctcgccaagttcgaggaccagaagatcggcgggccgcggccgtcgttcccgtacggcaacctcgccgacatgagggaggcggccgccgctgcgaaggctgcgcgcgcgtcggcacgcagtagcggcagcggcggcggcggtggcggcggcatcgtgcacgactaccgcccggcggtgctgccctactacgagaaatggaggaaagagtacggtcccatattcacttactccatggggaacgtcgtattccttcacgtgagccggcccgacgtggtccgggacatcaacctctgcgtgtcgctggacctcggcaagagctcctacctcaaggcaacgcacgagcccctcttcggcgggggcatcctcaagtccaacggcgaggcctggctgcaccagaggaaaatcatcgccccggagttcttcctggacaaggtcaagggcatggtggatctgatggtcgattctgcacagccactgcttatgtcatgggaagagagagttgatagaaatggtgggatcacagacattaagatcgacgatgacatcagggcttactctgcagatgtgatctctagaacgtgctttggaagcagctacatcaaaggaaaggaaatctttatgaagatcagagaactccagcaggctgtgtccaagccaaatgtgctagctgaaatgactggcctaaggttctttccttcaatgaggaacaagcaggcctgggagcttcacaaacaagtccgcaaactaattcttgaaatcgtaaaggaaagtggagaagacaggaacttactgagtgcaattcttcacagcgcaagcaccagtagggtgggcattgccgaggcagagaactttatagtggataactgcaagagcatatattttgcaggacatgagagcacagctgttacagctgcgtggtgtctaatgctccttggactgcacccagaatggcagaatcgagtacgagaagaggtgcatgaagtctgcagaggccagccagtagactcacggtcacttcagaagatgaaaaatttgacaatggtgatccaggaaaccttgaggttgtacccagcaggtgcctttgtttcaaggcaggccctccaggaactgaagctcggtggcgtacatataccaaaaggtgtcaacatctacatccctgtctccacaatgcatcttgacccagagctatgggggcctgatgtgaaagagttcaacccagagcgcttctctgatgttcgaccccagctacattcatacttgccatttggtgctggggcccgaacctgcctagggcagggatttgctatggctgagctcaagatcctcatctctctcatcgtctccaagtttgttttgaagctctcaccacactaccagcattctccaacactgaaactcattgtggagccagaacttggtgtagacctcaccttaacgaaagtgcaaagtgtctgtactaagaggggcactgcaatttagtcatacaatgtcatggaatgaaacctgtgctatggtgaatgcagcttcccctgcggagaggggacaatttgtacagagacagctcatactatctacgcatgatcttttcaatgtgcatgattatagtaagaaatggtgccaaatgatccaatcatttataccaacattgtatgggaaaactatacagctattaaatttagtaatgaaacgaaatatattggaacattattaaggtgttcaa

SEQ ID NO: 3926 - DNA, 2109 bp, Setaria italica
ctccttttgggagcctttttatgccaaagttggcatttggactctcgcaccttcccctagtagtccagactccagaccccctctatatacacataccaccaccttggcaccttcagcaaacacaaccaacctggcactctctcatagctagagagagagagaggcgtagagataatcagatcgtcagtcagagagagggggagctatatatagcctgtatcattgaggaggaggaggagagagagatggagcaggtggccatggcggtgaaggtgttgctgagcctgtgctgcgtgggggcatgcggcctcgccgtgtacctctactacatcctctggctcgtgccgcagagggtcctcgccgagttcaggcggcagggcatcggcgggccgcggccgtcgttcccttacggcaacctcgccgacatgcgggaggcggtcgccaccgcgaaggctgcgcgcgcgtcggcgcgccgccctggctgctgctgcggcggcggcggcatcgtgcacgactaccggccggccgtgctgccctactacgagaaatggaggaaagagcatggccccatattcacttactccatggggaacgtcgtattccttcacgtgagccggccggacgtggtccgggacatcaacctctgcgtgtcgctggacctcggcaagagctcctacctcaaggccacgcacgagccgctgttcggcgggggcatcctcaagtccaacggtgaggcatggctgcaccagaggaagatcatcgcccctgagttcttcctggacaaggttaagggcatggtggatctcatggtcgattctgcgcaaccactgctcaagttgtgggaagagagagttgacagaaatggtgggatcacagacattaagatcgatgatgacattagggcctactctgcagatgtgatctctagaacatgcttcggaagcaactacatcaaaggaaaggaaatttttataaagataagagaactacagcaggctgtgtccaagccaaatgtgctagctgaaatgactggcctaaggttcttcccttcgacgaggaacaagcaggcatgggagcttcacaaagaagtccacaaacttatcctagaaattgtaaaggaaagtggagaagacaggaacttactaagtgcaattcttcacagtgcaagctacagcagggtgggtatcgccgaggcagagaactttatagtggataactgcaagagcatatattttgcaggatatgagagcacagctgtcacagctgcctggtgtctaatgctccttgggctgcacccagaatggcaggaccgggtacgagcagaggtgcatgaagtctgcagaggccggccattagactcccagtcacttcagaaaatgaaaaatttgacaatggtgatccaggagaccttgcgcttgtacccagcaggggcctttgtatcaaggcaggccctccaggacctgaagcttggaggtgtacatataccaaaaggtgtcaacatctacatccctgtctccacaatgcatcttgaccccaagctatggggcgccgatgtgaaagagttcaacccagagcgcttctctgatgttagaccccagctacattcatacttgccgtttggtgctggggcacggacctgcctagggcagggatttgctatggctgagctcaagatcctcatctctcttatcatctccaagtttattctgaagctctcaccacactacgagcattctccaacacttaaactcattgttgagccagagcttggtgtggacctcacgttaacaaaagtgcagtgtctatagactaagaggaggtctgcaattcaacacgataacattagtcatactatgtgatggaaaggaaactatgatctgatgaatgcagctaccaaggagggaggggggagggggggtgttgtaatttgtacagagatatcccatgatatttaggcttgatctttatcttgttcatgttcgtaataagtcgatagagaaatggtgccaaatgaggcaatcatttgtgccaacattgtatgggaaaacactacagctatagaattagtaccaaaaagaatatatgttggaacattattaaggtgttcaa

SEQ ID NO: 3927 - DNA, 1951 bp, Panicum virgatum
cataatcataggtagagagagaagagtagagatccccacatcatcggagagaggggaggggagtgggggagcaagaattaatcattctagtctgcatcaccgaggaagcagatagagaaagagaaagatggagcaggtggccatggcggtgaaggtgttgctgagcctgtgctgcgtgggggcgtgcggcctcgccatgtacctctaccacaccctctggctcgtgccacagagggtcctcgccgagttcaggatgcagggcatcggcgggcccccgccgtcgttcccttacggcaacatcgccgacatgcgggaggccgtcgccgccgcgaaggccgcgcgcgcatcggcacgccgcgccgccgcaggcgccggcgccggcggcatcaggcacgactaccggcctgcggtgctgccctactacgagaaatggaggaaagagcacggtcccatcttcacttactccatggggaacgtcgtattccttcacgtgagccggccggacgtggtccgggacatcaacctctgcgtgtcgctggacctcggcaagagctcctacctcaaggccacgcacgagccgctcttcggcgggggcatcctcaagtccaacggcgaggcctggctgcaccagaggaagatcatcgcccccgagttcttcctggacaaggtcaagggcatggtggatctcatggtcgattctgcgcaaccactactgaagtcatgggaggagagagttgacagaaatggtggggtcacagacattaagatcgatgatgacattagggcctactctgcagatgtgatctctaggacgtgcttcggaagcagctacattaaaggaaaggaaatctttatgaagatcagagaactacagcaggctgtgtccaagccaaatgtgctagctgaaatgactggcctaaggttctttccttcaatgaggaacaagcaggcgtgggagcttcacaaagaagtccgccaacttattctagaaatcgtaaaggaaagtggagaagacaggaacttattaagtgcaattcttcacagcgcaagctgcagcagggtgggcatcgccgaggcagagaactttatagtggataactgcaagagcatatattttgcaggacatgagagcacagctgtcacagctgcctggtgtctaatgctccttggactgcacccagaatggcaggaccgggtacgagcagaagtgcatgaagtctgcagaggccggccagtagactcccaatcacttcagaaaatgaaaaagttgacaatggtgatccaggaaaccttgcgcttgtacccagcaggggcctttgtatcaaggcaggccctccaggacctgaagcttggtggtgttcatataccaaaaggtgtcaacatctacatccctgtctccacaatacatcttgaccccgagctatggggcgctgatgtgaaagagttcaacccagagcgcttctctgatgttaaaccccagctacattcatacttgccgtttggtgctggggcacggacctgcctagggcagggatttgctatggctgagcttaagatcctcatctcctttatcatctccaagtttgttctgaagctctcaccacactacgagcattctccaacgcttaaactcatcgtggagccagagcttggtgtggacctcaccttaacaaaagtgcagtgtctatactgactaagaagggctctgcaattcgggcacaatgatattagtcgtactatgtgatggaatgaaaactatgatctgatgggcgcagcttcccaggaaaaagagggggtggggtaatttgtacagagatatcccatgatatgtgattatgtaggcttgatctttttgtgtgcatgttcataataagttgatagagaaatggtgccaaatgagccaatcatttatgccaacattgtatgggaaaacaccacagctttaggtccg

SEQ ID NO: 3928 - DNA, 1742 bp, Hordeum vulgare
gagagaagtgcagagagatcaagttgttagacaacttaaagagagagagagagagagagagatgatggacatggagatggaggtgggcatggtgatgaaggtgctgctaggcctatgctgcgtgggggcgtgctccctcgcgctctacctctactacaccgtgtgggtggtgccgcagaggcttctcgcggggttcaggaggcagggcatcggcggcccgcgcccgtctttcccttacggcaacatggccgacatgagggaggcggtcgccgccgcaaagtcggctcgccgatccggcggccgcatgcgcatcgtccacgactaccgcccagccgtgttgcccttctacgagaaatggagaaaagagcatggtccagtgttcacttactcgatggggaacgtggtgttccttcacgtgagccggccagacgtggtccgggacatcaacctctgcgtctcgctggacctcggcaagagctcctacctaaaggccacgcacgagccgctgttcggcagaggcatcctcaaatccaacggggaggcatgggcccaccagaggaagatcattgcgcctgagttctttctcgacaaggtcaagggaatggtggatctgatggtagattccgcacaaacgctgctcgagtcatgggaagcgagggtcgacaaaagtggcggcactgtagacatcaagattgacgacgacattcgagcctactccgcagatgtcatctccaggacatgcttcggaagcagctacgtcaaaggaaagaaaatcttcctgaagctcagagaactgcagaaggccgtgtccaagccaaatgtgctggctgaaatgaccggcctacggttctttcctacaaagaagaacaggcaggcgtgggggcttcacaaacaagtgcacagactgatactagagatcgtcaaggaaagcggagaggacaagaatttactgcgtgccattcttcacagcgcaagcagcagcaaggtggggctgggcgaggcagagaactttatagtggacaactgcaagagcatatattttgcaggatacgagagcacagctgtaacagctgcctggtgtctaatgctccttggactgcacccagaatggcaggaccgggtccggcaagaggtcctggaggtctgcgggggccgtccgctagactcccaatcactgcagaaaatgaagaatctgacgatggtgattcaggaaactctgaggctgtacccagcaggcgcgtttgtgtcaaggatggcccttcaggaactgaagctggggggcgtacacatacctaaaggtgtcaacatctacatccctgtctccaccatgcaccttgaccccaagctgtggggtcctgatgccaaggagttcaacccggcacgcttctccgacgctcgaccccagctgcactcctacttgccatttggcgccggcgctcggacctgcctcggccaagggttcgccacggcggagctcaagatactcatatctctcatcatctccaagtttgcgctcaggctctcgccactctatcagcattctccagcactcaaactcatagtcgagccagagttcggcgtcgacatcaccttaaccaaagtgcagactgcttctactaccacgtactaattaagagaggcaatgtggtctggatataataatgcaaagaaatttgtacgtggtttaatcaatgaatgcagctttcttgagaaaatgtacagatacacgtgtggtttgttca

SEQ ID NO: 3929 - DNA, 1677 bp, Brachypodium distachyon
atggaggtgggcatggtgatgaaggcgtctctgagcctgtgctgcgtgggggcgtgctgcctcgcgctctacctctactacatcgtctgggtggtgcctcagaggctgctcgccgggttcagaaggcaggggatcggcgggccgcgcccgtccttcccttacggcaacctcgccgacatgaaagaggcggtcgccgccgccaaggtggcaagccgaggcgtcggcggcatcgtgcacgactaccgccccgccgtgctgcccttctacgagaaatggagaaaagagcacggccccgtgttcacttactccatggggaacgtggtgttccttcacgtgagccggccggacgtggtccgggacatcaacctctgcgtctcgctggacctcggcaagagctcctacctaaaggccacgcacgagcccctcttcggcaggggcatactcaaatccaacggccaggcctgggcccaccagaggaagatcatcgcacccgcgttcttcctcgacaaggtcaagggaatggtggatttgatggtggattctgcgcaaacactgctcaagtcatgggaagagagggtagacggaaatggcgggaccgtaaacatcaagattgatgatgacataagagcctactctgcagatgtgatctccaggacatgcttcggaagcagctacatcaaaggaaagaaaatatttttgaagctaagagaactgcagaaggccgtctccaagccaaatgtgctagctgaaatgaccggcctaaggttgtttcctacaaagaagaacaggcaggcatgggagcttcacagacaagtgcacaaactaatactagaaattgtgaaggaaagcggagaagacaaaaacttactgagtacaattcttcatagtgcaagcagcagcaaggtgggcctcggcgaggcagagaactttatagtcgacaactgcaagagcatatattttgcaggatatgagagcacagctgtaacagctgcctggtgcctaatgctccttggactgcacccagaatggcaagacaaggtgcgagaagaagtgcaggaggtttgtgggggccggccaatcgactcccaatcacttcagaaaatgaagaatctgacaatggtaatccaggaaactctgcgattgtacccagcaggtgcctttgtatcaaggatggcccttcaggagctgaagcttgggggtgtaaacataccaaaaggtgtcaacatttacattcctgtctccacaatgcaccttgatcccaagctgtggggtgctgatgttaaagagttcaacccagaacgcttctccgatgctcgaccccagctacattcttacctgccgtttggcgccggtgctcggacctgccttggccaaggattcgctacggctgagctcaagatactgatatctctcatcatctccaagtttgcactgaagctctcgccactgtacgagcattctccaacactgaaactcgttgtggagcctgagtttggtgttgacctcaccttaacgaaagtgcaaggtgcttgtagatgctaagatgggcattgcgatttggatataataatgttacttcccatcctgaatggttgaaagaaaattatacttgaatgaatgcagcttcaaaaagatgtacatgtacatacagagctccatattattcaggtttgatct

SEQ ID NO: 3930 - DNA, 2172 bp, Brachypodium distachyon
ggcatccatacacacaccacacggcatgtgagtgcgacgtcccttgcttcttgaacttcgtttctggcatgggggagctcggccggtctatgacaaagttggcatttggactctaccacctttccccacttgatttccacaccatataacacactaaccaagctcgctaacttcttcacccatcagtcgtcacacacatactctctgcgggcactcacatagagaggagtgcagagatcaagttgtgcgtgtgacagaggagacaaaatagagaataagtagggagggaagatagagagctagcagggagggaagatggaggtgggcatggtgatgaaggcgtctctgagcctgtgctgcgtgggggcgtgctgcctcgcgctctacctctactacatcgtctgggtggtgcctcagaggctgctcgccgggttcagaaggcaggggatcggcgggccgcgcccgtccttcccttacggcaacctcgccgacatgaaagaggcggtcgccgccgccaaggtggcaagccgaggcgtcggcggcatcgtgcacgactaccgccccgccgtgctgcccttctacgagaaatggagaaaagagcacggccccgtgttcacttactccatggggaacgtggtgttccttcacgtgagccggccggacgtggtccgggacatcaacctctgcgtctcgctggacctcggcaagagctcctacctaaaggccacgcacgagcccctcttcggcaggggcatactcaaatccaacggccaggcctgggcccaccagaggaagatcatcgcacccgcgttcttcctcgacaaggtcaagggaatggtggatttgatggtggattctgcgcaaacactgctcaagtcatgggaagagagggtagacggaaatggcgggaccgtaaacatcaagattgatgatgacataagagcctactctgcagatgtgatctccaggacatgcttcggaagcagctacatcaaaggaaagaaaatatttttgaagctaagagaactgcagaaggccgtctccaagccaaatgtgctagctgaaatgaccggcctaaggttgtttcctacaaagaagaacaggcaggcatgggagcttcacagacaagtgcacaaactaatactagaaattgtgaaggaaagcggagaagacaaaaacttactgagtacaattcttcatagtgcaagcagcagcaaggtgggcctcggcgaggcagagaactttatagtcgacaactgcaagagcatatattttgcaggatatgagagcacagctgtaacagctgcctggtgcctaatgctccttggactgcacccagaatggcaagacaaggtgcgagaagaagtgcaggaggtttgtgggggccggccaatcgactcccaatcacttcagaaaatgaagaatctgacaatggtaatccaggaaactctgcgattgtacccagcaggtgcctttgtatcaaggatggcccttcaggagctgaagcttgggggtgtaaacataccaaaaggtgtcaacatttacattcctgtctccacaatgcaccttgatcccaagctgtggggtgctgatgttaaagagttcaacccagaacgcttctccgatgctcgaccccagctacattcttacctgccgtttggcgccggtgctcggacctgccttggccaaggattcgctacggctgagctcaagatactgatatctctcatcatctccaagtttgcactgaagctctcgccactgtacgagcattctccaacactgaaactcgttgtggagcctgagtttggtgttgacctcaccttaacgaaagtgcaaggtgcttgtagatgctaagatgggcattgcgatttggatataataatgttacttcccatcctgaatggttgaaagaaaattatacttgaatgaatgcagcttcaaaaagatgtacatgtacatacagagctccatattattcaggtttgatctttctcgtgttggagttcagctccaataggctgaactagaggaaaaaggtggggagccaaatgagtaaaatggttgagtcgacaccatgtacaaaacagttgcagctgtcatgatgtgaataccaacgcaagaaggcaacattattagaacaaaatagagagtgcgctaaacacaatacag

SEQ ID NO: 3931 - DNA, 1672 bp, Secale cereale
tagagagagagagagagatgatggaggtgggcatggtgatgaaggtgctgctaagcctatcctgcgtgggggcgtgctccctcgcgctctacctctactacaccgtctgggtggtgccgcagaggcttcttgccggcttcaggaggcagggcatcggcggcccgcgcccgtctttcccttacggcaacatcaacgacatgagggaggccgtcgccaccgcaaagtcggctcgcccagccggcggccgcatcatccacgactaccgcccagccgtgctgcccttctacgagaaatggagaaaagagcatggtccagtgttcacttactccatggggaacgtggtgttccttcacgtgagccgggcagacgtggtccgggacatcaacctctgcgtctcgctggacctcggcaagagctcctacctaaaggccacgcacgagccgctgtttggcagaggcatcctcaagtccaacggcgaggcttgggcccaccagaggaagatcattgcgcccgagttctttctcgacaaggtcaagggaatggtggatctgatggtggattctgcgcaaacactgctcgagtcatgggaagcgatggtcgacaaaaatggcggcactgtagacatcaagattgacgacgacataagagcctactccgcagatgtcatctccaggacatgcttcggaagtagctacgtcaaaggaaagaagatcttcttgaagctcagagagctgcagaaggccgtgtccaagccaaacgtgctagccgaaatgaccggcctaaggttctttcctaccaagaagaacaggcaggcgtgggggcttcacaagcaggtgcacaggctgatcctggagatcgtcaaggaaagcggggaggacaagaatttactgcgtgcgatccttcacagcgcaagcagcagcaaggtcgggctccgcgaggcagagaactttatagtggacaactgcaagagcatatattttgcaggatacgagagcacagctgtaacagctgcctggtgcctgatgctccttggcctgcacccagaatggcaggaccgggtccggcaagaggtgctggaggtctgcgggggccgtccagcagactcccaatcacttcagaaaatgaagaatctgacgatggtgattcaggagaccctgaggctgtacccagcaggcgcctttgtgtcgaggatggcccttgaggaactgaagctggggggtgtgcacatcccaaaaggcgtcaacatctacatccctgtctccacgatgcacctcgaccccaagctgtggggtcctgatgccaaggagttcaacccggcacgcttctccgacgctcgaccccagctccactcttacttgccatttggggccggcgctcggacctgcctcggccaagggttcgccacggcggagctcaagatactcatatctctcatcatctccaagttcgcgctcaagctctcgccgctctatcaccactctccagccctcaaactcatagtggagccagagttcggcgtcgacctcaccttgaccaaagtgcagactgcttctactactacatactaagggacgaaagtgtggcctggatataataatgttggcatcggtcctggctcatgaaaagaaatttgtacgtagtttaatcatcaatgaatgctgcttgcttgaga

SEQ ID NO: 3932 - DNA, 3354 bp, Setaria italica
gcgtggtgtttttgtggacgacgccgtcgtcgccatccagccagcttcatgtggctctgcgctgcccccctcctccctccctgcccctccagaaaagtccattctttactccgagtatttagcctcgcctattgctgacacagctctcccgcgggcgttgtctgcgtggaatcctccgttccattccacaacaaatctctcgctgccgagcccagggaaaggaaatctcctcttctttgtgttcggttttgcatcgatttgtttggtttccgggtcttgcgctctgcgcagatccaacggtgggggaatctctcgttgtggggggttgaattggatcgatttcgattcgtttgttggcgttcttgatccgaaaggtgtgagatttgattgggttctctctcctggagcatttgtgtttgtaagcgacaaggatgctctacttgaagcagccgacgaggagctgaacaactacagggagtctttggttttttacaatttctcggtcaggacctggtgtttgtttgtcgatctgatccgatggaggctatgacgggtggtaaattcctgcaaaagtttcggctctacgaaaccagatcgaaattttaccttattggaagagacaagagcagggctcactggagggtcttaaagattgatcggatggagtgtactgagctgggtgtcgaggaggatccaactatttacacggagagtgaatgccaagaactgctttggcggattcatgaggggaataggttgactggtggactgaaatttgtcacaaaatgctatggaatagttggttttgtaaagtttcttggtccttattacatggttgtaataaccaggagaaggaaagttggcacaatatgcggccatgaaatctattccattggcaagagtgaaatgatcacaattccaagtgttatagtctggcccaacgtggcttattctagggatgagaacagatataagcgcctactttgctcggttgatctttcaaaggatttcttcttcagctactcttacaacatcatgcgcagccttcagaagaacataactgagaagaatactggacaggttgtttatgaaacaatgtttgtatggaatgaatttctgacacgagcaattcggaatcatctcaagaataccagttggactgttgccttagtccatggattttttaaacagtcgaagctctcagtatccgggaaggatttttggttgacacttatagctaggcgctcgcgccattttgctggaacgagattcttgaaacggggtgtgaatgaaaagggcagggtcgccaatgatgttgagactgaacagattgtttttgaagacacatctgatggaatcccaagtcacatggcttctgttgtacaacatagaggatcaatacctcttgtctggtttcaggaaacttcaagacttaatattagaccagatattattttaaaagccgatgtggactacaaggcgactcgtcttcattttgagaaccttgcacttagatatgggaatccaataatcatcttgaacttaataaagacccgcgagaagaagcctcgtgaatctttgctccgtgcagaatttgctaaggctatccattacattaataaggggctaacagaggacaagcgtctaaaatttttacacatggatttgagtaagctttctcgaaggaaaggtaccaatgtgcttgcactgttaaacaaggtggcatcggatgtgttggatctaactgaattcctccactgcaaaataagtacatcagccaaatctgaggatgccacaagtggcgaaagaactgttaccaaaccacatgatgacaaaagtagcagcgtgcaaagcgaatgcgtagctaagttggtacctattttgttacagaagggtgtcctcaggacaaattgtatagactgcttggaccgcacaaatgttgcacaatttgcatacggtttagctgctttaaggcgtcaacttcatgcgctggggcttactgaagcacctaaaattgaattgcatgctcctctggctgacgatctgatggatttctatgaacgaatgggtgatacattagctattcaatatggtggttctgcagctcacaacaagatcttctgtgagcaaagaggccaatggaaggcagcaacccaatctcaggagttccttcgaacccttcaacgctactacaataacgcctacactgatcatgacaagcaggatgctataaacgtgttcttaggtcatttccaacctcaacaagggaaacctgcattatggaagttggactccgatcagcattacaacattgggaggcaaggaactttaaaagaagagattgcaagatcattcataaagaggtcgctatcagatggtaatattttgttggagaacagcctacctgtatctaactgcaatagtggagaaaacaacactgcgttgcttcctatgcaacagctggatgatattagagagccttctgattctgcaccagatatctccatatgtgaacctaacccatgctccagtatgaactatggcacagtgcctgcaaggcactccatgtcagaagagcggcagagttatctgaaaagattaggttaccctgagttgcattcctcaaattttcttgatcttgatttgttgtcatcttcggggaattcctgtgatgaggaagtttttgagaggtcgtcgctgatcaattcgcctatggatgagatcagtgtagaatcatctacgtcttatagcgaacaaggacacctcgatgagggaagggatgacacggatctgtctcgttcgagcagccagctctcagacactagggactattctgaccgcttcgcgcactgggttgctaatggaggcatgctttgctactaggtggcgaactttttgtctcggtgacaactctgtaggaattttgagcagcaggaaatggctgacggctagagcagatcaaatggctgatggctaggcgcatctgcctgcataagagatgagactgaagagatggcggccatgggagaagcctcgcaccatcgtggttgtgatcactggaagtaatcagaggagatggcggcggctgggttgggtacaggattcaatttgctgtggtgaagaatttgaccatagcttagacaataaataggccaaagtatatctgattcttttagcttagcttacattttccctttctccatagaaattatgaaaaaaatataaaaaagtattttttaaaaaaaagaagaaaaaaggtgaaaaaagagcactgttgttgtaaatagtatgttacagaaatagaaatatttgctgcttatatcagttcaatttcggaggcctctgtttgtctgt

SEQ ID NO: 3933 - DNA, 3353 bp, Pennisetum glaucum
cccgcgtggtgtttttgtggacgacgccgtcgtcgtcgtcgccagccagcttcatgtggctctgcgctgcccccttcctccctccccgcccctccagaaaagtccattctttaccccgagtatttagcctcgcccgttgctgacacagctctcccgcgggcgttgtctgcgtggaatcctccgttccatcccacaacaaatctctcgctgccgagctcagggaaagggaaatctcctcttctttgtcttcagttttgcatcgatttgtttagtttccggggcttgcgtcctgcgcagatccaacggtgggggaatctctcgtcgtgggggttgaattggatcgatttcgatccgtttgttggcgttcttgatccgaaaggtgtgagctttgattgggttctatctcctggagcatttgtgtctgtaagcgacaaggatgctctacttgaagcagccgacgaggagctgaacaactacagagggtctttgtttctttctcacaatttctcggccagtgttcgtttgtcgatctgatccgatggaggctatgacgggtggcaaattcctccaaaagtttcggctctacgaaaccagatcgaaattttaccttattggaagagacaagagcagggctcactggagggtgctgaagattgatcggacggagtgtactgagctgggtgtcgaggaggatccaactatttacacggagagtgaatgccaagaactgctttggcggattcatgaggggaataggttgactggtggactgaaatttgtcacaaaatgctatggaatagttggttttgtaaagtttcttggtccttattacatggttgtaataaccaggagaaggaaagttgggacaatatgcggccatgaaatctattccattggcaagagtgaaatgatcgcaattccaagtgttatagtctggcccaacgtggcttattctagggatgagaacagatataagcgcctactttgctcggttgatctttcaaaggatttcttcttcagctactcttacaacatcatgcgcagccttcagaagaacataattgagaagaatactggacaggttgtttatgaaacaatgttcgtatggaatgaattcctgacacgagcaattcggaatcatctcaagaataccagttggactgttgccttagtccatggattttttaaacagtcgaagctctcagtatctgggaaggatttttggttgacacttatagctaggcgctcgcgccattttgctggaacgagattcttgaaacggggtgtgaatgaaaagggcagggtcgccaatgatgttgaaactgaacagattgtttttgaagacacatctgatggaatcccaagtcacatggcttctgttgtacaacatagaggatcgatacctcttgtctggtttcaggaaacttcaagacttaatattagaccagatatcactttaaaagccgatgtggattacaaggcgactcgccttcattttgagaaccttgcacttagatatgggaatccaataatcatcttgaacttaataaagacccgtgagaagaagcctcgtgaatctttgctccgtgcagaatttgctaaggctatccattatattaataagggactgacagaggacaagcgtctgaaatttttacacatggatctgagtaagctttctcgaaggaaaggtaccaatgtgcttgcactgttaaacaaggtggcatcagatgtgttggatctaactgaattcctccactgcgaaatagctacatcagttaaatctgaggatgccgcaagtggcgaaagaactgttaccaaaccacatgatgacaaaagtagcagcgtgcaaagtgaatgcgcagctaagttggtacctattttgttacagaagggtgtcctcaggacaaattgtatagactgcttggaccgcacaaatgttgcacaatttgcatacggtttagctgctttagggcgtcaacttcatgcgctggagcttactgaagcacctaaaattgaattgcatgctcctctggccgacgatctgatggatttctatgaacgaatgggtgatacattagctattcaatatggtggttctgccgctcacaacaagatcttctgtgagcaaagaggccaatggaaggcagcaacccaatctcaggagttccttcgaacccttcagcgctactacaataacgcctacactgatcacgacaagcaggatgctataaacgtgttcttaggtcattttcaacctcaacaagggaaacctgcattgtggaagttggactctgatcagcattacaacatcgggaggcaaggaactttgaaagaagagattgcaagatcattcataaagaggtcgctatcagatggtaacattttgttggacaacagcctacctgtatctaactgcaatagtggagaaaacaacactgtgttgcttcctatgcaacagctggatgatattagagagccttctgattctgcaccagatatctccatatgtgaacctagcccatgctccagtatgaaatatggcacagtttctgcgaggcactccatgtcagaagagcggcagagttatctaaaaagattaggttaccctgagttgcattcctcaaactttcttgatcttgatttgttgtcatcatcggggaattcctgcgatgaggaagttttcgagaggtcatcactgatcaattcgcctatggatgagattagtgtagattcatctacatcctacagtgaacaaggacacgccgatgagggaagggatgacacggatctgtctcgctcaagcagccagctctcagacactagggactattctgaccgctttgcgcaatgggtcgctactggaggcatgctctgctactaggcggtgaacttttttttttgcctcggtgacaactctgtaggaattttgaggcagcaggaaatggctgatggctagagcagatcaaacagctgatggctagagacatctgcctgcataatcagaggcagcaggaagagacgagacgagactgaagagatggcagtcacgggagaagattcgcaccatcgtggttgtgatcactggaaggcttgacggacggcttcacgttgataatcagagatggcggcttggtttcggtacatgattcaatttgctatggtgaagaatttgaccatagtttagacaataaataggccaaagtatatctgattcttttagcttagcttacattttccctttctccatagaaaatatgaaaagaaaaaagtaattattttttaaaaaaaggaaaacgagaaaggaaaaggttgaattatcgataaagaacaatgctgttgtaaatagtatg

SEQ ID NO: 3934 - DNA, 3335 bp, Zea mays
gcctcgcctattgttggcacatgtcttcccgcggccgttgtttacgcagaatcctcctgttccactcctcgccaaatgtcttttgttagagttcatatgaaatttctggtcgttcaattttagatcgatttctttacggcgtattttgattgcatcgcgaccggctccggagccatccggtcataagaccgtaccaacgcatttctttggtttgaggtgcgggacggcgggcgccgaacggtcgtgtgccgtagatccaaagtcgcgggaaatctctggtcgaggagtcgatttggatccgtttatcgctagtttggtcgtcgttgatctgaaaggtggagctttggtcgattttctcttccagaagcatttgtgtttctgaggtgctaaggtgctatatctgaagcagccgacgaggagctgagtctttgattttttttttaccaatttctgtcgtcgtttgttgatctgatccgatggaggctatgacgggtggcaaattccttcaaaagtttcggctctacgaaaccagatcgaaattttatcttattggaagagacaagagcaggattcactggagggtgctaaaaattgatcggtcggagttcactgagttgggtgtcgaggaggatccaactatttacacagagaatgaatgccaagaactgcttcggcggatccatgaggggaacaggttgaccggtggactgaaatttgtcacaaaatgttacggaatagttggttttgtaaagtttcttggtccttattacatggttataataaccaggagaaggaaaattggcacaatatgtggccatgaaatttattccgttggcaagagcgaaatgattgcaattccgagtgttacagtctggcccaacatggcttattctagggatgaaaacagatataagcacctgctttgctcagttgatctttcgaaggatttcttcttcagctactcttacaacatcatgcacagccttcagaagaacataaccgagaagaacattgggcaggtttatgaaacaatgtgtgtatggaatgaatttatgacacgagcaattcgggatcatctcatgaatacctgttggactgttgctttagtccatggattttttaagcagtcaaggttctctgtgtctgggaaggatttttggctgacgcttatagctaggcgctcacgccattttgctgggaccagattcttgaaacgtggtgttaatggaaagggcagggtagccaatgatgttgagactgaacagattgtttttgaagacacatctggtggaatcccaactcagatggcttctgttgtacaacatagaggatcgatacctcttgtctggtttcaggaaacttcaagacttaatattagaccagatattatattaaaacctgatctggactacaaggcaacccgccttcattttgagaaccttgcacttagatatgggaatccaataatcatattgaacttaataaaggcaagtgcagcatcattgttgtttgatacccacgagaagaagccccgtgaatctctgctctgtgcagaatttgcaaaggctattcattacattaacaagagcctatctgatgacaagtgtctaaaatttctgcacatggatctgagtaatctttttcgaaggaaaggcaccaatgtgcttgcactgttgagcaaggtggcatcagatgtgttggatctaactgaattcctccactgcgaaataagtacatcaacaaaatctgatgacatctcaagtgaagaaaaaactgttgccaaaccacgtgatgacagaagtagcagagatcaaactgaatgtgcagctaagttggtacctcttttattacagaagggtgtcctcaggacaaattgtatagactgcttggatcgcacaaatgttgcacaattttcatatggtttagctgctttagggcgtcaacttcatgcactgggacttgctgaagcacataaaattgaattgcatgatcctctggttgatgatctgatggatttctatgaacggatgggtgatacattagctattcagtatggtggctctgctgctcacaacaagatcttctgtgagcaaaggggccaatggaaggcaacaacccaatctcaggagttccttcgaacccttcaacgctactacaataacgcctacactgatcacgagaagcaggatgctataaacatgttcttaggtcatttccaacctcagcaagggaaacctgcattgtggaagctggactcagatcagcattacaacattgggaggcaaggaactttaaaagaagagattggaagatcattcataaagaggtcactatcagatggtaacatactgttggagagcagcttgcctgtaactatctgtaacaatgaaacagacaacacagaattgctcccagtgcaacagctggatgatattagagaagcttctgattctgcgccagagatctccatatgcgaacctaacctgtgctccagtatgaactatggcacagtgcctggaagacactccatgtcagaagagcggcagagttatttgaaaagattaggttaccctgaattgcactcttcaaatttctttgaccttgatttgttgtcatcttcaggaaattcgtttgacgaggaagtttttgagaggtcattactgatcaattcacctatggatgtgatcagtcctgaatcatctatgtcatacagtgaacaaggacacactgatgagggaagagatgacacggatctttcccgttctagcagccagctctcagacattcgggactactctgaccactttgcgcagtgggtcgtgaatggagacacgctttgctactaggccctggacttttgtcttggtgacagctcagtagatgtgacacggcaggaaatggaagtctgacggatagagcagatgaaatggctgacgactagccgggctaggtgccgtgcatctacctgcagaggcggcgtagcagaagaggtggtggacatgggagaagtctcgcatcggcatgcttgtggtcactggaaggcttgaacgatgaacgctgatattcgtcggatgcagctttcggtggggtacatgattcaatttgctatggtgaaaattttgaccgtagcttagacaataaataggcaaaatatatctgttcttttagtttagcttaccttgcgtttcccttctccatagaaaagtatcaaaaggaaaaacaatggaaaatctattaggaaaaggaaaaaacaaacaaaccataggtaaagaacacttctgttgtaaatagttagtttgctacagaagtataaatatctggtacttgttgggttt

SEQ ID NO: 3935 - DNA, 2625 bp, Saccharum officinarum
gggaacaagttgactggtggactgaaatttgtcacaaaatgttacgggatagttggttttgtaaagtttcttggtccttattacatggttataataaccaggagaaggaaaattggcacaatatgcggacatgaaatttattctgttgccaagagcgaaatgattgcaattccaagtgttatagtctggcccaacgtggcttattctagggatgagaacagatataagcgcctgctttgctcagtcgatctttcgaaggatttcttcttcagttactcttacaacgtcatgcgcagccttcagaagaacataaccgagaagaatactgggcaggttgtttatgaaacaatgtgtgtatggaatgaatttctgacacgagcagttcggaatcatctcaagaatacctgttggactgttgccttagtccatggattttttaaacagtcgaagctctctgtatctggcaaggatttttggttgacccttatagctaggcgctcacgacattttgccggaaccagattcttgaaacgtggcgttaatgaaaagggcagggtagccaatgatgttgagactgaacaaattgtttttgaagacacatctgatggaatcccaactcagatagcttctgttgtacaacatagaggatcgatacctcttgtctggtttcaggaaacttcaaggcttaatattagaccagatattatattaaaacctgatgtggactacaaggcgactcgccttcattttgagaaccttgcacttagatatgggaatccaataatcatcttgaacttaataaagacccgcgagaagaagccccgtgaatctctgctccgtgcagaatttgcaaaggctatccattacattaacaagagcctacctgatgacaagcgtctaaaatttttacacatggatctgagtaagctttctcgaaggaaaggaaccaatgtgcttgcactgttgaacaaggtggcatcagatgtgttggatctaactgaattcctccactgcgaaataagtacatcgacaaaacctgatgacacctcaagtggagaagaaactgttgccaaaccacgtgatgacagaagtagcagagatcaaactgaatgtgcagctaagttggcacctcgtttattacagaagggtgtcctcaggacaaattgcatagactgcttggatcgcacaaatgttgcacaatttgcatatggtttagttgctttagggcgtcaacttcatgtattggggcttactgaagcacagaaaattgaattgcatgatcctctggctgatgatctgatggatttttatgaacggatgggtgatacattagctattcagtatggtggttctgctgctcacaacaagatcttctgtgagcaaaggggccaatggaaggcagcaacccaatctcaggagttccttcgaacccttcaacgctactacaataacgcctacactgatcacgagaagcaggatgctataaacatgttcttaggtcatttccatcctcagcaagggaaacctgcattgtggaagctggactcagatcagcattacaacattgggaggcaaggaactttaacagaagagattggaagatcattcataaagaggtcactatcagatggtaacataatgttggagaacagcttgcctataactaactgtaacaatgaaacaaacaatacagaattgctcccaatgcaacagctggatgatattagagaaccttctgattctgcgccagagatctccatatgcgaacctaacccgtgctccagtatgaactatggcacagtgcctggaagacactccatgtcagaagagcggcagagttatttgaaaagattaggtttccctgaattgcattcttcaaatttccttgaccttgatttgttatcatcttcagggaattcgtgtgacgaggaagtttttgagaggtcatcactgatcaattcacctttggatgtgatcagtgttgaatcatctacgtcatacagtgaacaaggacacattgatgagggcagggatgacacggatctttcccgttcgagcagccagctctcagacgttcgggactattctgaccgctttgcgcactgggtcgcgaatggaggcatgctttgctactaggccctggacttttgtcttggtgacagctcagtagaatttgtgacacagcaggaaatggatgtctagcggatagagcagacgaaaatggctgacggctagccggctaggtgcatctgcctgcagaggaggcgtagcggaagagatgttggacgtgggagaagtctcgcatcggcatggttgtgattgcttgaaggcttgaacgctgatattcgtcggatggagattttggtggttggattgggtacaggattcaatttgctatggtgaaaattttttgaccatagtttagacaataaataggcaaaatatatctgattcttttagtttagcttaccctgcgttccccttcatagaaaattatcaaaaaggaaaaaatttgaaaatctattagaaaaaggagaaaaaaaaaccatagataaagaatacttttgttgtaaatagttagtatgctattacagaagtataaatatttggtacttgttcggtttc

SEQ ID NO: 3936 - DNA, 3423 bp, Zea mays
acgacgccgtcgtcgccaggcagcttgcatgtggctctgcgctgcgcccttgtcttcctcttcctccccactccgcatctccagaaaattccgttattttactcccagtatttagcctcgacgattgctcgggactctctttacaggtcctatttcgcggtttcctcatcctcctaatcctaacctccttccctgttttattcttcctcgtcgagcctgattcccctgccgccaccgcggccagcgccgccctcgccgccggtcgccaccgccgccgccaccgtccactcctcgccctcacctaatctcactcggagggagaaaaaaaaaacctcgccctcgccgccgggttgagttgaatctgtggtcgctgggttgaattgaatcgatttagatccgtttatccctagttcgggtgcccgtgttctggaaggtggaagctttggttgggttttctcttccagagcattaatgtttctgagggcctaagatgctctatttgaagcagcccacgaggagctgagtctttgtgttttttttatcgttctctctcgtcgtctgttgatctgatcggatggaggctatgacgggtggcaaattccttcaaaagtttcgactctacgaaaccagatcgaaattttatcttattggaagagacaagagcaggattcactggagggtgctaaaaattgatcggttggagtccactgagctgggtgtcgatgaggatccaactatttacacggaaagtgaatgtcaagaactgctttggcggatccatgaggggaacatgttgactggtggactgaaatttgtcacaaaatgttacggaatagttggttttgtaaagtttcttggtccttattacatggttataataaccagtagaaggaaaatcggcacaatatgcggccatgaaatttattccgtcggcaagagtgaaatgattgcaatttcaagtgttacagtctggcccaacgtggcttattctagggacgagaacagatataagcgccttctttgctcagttgacctttcgaaggatttcttcttcagctactcttacaacatcatgcgcagccttcagaagaacataacccagaagaatactgggcaggctgtttatgaaccaatgtgtgtatggaatgaatttctgacacgagcaattcggaatcatctcaagaatacatgttggactgttgccttagtccatggattttttaaacagtcgaagctctccgtatctgggaaggatttttggttgacccttatagctaggcgctcacgacactttgcgggaaccagattcttgaaacgtggcgttaatgaaaagggcagggtagcgaatgatgttgagactgagcagattgtttttgaagacacatctgatggaatcccaactcagatggcttctgctgtacagcatagaggatcgatacctcttgtctggtttcaggaaacttcaagacttaatattagaccagatattatattgaaacctgatgtggactacaaggcgactcgccttcattttgagaaccttgcacttagatatgggaatccagtaatcatcttgaacttaataaaggcaagtgcagcatcaatgttgtttgatacccgtgagaagaagccccgtgaatctctgctccgtgcagaatttgcaaaggctatccattacattaacaagagcctgcctgatgacaagcgtctaaaatttttacacatggatctgagtaagctttctcgaaggaaaggcaccaatgtgcttgcactgttgaccaaggtggcatcagatgtgttggatctaactgaattcctccactgtgaaataagtacatcaacaaaacctgatgacacctcaagtggagaaagaactgctgccaaaccacatgatgacagaagtagcagtgatcaaactgaatgtgcagctaaggcgtcaacttcatgcattggggcttactgaagcacagaaaattgaattgcacgatcctctggctgatgatctgatggacttctatgaatggatgggtgatacattagctattcagtatggtggttctgctgctcacaacaagatcttctgcgagcaaaggggtcaatggaaggcagcaacccaatctcaggagttccttcggaccattcaacgctactataataacgcctacactgatcacgacaagcaggatgctataaacatgttcttaggtcatttccaacctcagcaagggaaacctgcactgtggaagctggactcagatcagcattacaacattgggaggcaagggactttaaaagaagagattggaagatcgttcataaagaggtcactatcagatggtaacatactgttggagaacaacttgcctgtaactagctgtaacaatgaaacaaacaacacagaattgcttccaatgcaacagctggatgatattagagaacctaccgactctgcgccagagatctccatatgtgaacctaacccgtgctccagtgtgaactacggcagagtgcctggaagacactctatttcagaagagcggcagagttatttgaaaagattaggttaccctgaattgcattcttcaaatttcctcgaccttgatttgttgtcgtcttctgggaattcctgtgacgaggaagtttttgagaggtcatcactgatcaattcacctatggatgtggtcagcgttgaatcatctacgtcgtacagtgaacaaggacacactgatgagggaagggatgacatggatctttcccgttcaagcagccaggtctcagacgttcgggactattctgaccggtttgcgcactgggtcgcggatggaggcatgctttggtaaaaggccatggacttttgtcttgcttgacaactcggtagaatctgtgaccgcaggaaatggatgcgagcagatgacatggctagatgcagagatggtgggcgtggaaaaagtctcgcatcggtatggttgtgaccactggaaggcttgaacgctgatattcatcggatggggatggagatttcggtggttgggttgagtacaagattcaatttgctgtggtgaaaaattttaccatagtttgtttagacaataaataggcaaaatatatatgattcttttattttagcttacagtgcgtcccccttctccatagaaaattctgaaaagcaaaaaaaaaaaggaaaatctagaaaaaggaggaaaaaaaacttagataaagaacacttttgctgtaaatagttagtatgttacggaagtataaatattgtgaaattttgctgacgacacgacttcgctcaaacgtgtaatatactgttggacagtgttaacaaaatatatcccgtatcagtacgaaaactgtgtaaatttactgtaacgcacagtatgcattatttatttatttgtttctcagattatggaagag

SEQ ID NO: 3937 - DNA, 4125 bp, Oryza sativa
cctagtagtaatttatattccattcaataaaagatcacattctcctctgtaaagaaaccggagggagtacatcatttttacatactattaacttattatccatttattacaaacaacacattattctctgtaatggaaaacaaaatctgcatcctgaatttctcataatgttcactgttacctcgtcgtatgcaacaaaaagatggcatttaccagtttcctcttggacagcacaaaacaaaacaaagcaaagttgctcactagtagcaaaaaaaaaaagaaagaaagaaagaaaaagaagaaagtatatataaatccagctcaaggagatgcggttgcggcaatgattgattgatttgtattagcccccttccactctcgcgttttctccccttctctgcgtgtttttgtggacgacggcgtcgtcgcaagcttcttgtggccatcgtcttccccccctctcctccttcctcgcatcctctcctccctatctctcacaaaaatccattcttgcacagggaattttgcctactcctatttacgatccttctcttcccccctctgggcggccaaagctctcgtttttacgcgtgatttcgtcgtcttgttgctgctgacgagcccgctgattttggctcgatttaatcccattttacgggtgttttgcatctattggagatccaaaggtgcgccctttctgggggtatcttggggggaattggatcgatttcgatctgtctgagtggttctctgggcgttgttggtgcgttcttgatccgagaggtgagagatttggttggattttctccctggagcatttggtgtgctcgagcaggatgctctatttgaagcagccgacgaggagctgaactacgcggagttgtttttcccctctgaattttcttggtttggatttcgcggtggtcgtgtggtttgctttgctgatctgatctgatggaggctatggcgggcgacaaattccttcagaagttccggctctacgagaccagatcgaaattttatcttatcggaagggacaagacaaggactctatggagggtgctgaagattgacaggatggagcctactgagctggaaatcgaggaagatcatacaagttacacagagaatgaatgccaagaactgctgtggcgaattcatgaggggaatagattgactggtggactgaaatttgtcacgaaatgctatggaatagttggttttataaaatttcttggcccttattacatggttctaattaccagaagaaggaaagttggtacaatctgcagtcatgaaatatattctgtcggcaagagcgaattgattgcaattccaagtcctattgtgtggcccaacgtggcttattctagggatgagaacagatataaacggctcctttgctcggtcgatctctcgaaagacttcttcttcagctactcttacaatatcatgcgcagccttcagaagaacataactgacaagaatactgggcaagttgtttatgagacaatgtttgtttggaacgagtttctgtctcgagctatccggaaccatctcaagaatacaacgtggactgttgccttaatccatggattttttaaacagtcaaagctctcagtagctgggaaggaattctggttgacacttatagcaaggcgctcacgtcattttgctggaaccagattcttgaaaagaggtgttaatgaaaagggtagggttgccaatgatgttgagactgaacaaattgtttttgaggacacaccagatgaaataccacatcagatatcatctgttgtacaacatagaggatccatacctcttatatggtttcaggaaacttcaagactcaacattaggccagatatcatactgaaaccggatgtagactacaagacaactcgccttcattttgagaaccttgcacttagatatgggaacccaataattatcttaaacttgatcaagactcgtgagaagaaacctcgtgaatctttgctccgtgcagaattcgcaaaggctatacattatattaacaaggggctgccagatgacaaacgtctaaagtttttacacatggatctgagtaagctttctagaaggaaaggtaccaatgtgctttcgctgttgaacaaggtagcatcagatgtgttggatctaactgacttcctccactgtgagataactacatcaaagtatgaggatgcatcaagtggacaaggagctgttgccaactcaggtgacatcgaaaacatccaggatcaaaatttatgtgcaactaagctagtacctcttttactgcaaaagggtgtcctcaggactaactgcatagactgcttggaccgcacaaatgttgcacagtttgcgtatggcttagctgctttagggcgtcaacttcatgtgctccagctcaatgaaacccctacaattgaattgcatgctcctttggccgatgatcttatggatttctatgaacggatgggtgatacgctagctattcaatatggtggctctgctgctcacaacaagatcttctgtgagcaaagaggccaatggaaggcagcaacacaatctcaggagttcctccggacccttcagcgctactacagtaatgcctacactgatcctgagaagcaggattctataaatgtgttcttgggtcatttccaaccacaagaaggaaaacctgcgctttggaaattggactcagatcagcattacaacattggcaggcaaggaactttaactgaagaaactgggagatcattcataaagaggtcgttatcggacggtaatattttatgtgacaacactggtggacctgtatctgactgtaatgttggaaaaaacaacacaagctcagaattgctcccaatgcaaccactggaggatattagagaaccttctgattctgcaccagagatctctatagaacctaacccgtgctccagtacaaactatagcacattgtctgggagacactcaatttcagaagagcggcagaattatttgagaagattgggttatcctgaattgcactcttcaaactttcttgatcttgatctgttatcatcttcaggaaattcttgtgaggaggaaatttatgagaggtcatcactcatcaattcacccatggatgttgtcagtattgaatcaactacatcatacagtgaacagggacacaatgatgagggaagagatgacacagatctgtcacgctcaagcagccaaatgtcagacatccgtgactactctgaccgcttcacgcattgggtggatggcggaggcatgctttgctactagagctataaaattgtcttggtgacatctcagcaaaaggattcaacagcagaagctatcgcagctacattaaaggaaacactcgaagtcaagctacatctgctgcaaactgcaacggtctcgtgatcgaagagatcatcacaacaaatggaagaaacatcaacttggtttgcccagagaaagtgctcaaagatgacaatccattggggaatatgaaaccattctgactcggttcggttgaggtacacgattgaatttctatggtgaagaagaattgaccatactgaagacaataaataggagaaacatatatcacattctttgcaagggttagcttagttagaatctttggcaatatgttataggaaaaggataaaacagaaaaaagaacttctcaaacaaaaatgaaaaaaaaatggaaatgctaatccctgttgtaaatatgttatagtattatacatatttaccaatttttactttacttgctctctgtatggaacttgccttttcagtcttcactgtacaaaatacactaatcgttggcaacacggtaatgattgcgagacaatctaacaggccacacggtacaggaggaaatgagttgtcaagccaatgtttcagtcagcctggttgtgtgtttttttttttcctttccagagatgtatgaaattgcacctgatgcatgaactaattttcttctggggtcctgctgattcatgttaccagtattgtcttgcatgaaccctgaactccatgatgaatgggagtgctgttgcaacatgatgggaaattactatattaacgaatcaagatacaggtttgtgc

SEQ ID NO: 3938 - DNA, 4128 bp, Oryza sativa
cctagtagtaatttatattccattcaataaaagatcacattctcctctgtaaagaaaccggagggagtacatcatttttacatactattaacttattatccatttattacaaacaacacattattctctgtaatggaaaacaaaatctgcatcctgaatttctcataatgttcactgttacctcgtcgtatgcaacaaaaagatggcatttaccagtttcctcttggacagcacaaaacaaaacaaagcaaagttgctcactagtagcaaaaaaaaaaagaaagaaagaaagaaaaagaagaaagtatatataaatccagctcaaggagatgcggttgcggcaatgattgattgatttgtattagcccccttccactctcgcgttttctccccttctctgcgtgtttttgtggacgacggcgtcgtcgcaagcttcttgtggccatcgtcttccccccctctcctccttcctcgcatcctctcctccctatctctcacaaaaatccattcttgcacagggaattttgcctactcctatttacgatccttctcttcccccctctgggcggccaaagctctcgtttttacgcgtgatttcgtcgtcttgttgctgctgacgagcccgctgattttggctcgatttaatcccattttacgggtgttttgcatctattggagatccaaaggtgcgccctttctgggggtatcttggggggaattggatcgatttcgatctgtctgagtggttctctgggcgttgttggtgcgttcttgatccgagaggtgagagatttggttggattttctccctggagcatttggtgtgctcgagcaggatgctctatttgaagcagccgacgaggagctgaactacgcggagttgtttttcccctctgaattttcttggtttggatttcgcggtggtcgtgtggtttgctttgctgatctgatctgatggaggctatggcgggcgacaaattccttcagaagttccggctctacgagaccagatcgaaattttatcttatcggaagggacaagacaaggactctatggagggtgctgaagattgacaggatggagcctactgagctggaaatcgaggaagatcatacaagttacacagagaatgaatgccaagaactgctgtggcgaattcatgaggggaatagattgactggtggactgaaatttgtcacgaaatgctatggaatagttggttttataaaatttcttggcccttattacatggttctaattaccagaagaaggaaagttggtacaatctgcagtcatgaaatatattctgtcggcaagagcgaattgattgcaattccaagtcctattgtgtggcccaacgtggcttattctagggatgagaacagatataaacggctcctttgctcggtcgatctctcgaaagacttcttcttcagctactcttacaatatcatgcgcagccttcagaagaacataactgacaagaatactgggcaagttgtttatgagacaatgtttgtttggaacgagtttctgtctcgagctatccggaaccatctcaagaatacaacgtggactgttgccttaatccatggattttttaaacagtcaaagctctcagtagctgggaaggaattctggttgacacttatagcaaggcgctcacgtcattttgctggaaccagattcttgaaaagaggtgttaatgaaaagggtagggttgccaatgatgttgagactgaacaaattgtttttgaggacacaccagatgaaataccacatcagatatcatctgttgtacaacatagaggatccatacctcttatatggtttcaggaaacttcaagactcaacattaggccagatatcatactgaaaccggatgtagactacaagacaactcgccttcattttgagaaccttgcacttagatatgggaacccaataattatcttaaacttgatcaagactcgtgagaagaaacctcgtgaatctttgctccgtgcagaattcgcaaaggctatacattatattaacaaggggctgccagatgacaaacgtctaaagtttttacacatggatctgagtaagctttctagaaggaaaggtaccaatgtgctttcgctgttgaacaaggtagcatcagatgtgttggatctaactgacttcctccactgtgagataactacatcaaagtatgaggatgcatcaagtggacaaggagctgttgccaactcaggtgacatcgaaaacatccaggatcaaaatttatgtgcaactaagctagtacctcttttactgcaaaagggtgtcctcaggactaactgcatagactgcttggaccgcacaaatgttgcacagtttgcgtatggcttagctgctttagggcgtcaacttcatgtgctccagctcaatgaaacccctacaattgaattgcatgctcctttggccgatgatcttatggatttctatgaacggatgggtgatacgctagctattcaatatggtggctctgctgctcacaacaagatcttctgtgagcaaagaggccaatggaaggcagcaacacaatctcaggagttcctccggacccttcagcgctactacagtaatgcctacactgatcctgagaagcaggattctataaatgtgttcttgggtcatttccaaccacaagaaggaaaacctgcgctttggaaattggactcagatcagcattacaacattggcaggcaaggaactttaactgaagaaactgggagatcattcataaagaggtcgttatcggacggtaatattttatgtgacaacactggtggacctgtatctgactgtaatgttggaaaaaacaacacaagctcagaattgctcccaatgcaaccactggaggatattagagaaccttctgattctgcaccagagatctctatagaacctaacccgtgctccagtacaaactatagcacattgtctgggagacactcaatttcagaagagcggcagaattatttgagaagattgggttatcctgaattgcactcttcaaactttcttgatcttgatctgttatcatcttcaggaaattcttgtgaggaggaaatttatgagaggtcatcactcatcaattcacccatggatgttgtcagtattgaatcaactacatcatacagtgaacagggacacaatgatgagcagggaagagatgacacagatctgtcacgctcaagcagccaaatgtcagacatccgtgactactctgaccgcttcacgcattgggtggatggcggaggcatgctttgctactagagctataaaattgtcttggtgacatctcagcaaaaggattcaacagcagaagctatcgcagctacattaaaggaaacactcgaagtcaagctacatctgctgcaaactgcaacggtctcgtgatcgaagagatcatcacaacaaatggaagaaacatcaacttggtttgcccagagaaagtgctcaaagatgacaatccattggggaatatgaaaccattctgactcggttcggttgaggtacacgattgaatttctatggtgaagaagaattgaccatactgaagacaataaataggagaaacatatatcacattctttgcaagggttagcttagttagaatctttggcaatatgttataggaaaaggataaaacagaaaaaagaacttctcaaacaaaaatgaaaaaaaaatggaaatgctaatccctgttgtaaatatgttatagtattatacatatttaccaatttttactttacttgctctctgtatggaacttgccttttcagtcttcactgtacaaaatacactaatcgttggcaacacggtaatgattgcgagacaatctaacaggccacacggtacaggaggaaatgagttgtcaagccaatgtttcagtcagcctggttgtgtgtttttttttttcctttccagagatgtatgaaattgcacctgatgcatgaactaattttcttctggggtcctgctgattcatgttaccagtattgtcttgcatgaaccctgaactccatgatgaatgggagtgctgttgcaacatgatgggaaattactatattaacgaatcaagatacaggtttgtgc

SEQ ID NO: 3939 - DNA, 3471 bp, Brachypodium distachyon
tggctgctgcaatgattagtctcgtgtttgcgccttgccactctcgcctggcttgcgtttgcgtggtgtttttgtggacgacggcgtcgtcgccagcctcctccttgtggctctcgtttccccccttcctccttctcgttgccctcagaaaaatccattcattctgctctggaaatttagccctctcctatttataacccatccatctccccgcgggggcggccaaggctagatttgtttgcctgaatttttccctgtttctctcaaccgggaatcgggttcttgattcttccgtcgatttctcccctttcccgggctgttgattcttgcacggatcgaaaggtgcgttttttctgcagaattttcggtgttggaggtgtttggaacaatttcgatccgttcggtggtcgctggtccattcttgatccgaaaggtggtgctgtgattgggctatttaccctggatcatttgtgctcgagcgcaagatgctctacttgaagcagccgacgaggagctgaactacgcagagtctccgtctgttctgaatttattggttcggattcgtgcccctgttgtgtatctgtttgttgatctgatccgatggaatctataagaggcggcaagttccttcagaagttccggctctacgagaccagatcgaaattttatcttattggaagaaacaagagcaggactatttggaaagtgctaaagattgatcggttggaatctactgatttgggcatccaggaagatcctacatgttacacggagaatgaatgccaagaactgctttggcggattcacgaggggaataggttgactggtgggctgaaatttgtcacaaaatgctacggaatagttggttttatgaagtttcttggtccttactacatggttatcattaccaggagaaggaaagttggcacaatctgtggccatgatatttattcgattgggaagagtgaaatgatcgcaattccatgtcctatagtctggcccaacgtggctaattctagggatgagaacagatataaacggctcctttgctcggtcgatctcacgaaggacttcttcttcagctactcttacaacatcatgcgcagtcttcagaagaacatagctgataagaatactgggcaggttgtttatgaaacaatgtttgtatggaatgaatttctgacacgagcaatgcggagccatctcaagaataccaattggactgtggccttaatccatggattttttaagcagtccaagctgtcagtatgtgggaaagatttctggttgacacttatagccagacgttcgcgtcattttgctggaaccagattcttgaaacgaggtgttaatgaaaagggtagggttgccaatgatgttgagactgaacagattgtttttgaagatacacctgatgacatcccatgtgaaataacctctgttgtacaacatagaggatcaatacccctcgtctggtttcaggaaacttcaagacttaatattaggccagagatcacattaaaaccggatgtggactacaaggcaacccggcttcattttgaaaaccttgcactgagatatgggaaccctatagtcatcttaaacttaatcaagactcgtgagaagaagcctcgtgaatctttgctccgcgctgaatttgcaaaggctatccattacataaataaagggttaccggatgacaaacgcctgaagtttttacacatggatctgagtaagcttgctcgaaggaaaggcaccaatgtgcttggactgttaaacaaggtagcatcagatgtgttggaactaacggatctccttcattgcgagataactacatcaaaacccaggggcgcctcaagtgggcaaggagatgttacggagtcatgtgagatcaaaagcaatgatgatttctgtgcagatatgatggtacctcttttactacaaaagggtgtcctcaggacaaactgcatagactgcttagaccgcacaaatgttgcacaattcgcatatggattaactgctttaggacgccaacttcatgtgttgaggctcactcaagaacctaaaattgaattgcatgctcctttggctgacgatctgatggatttctatgaaaggatgggtgatacattagctatccaatatggtggttctgctgctcataacaagatcttctgcgagcaaagagggcaatggaaggcagcaacccaatcccaggagttccttcggacccttcaacgttactacaataatgcctacacagatcctgagaagcaggacgctataaatgtgttcttgggtcatttccaacctcagcaaggcagacctgcgctgtggaagttggactcagatcagcactacaatattggcaggcaaggaactgtgaatgaagaaagtggaagatcattcataaagaggtcactctcagatggaaatattctatgtgaaaacagtgtacctatatctgaccgtaacgttggagaaaacaacactgcaaactcagaattactccccatgcaacagctggatgatattagggagcctactgactctgcaccagagatctacatgtgtgaaacaaacccatgctccagtacaaaatatagcacaatgcctggaagacactccatttcggaagaacggcagagttacttgaaaagattaggttatccagaattgcattcgtcaaattttcttgatcttgatttattatcgtcttcaggaaattcttgcgacgaagaagcttttgagaggtcatcgctcatccattccccaatggatgttatcagtgttgaatctgctacaacatacagtgaacaaggacacaacgatgagggaagggatgacacagatctgtcgcgctcgagcagccagctctcagactctcgtgactattcagaccgatttgcacaatgggtggctaatggaggcatgctttgctactagtgctaaagatttcctcctgatggcatctctaaaatttgtggcagcaggaaagacatgctagagcgaagggaaaaaagctcgatggcaaagctgcaatctgccaatctgcaatgcacagggctggtaatcgccgaggctgctgtgacgaaagaagaaacacaatgactggtcagcgtatcaaagctttaacgcggtaactcgatcgaggaatgcaattcattcatgctgggttggtttggtcgaggtgcaggattcaattactatggtgaagaattgaccatagttgcagggaataataggtgaaacatatacatctgattgttagcttagtttgacagatcttttctcgttagcgaaaaaatataaaaaacccggaaaatggtttgcaaaaagagaaaggaccgctcctgtaaatatgctacagatacaaaagtatgctgactgcattggttttggatggcgctttacctgtatatgtttgtaagacatttagacatgatctcacagaaaagaggattggagagg

SEQ ID NO: 3940 - DNA, 3809 bp, Brachypodium distachyon
tggctgctgcaatgattagtctcgtgtttgcgccttgccactctcgcctggcttgcgtttgcgtggtgtttttgtggacgacggcgtcgtcgccagcctcctccttgtggctctcgtttccccccttcctccttctcgttgccctcagaaaaatccattcattctgctctggaaatttagccctctcctatttataacccatccatctccccgcgggggcggccaaggctagatttgtttgcctgaatttttccctgtttctctcaaccgggaatcgggttcttgattcttccgtcgatttctcccctttcccgggctgttgattcttgcacggatcgaaaggtgcgttttttctgcagaattttcggtgttggaggtgtttggaacaatttcgatccgttcggtggtcgctggtccattcttgatccgaaaggtggtgctgtgattgggctatttaccctggatcatttgtgctcgagcgcaagatgctctacttgaagcagccgacgaggagctgaactacgcagagtctccgtctgttctgaatttattggttcggattcgtgcccctgttgtgtatctgtttgttgatctgatccgatggaatctataagaggcggcaagttccttcagaagttccggctctacgagaccagatcgaaattttatcttattggaagaaacaagagcaggactatttggaaagtgctaaagattgatcggttggaatctactgatttgggcatccaggaagatcctacatgttacacggagaatgaatgccaagaactgctttggcggattcacgaggggaataggttgactggtgggctgaaatttgtcacaaaatgctacggaatagttggttttatgaagtttcttggtccttactacatggttatcattaccaggagaaggaaagttggcacaatctgtggccatgatatttattcgattgggaagagtgaaatgatcgcaattccatgtcctatagtctggcccaacgtggctaattctagggatgagaacagatataaacggctcctttgctcggtcgatctcacgaaggacttcttcttcagctactcttacaacatcatgcgcagtcttcagaagaacatagctgataagaatactgggcaggttgtttatgaaacaatgtttgtatggaatgaatttctgacacgagcaatgcggagccatctcaagaataccaattggactgtggccttaatccatggattttttaagcagtccaagctgtcagtatgtgggaaagatttctggttgacacttatagccagacgttcgcgtcattttgctggaaccagattcttgaaacgaggtgttaatgaaaagggtagggttgccaatgatgttgagactgaacagattgtttttgaagatacacctgatgacatcccatgtgaaataacctctgttgtacaacatagaggatcaatacccctcgtctggtttcaggaaacttcaagacttaatattaggccagagatcacattaaaaccggatgtggactacaaggcaacccggcttcattttgaaaaccttgcactgagatatgggaaccctatagtcatcttaaacttaatcaagactcgtgagaagaagcctcgtgaatctttgctccgcgctgaatttgcaaaggctatccattacataaataaagggttaccggatgacaaacgcctgaagtttttacacatggatctgagtaagcttgctcgaaggaaaggcaccaatgtgcttggactgttaaacaaggtagcatcagatgtgttggaactaacggatctccttcattgcgagataactacatcaaaacccaggggcgcctcaagtgggcaaggagatgttacggagtcatgtgagatcaaaagcaatgatgatttctgtgcagatatgatggtacctcttttactacaaaagggtgtcctcaggacaaactgcatagactgcttagaccgcacaaatgttgcacaattcgcatatggattaactgctttaggacgccaacttcatgtgttgaggctcactcaagaacctaaaattgaattgcatgctcctttggctgacgatctgatggatttctatgaaaggatgggtgatacattagctatccaatatggtggttctgctgctcataacaagatcttctgcgagcaaagagggcaatggaaggcagcaacccaatcccaggagttccttcggacccttcaacgttactacaataatgcctacacagatcctgagaagcaggacgctataaatgtgttcttgggtcatttccaacctcagcaaggcagacctgcgctgtggaagttggactcagatcagcactacaatattggcaggcaaggaactgtgaatgaagaaagtggaagatcattcataaagaggtcactctcagatggaaatattctatgtgaaaacagtgtacctatatctgaccgtaacgttggagaaaacaacactgcaaactcagaattactccccatgcaacagctggatgatattagggagcctactgactctgcaccagagatctacatgtgtgaaacaaacccatgctccagtacaaaatatagcacaatgcctggaagacactccatttcggaagaacggcagagttacttgaaaagattaggttatccagaattgcattcgtcaaattttcttgatcttgatttattatcgtcttcaggaaattcttgcgacgaagaagcttttgagaggtcatcgctcatccattccccaatggatgttatcagtgttgaatctgctacaacatacagtgaacaaggacacaacgatgagggaagggatgacacagatctgtcgcgctcgagcagccagctctcagactctcgtgactattcagaccgatttgcacaatgggtggctaatggaggcatgctttgctactagtgctaaagatttcctcctgatggcatctctaaaatttgtggcagcaggaaagacatgctagagcgaagggaaaaaagctcgatggcaaagctgcaatctgccaatctgcaatgcacagggctggtaatcgccgaggctgctgtgacgaaagaagaaacacaatgactggtcagcgtatcaaagctttaacgcggtaactcgatcgaggaatgcaattcattcatgctgggttggtttggtcgaggtgcaggattcaattactatggtgaagaattgaccatagttgcagggaataataggtgaaacatatacatctgattgttagcttagtttgacagatcttttctcgttagcgaaaaaatataaaaaacccggaaaatggtttgcaaaaagagaaaggaccgctcctgtaaatatgctacagatacaaaagtatgctgactgcattggttttggatggcgctttacctgtatatgtttgtaagacatttagacatgatctcacagaaaagaggattggagaggaaaatttctgctctgcggttgagatctaggcacgatcgctattcgctttgccatgtttgcatggtatatctaatctgggcgcaatttacttgtaaataagaaaattaaccaaagcacaagcacatatagcacacagatccaccacatagatgcttattcagttattcaggtcgcaatgggactcacattgtcacaattattaaacggggagttctctcctcgaaggagcggggatgatcagaaaaccacacaagcacacggaaacgaacgataggaattactctagagctgaccagccctggcagccatgaagacggaggccacgagctgacttgcct

SEQ ID NO: 3941 - DNA, 3221 bp, Hordeum vulgare
gccctgctcccctgaatcggcctcttgattcccgcgtcgatttcttcctccccccccacgcgttcttgatccgaaggtgcgtgtgttttctggagaatttcccgctgttgaggtgtgaattggatccatttcgatccgtccggtcgccgccggcccgttcttgatcccaggggcgggctccttgattgggtctcgtgtcgccctggagcattctcgcgcgagaccaagatgctctacttgaagcagccgaagaggagctagctgaaccacgcggagtctccgtttgtctttctgaatttctcaggctcggattcgttctggccctcttgtctgctgcctgcgtgttgatctgaatatctgacccgatggaggccatgagaggcggcaaattcctccagaagttccggctctacgaaaccagatcgaaattttatcttgtcggaagagacaagagcaggactctttggagggtgctaaagattgaccggttggagtctactgatttgggtatccaggaggatcctactagttacacagagaatgaatgccaagaactactatggcggattcacgagggaaataggttgaccggtgggctgaaatttgtcacaaaatgctatggaataattggttttatgaagtttcttggtccttactacatggttgtaattaccaggagacgaaaagttggcacaatctgtggccatgatatttattcaattggcaagagcgaaatgatcgcaattccatgtcctatagtctgccccaatgtggctaattctagggatgagaacagatataaacgactcctttgctcggtcgatcttacgaaggacttcttcttcagctactcttacaacatcatgcgcagtcttcagaagaacataaatgacaaaaatactggacatgttgtttatgaaacaatgtttgtatggaatgaatttttgacacgagcaatgcggaaccatctcaagaataccgattggaccgtggccttggtccatggattttttaaacagtcgaagctggcagtatctgggaaggatttctggttgacacttatagcaagacgctcgcgtcattttgctggaaccagattcatgaaacgaggtgttaatgaaaagggtagggttgccaatgacgttgagactgaacagattgtttttgaagatacacctgatgacatcccaagtcaaataacttctgttgtacaacatagaggatccatacctcttgtctggtttcaggaaacttcaagacttaatattaggccagaaatcacgttaaaatcagatgtggactacaaggccacccgccttcattttgaaaaccttgttcttagatatgggaatcctatagtcatcttaaacttaatcaagactcgtgagaagaagcctcgtgaatctttgctccgtgcagaatttgcaaaggctatccattacataaataaggggttaccggatgacgaacgccttaagtttttacacatggatctgagtaaactttctcgaaggaaaggcaccaatgtgctcgggctgttaaacaaggtagcatcagatgtgttggaactaacggacctcctccattgcgagataactacatcatcaaaacctttggatgcttcaagtggacaagggtcatctgacatcaaaagaaatgatgatttctgcgcagctacaatggtacctcttctactgcagaagggtgtcctcaggacaaactgcatagactgcttagaccgcacaaatgtcgcacagtttgcatacgggttagctgctttagggcgtcaacttcatgtgttgaagctcactgaagaacctaaaattgatctgcatgatcctttggccgatgatctgatggacttctatgaaaggatgggcgatacattagccatccagtacggtggttctgctgctcacaacaagatcttttgtgagcaaagagggcagtggaaggcagcaacccaatcccaggagtttcttcgaacccttcagcgttactataataacgcgtacacagatcctgagaagcaggatgctataaatgtgttcttgggtcattttcagcctcaacaagggaaaccacctctgtggaagttggactcagatcagcattacaatatcggccggcaaggaactttaagtgaagaaactggaagattcataaagaggtcgctctcggatggaaatattctatgtgaaaacagtgcacctgtgtctgaccgtaatgtcggcgaaaacaacactgcaaactcagaattactgcctgtgcaacagctggatgatattagagagcctactgattctgcaccagagatctatatgtgtgaaacaaacccatgccccagtacaaaatatagcacgatgcctggaagacactccatttcggaggaacggcagagttacctgaaaagattaggttatccggagttgcattcttcaaattttctcgatcttgatttgttatcgtcttcaggaaattcttgtgatgaagaagcttttgagaggtcatcactcattcactcaccattggatggtatcagtgttggatctactactacttacagtgagccaggacacaatgatgagggaagggatgacctgtcccgctcaagcagccagctctcagactcgcgcgactattctgaccgctttgctcagtgggtggctaatggaggcatgctttgctactaatgctaaagaatttgtcctggtgacatctccatataattttcgccgcagcacaaaggctccacagctagaacaaaggaaaatcaatctcaagaagaagctgcagccgcacagtgctgccattcgccaaggctgaagcaacagaagaagaatcggcacgattcgctcggtggatcaaagctctaacgcagtaactcagttgaggaatgaatgcagatgatggtgacttgtggtttggttttgttcggacagggttggagtgctatggtgaagaattgaccgtagtgaagggaaaggcaatgaatgataggcaaaggaaatatatctatctgattctttttcaagggttagcttaggtagacagcttatgtttttgttcacctttagaaacaaaatacaaaaaaacacatggaaaataacaaaaagaaagagacttctcctgtaaatatatatggtacagataaatatgttgtcacatgttttggacggtggtttacgtgtatatgtttgtaacacaggatatacaggttt

SEQ ID NO: 3942 - DNA, 3278 bp, Avena sativa
atgacccatccatctctcccgcgagggctcgcgttcttcttcttcgcctgaatttcccccctgtttccctccgcccggaatcgggttctcgggttgattcattcgctttcccgggttcctgatccttgcacggatccaaagggcttcttttgcgccgaattttcgttgtccgggtgtgaattgcatcgatttcatcccgctgctcggttcttgatccgaaagccgtgttcttcgattgtttttctcattaccctggagcattctcgcgcgagatcagtatgctctacttgaagcaaccgaagacgaggagctgaaccacacgcatagtttccttattttcttctgaattttcttggttcggattctgtcactcttgtgtgccagtttattgatctgggccgatggaggctatgaggggcggcaaattccttcagaagttccggctctacgaaaccagatcgaaattttatcttgttgggagagacaagagcaggactctttggagagtgctaaagattgaccggttggagactactgatttgggtatcgaggaagatcctactagttacacggagaatgaatgccaagaactactttggcggattcacgagggaaataggttgaccggtggcctgaaatttgtcacaaaatgctacgggatagttggttttatgaagtttcttggtccttactatatggttgtaattaccaggagaaggaaagttggcaccatctgtggccatgatatttattcgatcggcaagagcgaaatgatcgcaattccatgtcctatagtctggcccgaagtggccaattctagggatgaaaacagatataaacgactcctttgctcggtcgatctcacgaaggacttcttcttcagctactcttacaacatcatgcgcagtcttcagaagaacataactgccaagaatactgggcaggttgtttatgaaacaatgtttgtatggaatgaatttctgacacgagcaatgcggaaccatctcaagaataccaattggaccgtggccttaatccatggatttttcaaacagtcaaagctgtcagtatctgggaaggatttttggttgacacttatagccagacgctcacgccattttgctggaaccagattcttgaaacgaggtgtcaacgagaagggtagggttgccaatgatgttgagactgaacagatcgtttttgaagacacatctgatgacatcccatgtcaaataacttcttctgtacaacatagaggatcaatacctctcgtctggtttcaggaaacttcaagacttaatattaggccagaaatcacattgaaaccagatgtggactacaaggccacccgccttcattttgaaaaccttgttcttagatatgggaaccctatagtcatcttaaacttaatcaagactcgtgagaagaagccccgtgaatcattgctccgtgcagaatttgcaaaggctatccattacataaataaagggttaccggatgacaaacgtcttaaatttttacacatggatctcagtaagctgtctcgaaggaaaggtaccaatgtgctttcactgttaaacaaggtagcatcagatgtgttggaactaacggacatcctccattgtgagataactacatcatcaaaaccgttggatgcctcgagtggacaaggatgtgttatcaagtcatgtgatgtcgaaagcaatgatgatttatgcacatctacgttggtgcctcttttactacagaagggtgtcctcaggacaaactgcatagactgcttagaccgcacaaatgtcgcccaatttgcatacggattagctgctttagggcgccaacttcatgtgttggggctcactgaagcacctaaaattgaattgcatgctcctttggctgatgatctgatggatttctatgaaaggatgggtgatacattagctatacaatacggtggttctgctgctcacaacaagattttctgcgagcaaagaggccagtggaaggcagcaacccaatcccaggagttccttcggacccttcaacgttactacaataatgcctacacagatcctgagaagcaggatgctataaatgtgttcttgggtcatttccaacctcaacaaggcaaacctgcactttggaagttggactcagatcagcattacagtattggcaggcaaggaactgtaggtgaagaaactgtgagaccactcataaagaggtccttttccgttggaaatattctatgtgaaaacagtggagctgtgtccgactgtaacgccgtagataacaacaatgcgaactcagaattactccccatacaacagctggatgatattagagagcctactgattctgcaccagagatctacatgtgtgaaacaaatccgtgctccagtacaaaatatagtgcaatgcctggaagacactccatctcggaagaacggcagagttacttgaaaagattaggttatccggagttgcattcttcaaattttctcgatcttgatttgttatcttcttcgggaaattcctgtgatgaagaagcttttgagaggtcatcactcatccattcacctactgatcttatcagtgttgaatctactacaacatacagtgagcaggggcacaatgacgagggaaggtatgacacagacctatcacgctcaagcagccagctcttggactcgggtgactattctgaaagttttgctcaatgggtggctaatggaggcatgttgtgctactagcgctaaagattttgtcctggtggcatctccatataattttgtgagcgctaaagattttgtcctggtggcatctccatataattttgtggcctcacggatgtttgacagctggaacagaaggaaaaaaggtcaggaacaagctgcaatcactggggctggcaatcgcccgaggctggaacaaggatcggcacgactgctccacagatcaaaggctggctttaacaatgtggtaactcagttgaggaatgaagatcatgatggcttggtttggttgggttgggtacaggactccattgctatggtgaagaattgaccgtagtgcaggcaatgacaggcagaagaaatctgattcttttccagggttaggtttagatagacagtttatatatattttttcacttttagaaaaaaaaaaaaaaaaatatggaaaatgataaaaaagaaagacttctctttgtaaatacggcagacacatatatgctacttatattggttttggacggcggttctacgtgtatatgtttgtaa

SEQ ID NO: 3943 - DNA, 3194 bp, Secale cereale
aatccatcctttctgctccggaaatttagcccccctcctatttatgacccgcccatctctcccgcggaggctgccctgaaaatccccccctgctcccctgaatcggcttcttggttcccccgtcgattccctcttccctcccccgcgttcttgatccgaaggtgcgtgtgttgaattttccgctgttggggtgtgaattggatccatttcgatccgtccggtcgtcgtcggcccgttcttgatcccagcggcgcgctccttgattggttctcgtatgaccctggagcattctcgcgcgagaccaagatgctctacttgaagcagccgaagaggagctagctgaaccacgcggagtctccgtttgtttgttctgaatttctcaggctcggattcgttctggtcctcttgtctgcccgcgcgttgatctgaatttctgacccgatggaggccatgagaggcggcaaattccttcagaagttcaggctctacgaaaccagatcgagattttatcttgttggaagagacaagagcaggactctctggagggtgctaaagattgaccggttggagtctactgatttgggtatccaggaggatcctactagttacacagagaatgaatgtcaagaactactttggcggattcacgagggaaataggttgactggtgggctgaaatttgtcacaaaatgctatggaataattggttttatgaagtttcttggtccatactacatggttgtaattaccaggagaagaaaagttggcacaatctgtggccatgatatttattcaattggcaagagtgaaatgatcgcaattccatgtcctatagtctgccccaatgtggctaattctagggatgagaacagatataaacgactcctttgctcggttgatcttacgaaggacttcttcttcagctactcttacaacatcatgcgcagtcttcagaagaacataaatgacaaaaatactggacatgttgtttatgaaacaatgtttgtatggaatgaatttttgtacacgagcaatgcggaaccatctcaagaataccgattggaccgtggccttggtccatggattttttaaacagtcgaagctgtcagtacctgggaaggatttctggttgacacttatagccagacgttcgcgtcattttgctggaaccagattcatgaaacggggtgttaatgaaaagggtagggttgccaatgatgttgagactgaacagattgtttttgaagacacacctgatgatatcccaagtcaaataacttctgttgtacagcatagaggatcaatacctcttgtctggtttcaggaaacttcaaggcttaatattaggccagaaatcacgttaaaatcagatgtggactacaaggccacccgccttcattttgaaaaccttgttcttagatacgggaaccctatagtcatcttaaacttaatcaagactcgtgagaagaagcctcgtgaatctttgctccgtgcagaatttgcaaaggctatccattacataaataaggggttaccggatgacaaacgtcttaagtttctacacatggatctgagtaagctttctcgaaggaaaggcaccaatgtgcttggactgttaaacaaggtagcatcagatgtgttggaactaacggacctcctccattgcgagataaccacatcatcaaaacctttggatgcttcaagtgaacaagggtcatgtgacattaaaagcaatgatgaattctgcgcagctacaatggtacctctcttactacagaagggtgtcctcaggacaaactgcatagactgcttagaccgcacaaatgtcgcacagtttgcatacggattagctgctttagggcgtcaacttcatgttttgaagctcactgaagaacctaaaattgatcttcatgatcctttggccgatgatctgatggatttctatgaaaggatgggtgatacattagccatccagtacggtggctctgctgctcacaacaagatcttctgtgagcaaagagggcagtggaaagcagcaacccaatcccaggagttccttcgaacccttcagcgttactacaataatgcgtacacagatcctgagaagcaggatgctataaatgtgttcttgggtcattttcagcctcaacaaggcaaaccacctctgtggaagttggactcagatcagcattacaatattggccggcaaggaactttaagtgaagaaaccggaagattcataaagaggtcgctctcggatggaaatattctatgtgaaactagtgcacctgtgtctgaccgtaatgttggcgaaaacaacactgcgaactcagaattactacccgtgcaacagctggatgatattagagagcctactgattctgcaccagagatctatatgtgtgaaacaaacccatgccccagtacaaaatatagcatgatgcctggaagacactctatttcagaggaacgacagagttacttgaaaagattaggttatcccgagttgcattcttcaaattttctcgatcttgatttgttatcatcttcaggaaattcttgtgatgaagaagcctatgagaggtcatcaatcatccattcacctttggatggtatcagtgttggatccactactacttacagtgagccaggacacaatgatgagggaagggatgagaccgacctgtcgcgctcgagcagccagctctcagactcgcgcgactattccgaccgctttgctcagtgggtggctaatggaggcatgctttgctactaagtgctaaagaatttatcctggtggcatctccatataattttcaccgcagcatgaaagcttgacagctagaacaaaggaaagagctcaagaacaaggtgcgacatgcaagcacagggctggcatccgccaaggctgctgcaagagaagaatcggcacgatttgctcggcggatcgaggctctaacgcggtaactcagttgaggaatgaatgcagatgatggtggcttgtggtttggttttgtttggacaggattggagtgctatggtgaagaattgaccgcagtgaagggaaaggcaatgaatgataggcaaaggcaaacatatctatctgattcgtttcaagggttagcttagctagacagcttatgttttttgtcgcctttagaagaaaaataaccaaaaaaacacatatggaaaat

SEQ ID NO: 3944 - DNA, 3255 bp, Secale cereale
tggctctcgtcttcctcccccttcccccgcgttgccctcggaaaaaatccatcctttctgctccggaaatttagcccccctcctatttatgacccgcccatctctcccgcggaggctgccctgaaaatccccccctgctcccctgaatcggcttcttggttcccccgtcgattccctcctccctctaccgcgttcttgatccgaaggtgcgtgtgttgaattttccgctgttggggtgtgaattggatccatttcgatccgtccggtcgtcgccggcccgttcttgatcccagcggcgggctccttgattggttctcgtatgaccctggagcattctcgcgcgagaccaagatgctctacttgaagcagccgaagaggagctagctgagccacgcggagtctccgtttgtttgttctgaatttctcaggctcggattcgttctggccctcttgtctgcctgcgcgttgatctgaatttctgacccgatggaggccatgagaggcggcaaattccttcagaagttcaggctctacgaaaccagatcgagattttatcttgttggaagagacaagagcaggactctctggagggtgctaaagattgaccggttggagtctactgatttgggtatccaggaggatcctactagttacacagagaatgaatgtcaagaactactttggcggattcatgagggaaataggttgactggtgggctgaaatttgtcacaaaatgctatggaataattggttttatgaagtttcttggtccttactacatggttgtaattaccaggagaagaaaagttggcacaatctgtggccacgatatttattcaattggcaagagtgaaatgatcgcaattccatgtcctatagtctgccccaatgtggctaattctagggatgagaacagatataaacgactcctttgctcggttgatcttacgaaggacttcttcttcagctactcttacaacatcatgcgcagtcttcagaagaacataaatgacaaaaatactggacatgttgtttatgaaacaatgtttgtatggaatgaatttttgacacgagcaatgcggaaccatctcaagaataccgattggactgtggccttggtccatggattttttaaacagtcgaagctgtcagtacctgggaaggatttctggttgacacttatagccagacgttcgcgtcattttgctggaaccagattcatgaaacgaggtgttaatgaaaagggtagggttgccaatgatgttgagactgaacagattgtttttgaagacacacctgatgatatcccaagtcaaataacttctgttgtacagcatagaggatcaatacctcttgtctggtttcaggaaacttcaaggcttaatattaggccagaaatcacgttaaaatcagatgtggactacaaggccacccgccttcattttgaaaaccttgttcttagatacgggaaccctatagtcatcttaaacttaattaagactcgtgagaagaagcctcgtgaatctttgctccgtgcagaatttgcaaaggctatccattacataaataaggggttaccggatgacaaacgtcttaagtttctacacatggatctgagtaagctttctcgaaggaaaggcaccaatgtgcttggactgttaaacaaggtagcatcagatgtgttggaactaacggacctcctccattgcgagataaccacatcatcaaaacctttggatgcttcaagtgaacaagggtcatgtgacattaaaagcaatgatgaattctgcgcagctacaatggtacctctcttactacagaagggtgtcctcaggacaaactgcatagactgcttagaccgcacaaatgtcgcacagtttgcatacggattagctgctttagggcgtcaacttcatgttttgaagctcactgaagaacctaaaattgatcttcatgatcctttggccgatgatctgatggatttctatgaaaggatgggtgatacattagccatccagtacggtggctctgctgctcacaacaagatcttctgtgagcaaagagggcagtggaaagcagcaacccaatcccaggagttccttcgaacccttcagcgttactacaataatgcgtacacagatcctgagaagcaggatgctataaatgtgttcttgggtcattttcagcctcaacaaggcaaaccacctctgtggaagttggactcagatcagcattacaatattggtcggcaaggaactttaagtgaagaaaccggaagattcataaagaggtcgctctcggatggaaatattctatgtgaaactagtgcacctgtgtctgaccgtaatgttggcgaaaacaacactgcgaactcagaattactacccgtgcaacagctggatgatattagagagcctactgattctgcaccagagatctatatgtgtgaaacaaacccatgccccagtacaaaatatagcatgatgcctggaagacactccatttcagaggaacgacagagttacttgaaaagattaggttatccggagttgcattcttcaaattttctcgatcttgatttgttatcatcttcaggaaattcttgtgatgaagaagcctatgagaggtcatcaatcatccattcacctttggatggtatcagtgttggatccactactacttacagtgagccaggacacaatgatgagggaagggatgagaccgacctgtcgcgctcgagcagccagctctcagactcgcgcgactattccgaccgctttgctcagtgggtggctaatggaggcatgctttgctactaagtgctaaagaatttatcctggtggcatctccatataattttcaccgcagcatgaaagcttgacagctagaacaaaggaaagagcccaagaacaatgtgcgacatgcatgcacagggccggcatccgccaaggctgctgcgagagaagaatcggcacgatttgctcggcggatcgaggctctaacgcggtaactcagttgaggaatgaatgcagatgatggtggcttgtggtttggttttgtttggacaggattggagtgctatggtgaagaattgaccgcagtgaagggaaaggcaatgaatgataggcaaaggcaaacatatctatctgattcgtttcaagggttagcttagctagacagcttatgttttttgttcgcctttagagaaaaaatacccccaaaaaaacacatatggaaaatgaataaaaaaaaaa

SEQ ID NO: 3945 - DNA, 3237 bp, Secale cereale
cccccgcgttgccctcggaaaaaatccatcctttctgctccggaaatttagccccctcctatttatgacccgcccatctctcccgcggaggcggccctgaaaatccccccttgcctgctcccctgaatcggcttcttggttcccccgtcgattccctcttccctccccgcgttcttgatccgaaggtgcgtgtgttttccggagaattttccgctgttggggtgtgaattggatccatttcgatccgtccggtcgtcgccggtgcgttcttgatcccagcggcgcgctccttgattggttctcgtatgaccctggagcattcccgcgcgagaccaagatgctctacttgaagcagccgaagaggagctagctgagccacgcggagtctccgtttgtttgttctgaatttctcaggctcggattcgttctggccctcttgtctgcctgcgcgttgatctgaatttctaacccgatggaggccatgagaggcggcaaattccttcagaagttcaggctctacgaaaccagatcgagattttatcttgtcggaagagacaagagcaggactctctggagggtgctaaagattgaccggttggagtctactgatctgggtatccaggaggatcctactagttacacagagaatgaatgtcaagaactactttggcggattcacgagggaaataggttgactggtgggctgaaatttgtcacaaaatgctatggaataattggttttatgaagtttcttggtccttactacatggttgtaattaccaggagaagaaaagttggcacaatctgtggccacgatatttattcaattggcaagagtgaaatgatcgcaattccatgtcctatagtctgccccaatgtggctaattctagggatgagaacagatataaacgactcctttgctcggttgatcttacgaaggacttcttcttcagctactcttacaacatcatgcgcagtcttcagaagaacataaatgacaaaaatactggacatgttgtttatgaaacaatgtttgtatggaatgaatttttgacacgagcaatgcggaaccatctcaagaataccgattggaccgtggccttggtccatggattttttaaacagtcgaagctgtcagtacctgggaaggatttctggttgacacttatagccagacgctcgcgtcattttgctggaaccagattcatgaaacgaggtgttaatgaaaagggtagggttgccaatgatgttgagactgaacagattgtttttgaagacacacctgatgacatcccaagtcaaataacttctgttgtacaacatagaggatcgatacctcttgtctggtttcaggaaacttcaagacttaatattaggccagaaatcacgttaaaatcagatgtggactacaaggccacccgccttcattttgaaaaccttgttcttagatatgggaaccctatagtcatcttgaacttaatcaagactcgtgagaagaagcctcgtgaatctttgctccgtgcagaatttgcaaaggctatccattacataaataaggggttaccggatgacaaacgtcttaagtttctacacatggatctcagtaagctttctcgaaggaaaggcaccaatgtgcttggactgttaaacaaggtagcatcagatgtgttggaactaacggacctcctccattgcgagataactacatcatcaaaacctttggatgcttcaagtgaacaagggtcatgtgacattaaaagcaaagatgaattctgcgcagctacaatggtacctctcttactacagaagggtgtcctcaggacaaactgcatagactgcttagaccgcacaaatgtcgcacagtttgcatacggattagctgctttagggcgtcaacttcatgttttgaagctcactgaagaacctaaaattgatcttcatgatcctttggccgatgatctgatggatttctatgaaaggatgggtgatacattagccatccagtacggcggctctgctgctcacaacaagatcttctgtgagcaaagagggcagtggaaagcagcaacccaatcccaggagttccttcgaacccttcagcgttactacaataatgcgtacacagatcctgagaagcaggatgctataaatgtgttcttgggtcattttcagcctcaacaaggcaaaccacctctttggaagttggactcagatcagcattacaatattggccggcaaggaactttaagtgaagaaaccggaagattcataaagaggtcgctctcggatggaaatattctatgtgaaactagtgcacctgtgtctgaccgtaatgttggcgaaaacaacactgcgaactcagaattactacccgtgcaacagctggatgatattagagagcctactgattctgcaccagagatctatatgtgtgaaacaaacccatgccccagtacaaaatatagcatgatgcctggaagacactccatttcagaggaacgacagagttacttgaaaagattaggttatccggagttgcattcttcaaattttctcgatcttgatttgttatcatcttcaggaaattcttgtgatgaagaagcctatgagaggtcatcaatcatccattcacctttggatggtatcagtgttggatccactactacttacagtgagccaggacacaatgatgagggaagggatgagaccgacctgtcgcgctcaagcagccagctctcagactcgcgcgactattccgaccgctttgctcagtgggtggctaatggaggcatgctttgctactaagtgctaaagaatttatcctggtggcatctccatataattttcaccgcagcatgaaagcttgacagctagaacaaaggaaagagcccaagaacaatgtgcgacatgcatgcacagggccggcatccgccaaggctgctgcgagagaagaatcggcacgatttgctcggcggatcgaggctctaacgcggtaactcagttgaggaatgaatgcagatgatggtggcttgtggtttggttttgtttggacaggattggagtgctatggtgaagaattgaccgcagtgaagggaaaggcaatgaatgataggcaaaggcaaacatatctatctgattcgtttcaagggttagcttagctagacagcttatgttttttgttcgcctttagagaaaaaataccccaaaaaaaacacatatggaaaatgataaaaaaa

SEQ ID NO: 3946 - DNA, 3252 bp, Triticum aestivum
ataaaccggaggacaatatacagttggatatatacttgccgaataagaccatgctgggacgaattccctcaatgttatgtacataacgaaatgaatatttggtatctacctatcaaagaattactgtactacttatctcgttactcgaaatcgaaagaacaggaaattaggcctctactctaccaagtctaccacccaagggcttcacttcagaatgtccgtgttgagtcagacacttggacgatcggtggttggttcagacgactcaagcaaggcttccccttgctgtcggtgtccaccagtatcgtgtcgccaggcttgtactcgccgaaaaggatcgcttcgctgatgacatcctccatcagttgggtgatggctctcctcagcggccgcgcgccgtagttcttgtcgtagccttctcggcagatcagctccttcatggcatcggagacctctaggccgatcccgacggccaagagcttgcccttcagttcctcctcgtgccgaattcggcacgaggaccagatcgaaattttatcttgtcggaagagacaagagcaggactctttggagggtgctaaagattgaccggttggagtctactgatttgggtatccaggaggatcctactagttacactgagaatgaatgccaagaactactatggcggattcatgagggaaataggttgaccggcgggctgaaatttgtcacaaaatgctacggaataattggttttatgaagtttcttggtccttactacatggttataattaccaggagaagaaaagttggcacaatctgtggccatgatatttattcaattggcaagagcgaaatgatcgcaattccgtgtcctatagtctgccccaatgtggctaattctagggatgagaacagatataaacgactcctttgctcggttgatcttacaaggacttcttcttcagctactcgtacaacatcatgcgcagtcttcagaagaacataaatgacaaaaatactggacatgttgtttatgaaacaatgtttgtatggaatgaatttttgacacgagcaatgcggaaccatctcaagaataccgattggaccgtggccttggtccatggattttttaaacagtcgaagctgtcagtatctgggaaggatttctggttgacacttatagcgagacgctcgcgtcattttgctggaaccagattcatgaaacgaggtgttaatgaaaagggtagggttgccaatgatgttgagactgaacagattgtttttgaagacacacctgatgacatcccaagtcaaataacttctgttgtacaacatagaggatcaatacctcttgtctggtttcaggaaacttcaagactgaatattaggccagaaatcacattaaaatcagatgtggactacaaggccacccgccttcattttgaaaaccttgttcttagatatgggaaccctatagtcatcttaaacttaatcaagactcgtgagaagaagcctcgtgaatctttgctccgtgcagaatttgcaaaggctatccattacataaataaggggttaccggatgacaaacgtcttaagtttttacacatggatctgagtaagctttctcgaaggaaaggcgccaatgtgcttggactgttaaacaaggtagcatcagatgtgttggaactaacggacctcctccattgtgagataactacatcatcaaaacctttggatgcttcaagtggacaagggccatgtgatatcaaaatcaatgatgatttctgcgcagctacgatggtacctcttttgctacagaagggtgtcctcaggacaaactgcatagactgcttagaccgcacaaatgtcgcacagtttgcatacggattagctgctttagggcgtcaacttcatgtgttgaagctcactgaagaacctaaaattgatctgcatgatcctttggccgatgatctgatggatttctatgaaaggatgggtgatacattagccatccagtacggtggttctgctgctcacaacaagatcttctgtgagcaaagagggcagtggaaggcagcaacccaatcccaggagttccttcgaacccttcaacgttactacaataatgcttacacagaccctgagaagcaggatgctataaatgtattcttgggccatttccagcctcaacaaggcaaacctcctctgtggaagttggactcagatcagcattacaatatcggccggcaaggaactttaagtgaagaaactggaagattcataaagaggtcgctctcggatggaaatattctatgtgaaaacagcgcacccgtatctgaccgtaatgtcggcgaaaacaacaccgcgtcagaattactccccgcgcaacagctggatgatattagagagcctactgattctgcaccagagatctatatgtgtgaaacaaacccatgccccagtacaaaatatagcacgatgcctggaagacactccatttcgcaggaacgacagagttacttaaaaagattaggttatccggagttgcattcttcaaattttctcgatcttgatttgttatcgtcttcaggaaattcttgtgacgaagaagcctttgagaggtcatcgatcatccattcacctttggatggtatcagtgttggatctactactacttacagtgagccaggacacaatgatgagggaagggatgacactgacctgtcgcgctcaagcagccagctctcagactcacgcgactattctgaccgctttgctcagtgggtggctaatggaggcatgctttgctactaagtgctaaagaatttgccctggtggcatctccatataattttcgctgcagcacgaaagctccacggctagaacaaaggtaaaaaagcttaagaagaagctgcggcctgcgtgcacgctgctggcattcgccgaggctgaagcaacagaagaagaatcggcgcaattcgctcggtggatcaaagctctaacgcggcaactcagtcgagaaatgcagatgatggcgtgtggtttggtttggtttggacaggattggagtgaagggaaaggcaatgaatgactggcaaaggcaaacatatctatctaattcttttcaagggttagcttagctagacagcttatgttttttgttcgcctttagagaaaaaaatacaaaaaaaaaacatatggaaaatgataaaagaaaggacttctcctgtaaatatatatggtacagatatatatgctgctcacata

SEQ ID NO: 3947 - DNA, 1455 bp, Zea mays
atgggcggcagaggaaggccgaggcaaaggcaatcaggtgtggggtcaacgtggcatccgtgggacccttcgcggattgcggagtggcattgggttggcagcacgcccctgcacacggtgacacgggccacggcgcggcgcggcgcggcacggggagcgagcgccgagcgagagcaagcaaccgctgtccgccgggccggccacggcgctgccccctgcttcgcgccttcgccggtgcgctcacgcctcacgcaggtgcatgcatcgacctacggtatcctagtctgggatcagaaaagaacacagcaacaacaaagaagaaaggcgcgagcgatggacggtgacgccggaccagagcaacacgggtgcgtgcactacaggagggggtgcaagataagggcgccgtgctgcggcgaggtatttggttgcaggcactgccacaacgaagccaaggactcgctggaggtcagcgtccacgaccgccacgtgcttccccgtcacgacatcaagctggttatctgctctctctgcaacaaagaacaggatgtgcagcaagactgtgcgaactgcggagcatgtctcggcaaatacttctgcgcgaaatgcaacttcttcgacgacgatgtgtcgaagaaccaatttcactgcgatgggtgcggcatatgcaggactggtggcgcagagaatttctatcactgtggcagatgtggatgctgctacaccactacgctgaaggattctcaccgctgcgtggacggagctatgcatcacaactgccctgtctgcatggagtatctattcgactcgatgaaagctatcagcgtgctccactgcggacacaccatccacctggaatgcctttacgagatgagagcgcaccagcagttttcatgcccggtgtgcctgaggtctgcctgcaacatgtccgacatctggcaaaagctggatcagcaggttgcagcgtccccgatgccagcgatctatcagaagaagatggtatggatcctttgcaacgactgtggcgtgacgtccaacgtgcagttccacatcttggcgcacaagtgccctggatgcagctcttacaacacccggcagacgaggggcgatccagccgcatgctctagagtttgagagcaaataaaactgcagtactgcactgcacataaactcgtggggttgtgcggtcgatcgataggtagcttgcatggaggaaattaaagactaccattgcgcatggacacgattggtgccggcagttgagtacgtgtattaggcctgtcatatgtagatgtatcatatgctatgccttcgcaaagaagaatttggcgcagcggacagggtatatacatttcttttgttgctatatatacacacatatttttgttgcgcggtgcttgtgccaatgatggagagttcgcacgttgtttttcttatatttaattgagcttgcttcaa

SEQ ID NO: 3948 - DNA, 989 bp, Panicum virgatum
gcgtccctcacggcgggtcggcggcaccactcgtgctcggctccggcaagcgttcgctttcttcgcggaggtgcagcgatggccgccggcccagagcgatacgggtgcgtgcactacaggaggaaatgcaagatacgggcgccgtgctgcggcgaggtatttgattgcaggcactgccacaacgaagccaaggactcattggaggtcagtatccacggccgccacgtggttccacgtcacgagatcaagctggttatctgctctctctgcaacaaagaacaggatgtacaacaagactgttcaaattgtggagcatgtcttggtaaatacttctgcgcaaaatgcaacttgtttgatgatgatgtttcaaagaaccagtttcactgcgatggatgtggcatatgtaggactggtggtgtagagaatttctaccactgtgataaatgcggatgctgctatacttatctgctgaaggattctcatcgttgcgtggacagagcaatgcatcaaaactgccctgtatgctttgagtatctattcgagtcgacgaaagctgtcagcgtgctccattgtggacacacgattcatctgcaatgcctgtacgagatgagagctcaccagcagttctcgtgcccagtttgcctgaggtcttcttgtgacatgtctgacaagtggcagaagcttgatcaagaggttgcagcctccccgatgccagcaatctgtcagaagaagatgatatggatcctctgcaacgattgtggaatgacatcgaacgtgcagttccacatcttggcgcacaagtgccctggatgcagctcttacaacacccggcggacgaggggagatcaagctgcatgttccagagtctgagaacgagggggcaagccggaagcaaataaaccatgctgcacagaggctcgtgtgatcaataagctgtaggcctgtacaaattggtgcaaaaaatgcagatcgtgttcattggctctcct

SEQ ID NO: 3949 - DNA, 1306 bp, Setaria italica
gtgacattggcagcacggcggctcgggaagccttcaccgaagagcaaggaaccgcctgggagggggacgcgtcggtgccgccgcccctgctcgtgctaggccggtggtcacgcagttgacgcagacaaggtgaagctccgagaagaccgaagagaagcagagcttggaatttgttggcgaaccttttgtctgaggtaaaacagagaggaaaaggcagcacggaatggacgcggacaccggcccagtgcaatacgggtgcgtgcactacaagaggaaatgcaagataagggcgccgtgctgtggcgagatatttgattgcaggcactgtcacaatgaagccaaggattcactggaggtcaataaccacgaacgccacgtggttcctcgccacgagatcaagctggttatctgctctctctgcaataaagaacaggatgtacatcaagattgttcaaattgtggagcatgttttggtaaatacttctgtgcaaaatgcaacttctttgatgacgatgtatcaaagaaccaatttcactgtgatggatgtggcatatgtagaactggtggtgcagagaacttctatcactgtgggaaatgcggatgttgctatacctatcagctgaaggattctcatcgttgcgtggacggagcaatgcatcataactgccctgtatgctttgagtatctattcgactcgacgaaagctgtcagcgtgctccattgtggacacacgattcatctgcaatgcctgtacgagatgagagctcatcagcagttctcgtgcccggtttgcttgaggtctgcttgcgacatgtctgacatatggcgaaagcttgatcaagaggttgcagcctccccgatgccggcaatttgtcagaagaagatgatatggatcctctgcaacgattgtggaatgacatcgaacgtgcagttccacattttggcgcacaagtgcccgggttgcagttcctacaacacccggcagacgaggggcggtccagctgcatgctccagagtttgagaacaagccaagagggaaaccggaagcaaataaaccatgctgcacaggagctggtgtgatcaataagctataggcctgtagacagcgtccatgtactctcctgatctccttccccagagaacagctagttgacctcaccgtcgtttgcgttgctgtgcctggaatagtggaattgtatatgctcggcccttctcgtattgggttatcgacatgatgggccactaagctgcttttcgctttcagcccataagtgatgtctgcttgcaaaaatggtttcgcctgaag

SEQ ID NO: 3950 - DNA, 1386 bp, Setaria italica
gggggtgctgcggagtgacattggcagcacggcggctcgggaagccttcaccgaagagcaaggaaccgcctgggagggggacgcgtcggtgccgccgcccctgctcgtgctaggccggtggtcacgcagttgacgcagacaaggtgaagctccgagaagaccgaagagaagcagagcttggaatttgttggcgaaccttttgtctgaggtaaaacagagaggaaaaggcagcacggaatggacgcggacaccggcccagtgcaatacgggtgcgtgcactacaagaggaaatgcaagataagggcgccgtgctgtggcgagatatttgattgcaggcactgtcacaatgaagccaaggattcactggaggtcaataaccacgaacgccacgtggttcctcgccacgagatcaagctggttatctgctctctctgcaataaagaacaggatgtacatcaagattgttcaaattgtggagcatgttttggtaaatacttctgtgcaaaatgcaacttctttgatgacgatgtatcaaagaaccaatttcactgtgatggatgtggcatatgtagaactggtggtgcagagaacttctatcactgtgggaaatgcggatgttgctatacctatcagctgaaggattctcatcgttgcgtggacggagcaatgcatcataactgccctgtatgctttgagtatctattcgactcgacgaaagctgtcagcgtgctccattgtggacacacgattcatctgcaatgcctgtacgagatgagagctcatcagcagttctcgtgcccggtttgcttgaggtctgcttgcgacatgtctgacatatggcgaaagcttgatcaagaggttgcagcctccccgatgccggcaatttgtcagaagaagatgatatggatcctctgcaacgattgtggaatgacatcgaacgtgcagttccacattttggcgcacaagtgcccgggttgcagttcctacaacacccggcagacgaggggcggtccagctgcatgctccagagtttgagaacaagccaagagggaaaccggaagcaaataaaccatgctgcacaggagctggtgtgatcaataagctataggcctgtagacagcgtccatgtactctcctgatctccttccccagagaacagctagttgacctcaccgtcgtttgcgttgctgtgcctggaatagtggaattgtatatgctcggcccttctcgtattgggttatcgacatgatgggccactaagctgcttttcgctttcagcccataagtgatgtctgcttgcaaaaatggtttcgcctgaagaagagagagaaggttattaacttgcgcaagaaaattaatactagctcgatcaaagtttgatccgag

SEQ ID NO: 3951 - DNA, 1589 bp, Oryza sativa
ctcgtttttctcctcttctttaaaccgcgccgcgccgcgcctacccaaatatataaccgtgggtgcagccgtgcgccgagccgtgcgtgcagcaggcgcaggccgtgctcgtgctcgctcgctcgggcagtcggtctccctccgcgaggagagaggagacccttggcaagcgtggaggacgactcggtgccggccgagtgcggctgctgctgctgcggctgtctcctgccgtggccgcgaaatcatcgggttggccggtggtcggcgcacgcaggtgctaagagctacaatacctgagaattcagttagtggatcatcagttcgaggaaagctgcgagaaatggagatggacttggcagtcgagcagtacggatgcgtgcattacaggaggaaatgcaagataagggcgccctgctgcggcgagatcttcgattgcaggcactgccacaacgaagcgaaggactcgttggaggtcagcatcagcgaccggcacgagatccctcgccatgaaatcaagctggttatctgctctctctgcaacaaagaacaggatgtacaacaggattgctccaattgtggggcatgcttgggtaaatatttctgcgcaaaatgcaacttttatgatgacgatgtatcaaagaaccaatttcactgcgatggatgtggcatatgcagaactggtggtgcagagaacttctttcactgtgacaaatgcggatgctgctacagctatgtgctgaaggattcccatcattgtgtggaaagagcaatgcaccataactgccctgtatgcttcgagtatctatttgactcaacaaaagacatcagtgcactgcactgcggacacacgatccatctggaatgcctatacgagatgagatcccatcaacaattctcttgcccggtctgcctgaggtctgcttgtgacatgtcccatgcatggcaaaagcttgatcaagaggttgcagcatcgccgatgccagtgatctatcagaagaaaatgatatggatcctatgcaacgactgtgggacgacatcgaacgtgcaattccacatattgggacacaagtgccccggatgcagctcttacaacacccggcagacaagagccgcccctgctgccgcgtgctccagagtctgaattctgaagaacagtgagatgagagctagtctgaactccgaagaacagcgagagatttgcactgctctctgcagtctgaaatgcccaataaaaagatttgcagcctgtgattagtctcaaagcccatcaaaacgcaaacaaccgtttgttctgaaatttgggctcgtccatggtttgttccccctagtaggccggtctggtgctaatctggcccagcgttgtgctttaggcggatttcgactttgcttgcctgctgggccttggccgcaagcgccagtcaggactctgcatcgagatgatttttatcattaccgtgatttttatcgcgttgtgctttcgccggtgaggtatttctcgcaaagaaaaaggaactaacgaaatgtgctcgtcgttcattggcatgccggtgcttacgagattgaaataaagaagtagcggtatgatcatc

SEQ ID NO: 3952 - DNA, 1369 bp, Saccharum officinarum
cggagtggcattcggcagcacgtccctgctgcacacgggaagcaagcagccgccgtccgcccctgctggaatcctgctgcgcgtgggagttgggacggcaagagctggtcgtagcacggacacggctttatattcgttgttgccggcgtgtttctctcccccgccggcttttggagcggtggacggccgcgctgctgctctgctcaactttaagcccccggccggcgccttccgtcggtgcgacggtgtcttacgtctggtgggcggcgacgccctgacgctgacgcatacaaggtgcatgcacaacaacgaaggggaaaggtgcgagagcaatggacgctgacgccggaccagagcgatacgggtgcgtgcactacaggaggaaatgcaagatagggcgccgtgctgcggcgaggtatttgattgcagacactgccacaaccaagccaaggattcactggaggtcagcatccacgaccgccacgtggttccccgtcacgacatcaagctggttatctgctctctctgcaataaagaacaggatgtacagcaagattgttcaaattgtggagcatgtctcggtaaatacttctgcgcgaaatgcaacttcttcgatgatgatgtaagctcggttttgaagtattaagcgaagtagtctatgattttacgtgctaatttggacataatttcagaagtattccatcttctgttttctccgattttgtgtcgtgttccctgacatttcaggtatctaagaaccaatttcactgtgatggatgcggcatatgtagaactggtggtgcagagaatttctaccactgtgataaatgtggatgctgctatacctctctgttgaaggattctcactgttgcgtggacagagctatgcatcacaactgccccgtatgcattgagtatctattcgactcgacgaaagctatcagtgtgctccattgtggacacacgattcacctggaatgcctgtacgagatgagggcgcatcagcagttctcatgcccggtttgcctgaggtctgcctgcaacatgtctgacatatggcaaaagctagatcaagaggttgcagcgtctccgatgccggcgatttatcagaagaagatgatatggatcctttgcaacgactgtggcatgacgtcgaacgtgcagttccacatcttggcgcacaagtgccctagatgcagctcttacaacacccggcagacgaggggcgagccagctgcatgctccagagtttgagagcaagtcaagtcaggtgggaagccggaagcaaataaaaccatactgcactgcacagaaactcgtgtgtgatcgatcaataagagcaaacccaataaacttgggccaatcaata

SEQ ID NO: 3953 - DNA, 2643 bp, Brachypodium distachyon
cgaccacccgcacgggcacgatgccgacggcgtcgcggcagcgcctgtgccgcgcggccctgctcgtcgccggcgcggggtacctcgccttcctcctgctcttcgaggtcccttccctgcccttctcctcctcctcctcctcctcggctgcggcgtcgcagcagctgcctacccacagctcgcgccgccgcgagctcgaggcgtcggcgtccacctccccgttctcccccgctcgcccctccaagcccgccttccccgcggccggttcccccgctccgtcccctcccccgctcccgatcttctcctcgctcctcgttctccccaggtccaacgccacagcgacccccttcgacggcaccgccgccgacgcctttgccgccgccaagccccacctgacacatctcaggaccgccgccgcctctgcgtccgtcgccgcgtccccgcccccgtcttccccgacctgccccgcctccatctcgctgcacgcggacaagctccccgcgaacggggtccggacggtggaactgccgtgcgggctcgcggtggggtcgcacgtgaccgtcgtggcccgcccaagggccgcgcggccggagtacgacccgcagatcgccgagcgcaaggacggcaagacgcccctcatggtgtctcagttcatggtcgagctggtgggcaccaaggtggtcgacggggaggcgccgcccaggatactccacttcaaccccaggatccgaggggattacagcggcaagcccgtgattgagatgaacagctgctacaggatgcagtgggggcgctctcagcgctgcgagggcttcgcgtcccgtcccgccgaagagactgttgatgatcaactgaagtgtgagaaatggattcgggacgatgacaacaagtcggaggaatcaaaaatgaaatggtgggtgaaacgtttgatcggtaggccgaaggatgtgcacatcagttggccatatccattcgcagaaggcaagctatttgttttgactctaacagctggtttggaaggttaccatgtcaatgttgatgggaggcatgtcgcttcatttccataccgcactggttacactcttgaggatgcaactggcttgtctctgaatggggacatcgatattgagtcgatttttgctagttctctgcccaattcacatcctagtttctccccggagagatacctcgaaatgtctgagcagtggagagccccacccctaccaactgaacctgttgagctttttattggcattctgtcagcagctaaccattttgctgagcgtatggctgtgcggaagtcatggatgatgtatacaaggaaatcatctaatattgtagctcggttctttgtggctctgaatggaaaaaaggaggtcaatgcagagctgaaaagggaggcagagttcttccatgacattgttatagtgccttttatggatagttatgaccttgttgtcttgaagactattgcaattgccgagtatggggttcgagtcatcccagcaaaatatgtaatgaaatgtgatgatgacacatttgttagaattgattctgttctggatcaagtgaagaaagttcaaagcgataagagtgtgtatgtgggaagcatgaactacttccatagaccactgagatctggcaagtgggctgtaacttatgaggaatggccagaagaggtgtacccaaattatgctaatgggcctggctatgtaatctcagcagatattgcaagctatattgtttctgaatttgacaatcagacacttcggctatttaagatggaagatgtcagcatgggcatgtgggtcgagaagttcaataacactcgccgaccagtggagtatcggcatgatgtcaggttttaccaggcaggttgctacgatggttatttcactgcacactatcagtccccccagcacatgatctgtctatggagaaaactgcagtctggcagcacccattgttgcaacgtgagatgacgatggtgaaaaatttctggcattgtgggtcggagagacgaaacaatcagctcgcgagcacatcgctcacagaactgaaatcatcaccactgatgctgaggaaaagtgaggagaactctcttctggacttgccatacaattcattcattcttttgatcggtggcctgtttccaagctgctgattctgacacctgatggatgccctagcgctacttttgacacttgttgatatttatactcgcgtcaaattttcttgacctaggaattttcagattgggcggcatattgtgtatagaaacattttcagagttactatttatgatctacagtgtttggtttgtcaagcagatggagaatttttcactggcaatttatttgtcaccagaaaaaaccatagaatagcttggcacttgtgatacgaactgaattactggactaaatagttatagctagttcatctgtgattgatatcacacaattctgggaacatcaaatgctccatccgtggtctgatgcaagcagggaaataagattgtgaattcaggtaggtaaaacgagaataattcgttattctgatgccagaaataacgctggttttctgtttattcatgaatatattaaatttaagaaatgcaagttcattatgaagcacacattaaac

SEQ ID NO: 3954 - DNA, 2857 bp, Brachypodium distachyon
agcaaagccgttaagctcttttctctttacctacccaccggcggtgtttggtgttttgcatcctccgcaccgccgtcccatccccttccccaccacgcaacggtcaggtcgccgccggagtccaaccccgcaataagtagcaccccatctcctccccgcaaacggctacttcctcctccccctcttcttccttccgccaccttcgagaaccttcgaccacccgcacgggcacgatgccgacggcgtcgcggcagcgcctgtgccgcgcggccctgctcgtcgccggcgcggggtacctcgccttcctcctgctcttcgaggtcccttccctgcccttctcctcctcctcctcctcctcggctgcggcgtcgcagcagctgcctacccacagctcgcgccgccgcgagctcgaggcgtcggcgtccacctccccgttctcccccgctcgcccctccaagcccgccttccccgcggccggttcccccgctccgtcccctcccccgctcccgatcttctcctcgctcctcgttctccccaggtccaacgccacagcgacccccttcgacggcaccgccgccgacgcctttgccgccgccaagccccacctgacacatctcaggaccgccgccgcctctgcgtccgtcgccgcgtccccgcccccgtcttccccgacctgccccgcctccatctcgctgcacgcggacaagctccccgcgaacggggtccggacggtggaactgccgtgcgggctcgcggtggggtcgcacgtgaccgtcgtggcccgcccaagggccgcgcggccggagtacgacccgcagatcgccgagcgcaaggacggcaagacgcccctcatggtgtctcagttcatggtcgagctggtgggcaccaaggtggtcgacggggaggcgccgcccaggatactccacttcaaccccaggatccgaggggattacagcggcaagcccgtgattgagatgaacagctgctacaggatgcagtgggggcgctctcagcgctgcgagggcttcgcgtcccgtcccgccgaagagactgttgatgatcaactgaagtgtgagaaatggattcgggacgatgacaacaagtcggaggaatcaaaaatgaaatggtgggtgaaacgtttgatcggtaggccgaaggatgtgcacatcagttggccatatccattcgcagaaggcaagctatttgttttgactctaacagctggtttggaaggttaccatgtcaatgttgatgggaggcatgtcgcttcatttccataccgcactggttacactcttgaggatgcaactggcttgtctctgaatggggacatcgatattgagtcgatttttgctagttctctgcccaattcacatcctagtttctccccggagagatacctcgaaatgtctgagcagtggagagccccacccctaccaactgaacctgttgagctttttattggcattctgtcagcagctaaccattttgctgagcgtatggctgtgcggaagtcatggatgatgtatacaaggaaatcatctaatattgtagctcggttctttgtggctctgaatggaaaaaaggaggtcaatgcagagctgaaaagggaggcagagttcttccatgacattgttatagtgccttttatggatagttatgaccttgttgtcttgaagactattgcaattgccgagtatggggttcgagtcatcccagcaaaatatgtaatgaaatgtgatgatgacacatttgttagaattgattctgttctggatcaagtgaagaaagttcaaagcgataagagtgtgtatgtgggaagcatgaactacttccatagaccactgagatctggcaagtgggctgtaacttatgaggaatggccagaagaggtgtacccaaattatgctaatgggcctggctatgtaatctcagcagatattgcaagctatattgtttctgaatttgacaatcagacacttcggctatttaagatggaagatgtcagcatgggcatgtgggtcgagaagttcaataacactcgccgaccagtggagtatcggcatgatgtcaggttttaccaggcaggttgctacgatggttatttcactgcacactatcagtccccccagcacatgatctgtctatggagaaaactgcagtctggcagcacccattgttgcaacgtgagatgacgatggtgaaaaatttctggcattgtgggtcggagagacgaaacaatcagctcgcgagcacatcgctcacagaactgaaatcatcaccactgatgctgaggaaaagtgaggagaactctcttctggacttgccatacaattcattcattcttttgatcggtggcctgtttccaagctgctgattctgacacctgatggatgccctagcgctacttttgacacttgttgatatttatactcgcgtcaaattttcttgacctaggaattttcagattgggcggcatattgtgtatagaaacattttcagagttactatttatgatctacagtgtttggtttgtcaagcagatggagaatttttcactggcaatttatttgtcaccagaaaaaaccatagaatagcttggcacttgtgatacgaactgaattactggactaaatagttatagctagttcatctgtgattgatatcacacaattctgggaacatcaaatgctccatccgtggtctgatgcaagcagggaaataagattgtgaattcaggtaggtaaaacgagaataattcgttattctgatgccagaaataacgctggttttctgtttattcatgaatatattaaatttaagaaatgcaagttcattatgaagcacacattaaaca

SEQ ID NO: 3955 - DNA, 2829 bp, Oryza sativa
gagctcacaattcacatgtgctgccattgcggagttgcggtgtttggtgttccacccgccgcagctcaccaccgctagcgccagcctcccaacacacaacggtcaggtcccccgatccccgttaagtccaatccccgacaggtattagtaccaccccgcatctccccctcctccactcgaaacggctacttcctccccttcctccccctccaccaccttctagaaccttccacgatgccgccgccgccgcggaagcgcctcggccgcgcggccctgctcctcgccgccgccgcctacctcgccttcctcctcctcttcgagctcccctccctcgacctcttcccctcctccgacgccgcggcgggcgcggcgatgcccacccaccgcccacgccgccgcgagctcgaggcctcgtcgtcgtcttcggcgttcgcttcccccgtcctccgccgccccgccacggcggtgtctcccgcgccggcttctgctgctgccgcggcggctggggcgctcccgatcttctcgtcgctgctcctcctcccccggcccaacgcgacggccaccccgttcgacgggaccgccgcggaggcgttcgccgcggcgaggccgcacctcgaccacctcaggactgctgctgctgcggcggcggaggaagcttcgtcgtcgtcgacggcgccgacgtgcccgacctcgatctcggtgcacgcggacgggttgcccggggacggggtgaggacggtggagctgccgtgcgggctcgcggtggggtcgcacgtgacggtggtggcgcggccgagggcggcgcggccggagtacgacccgaagatcgccgagaggaagtccgggcaggagccgctcatggtgtcgcagttcatggtggagctggtcgggaccaaggccgtggacggggaggccccgcccaggatactccacttcaaccccaggatccgcggcgactactccggcaagccggtcatcgagatgaacagctgctaccggatgcagtgggggcagtcgcagcgctgcgagggctacgcctcccgccctgccgacgagacagttgatggccaacttaagtgtgagaaatggattcgtgacgacgacaagaagtctgaggaatcgaagatgaagtggtgggtaaagcgtctaattggtaggccaaaggatgtgcacatcagttggccataccccttcgcagaaggcaagctgtttgttttgactctaacagctggtttggaaggttaccatgtcaatgttgatgggcggcatgttacttcctttccttatcgcactggttacactcttgaggatgcaaccggcttatctctgaatggagacatcgatatcgaatccatttttgctagttccctgcccaattcgcatcctagttttgccccagagagataccttgaaatgtctgaacagtggagggcaccaccactaccaactgagcctgttgagctttttattggtattctttcagcagccagccattttgctgagcggatggctgtacggaagtcgtggatgatgtatacaaggaaatcgactaatatagtagctcggttctttgtggctctgaatgggaaaaaggaggttaatgcagagctgaaaagggaagcagagttctttcaagacattgttatagttcctttcatggatagctatgaccttgttgttttgaagaccattgctattgctgagtatggggtgcgagtcatacccgcaaaatacatcatgaaatgtgatgatgatacatttgttagaattgactcagtactggatcaagtgaagaaagttcgaagtgataagagtgtgtacgtaggaagcatgaactacttccataggccactaagatctggcaagtgggctgtaacttatgaggaatggccagaggaggcatatccaaattatgccaatggacctggctatgtaatttcagccgatattgcacgctacattgtatctgaatttgacaatcagacacttcggctatttaagatggaagatgtaaacatgggcatgtgggtcgagaagttcaacaacacgcttcggccggtcgaataccggcacgatgtcaggttctaccagtctggctgcttcgacggctacttcacggctcactatcagtcccctcagcacatgatctgcctctggagaaaactgcagtccggaagctcacggtgctgcaacgtgagatgacaatggcagcaaaaattagccgtattttggagcaaatagagacgatgttaactcgtaagctcagctcgctgttggaacaccagaaaatcatcagcattcagcgatgctgacggttcggaggagcgctcatcttctggactggacctgatatatgattcgttcattcttttggtcggtggctccgtttcaagctgctgatttctgacacctgatcaatgatgttcttgccttcttggggattctttcgcctgttgatatttatactcgcgtcaaatttatttgacctaggaatttttgaggctggtggtggtggtggtggcggcggtggtatgccggcggcatgttttgtgtataaaaaggattttatgagttttactgtttgtgagtatatattcggtggactcctattggctgacactcttaccattactgtttttatgagttatttttagctggggagtgttattagagagatccttttgaacgggcagtacattcgtgagggaattcaatatataaaaatataatttatgcttaaaatactcttaataataaaataaatcatgacagaataaatcatatacatgtaatttatttaaatatgatgaatggtaaaacttaattaaa

SEQ ID NO: 3956 - DNA, 2674 bp, Oryza sativa
gagctcacaattcacatgtgctgccattgcggagttgcggtgtttggtgttccacccgccgcagctcaccaccgctagcgccagcctcccaacacacaacggtcaggtcccccgatccccgttaagtccaatccccgacaggtattagtaccaccccgcatctccccctcctccactcgaaacggctacttcctccccttcctccccctccaccaccttctagaaccttccacgatgccgccgccgccgcggaagcgcctcggccgcgcggccctgctcctcgccgccgccgcctacctcgccttcctcctcctcttcgagctcccctccctcgacctcttcccctcctccgacgccgcggcgggcgcggcgatgcccacccaccgcccacgccgccgcgagctcgaggcctcgtcgtcgtcttcggcgttcgcttcccccgtcctccgccgccccgccacggcggtgtctcccgcgccggcttctgctgctgccgcggcggctggggcgctcccgatcttctcgtcgctgctcctcctcccccggcccaacgcgacggccaccccgttcgacgggaccgccgcggaggcgttcgccgcggcgaggccgcacctcgaccacctcaggactgctgctgctgcggcggcggaggaagcttcgtcgtcgtcgacggcgccgacgtgcccgacctcgatctcggtgcacgcggacgggttgcccggggacggggtgaggacggtggagctgccgtgcgggctcgcggtggggtcgcacgtgacggtggtggcgcggccgagggcggcgcggccggagtacgacccgaagatcgccgagaggaagtccgggcaggagccgctcatggtgtcgcagttcatggtggagctggtcgggaccaaggccgtggacggggaggccccgcccaggatactccacttcaaccccaggatccgcggcgactactccggcaagccggtcatcgagatgaacagctgctaccggatgcagtgggggcagtcgcagcgctgcgagggctacgcctcccgccctgccgacgagacagttgatggccaacttaagtgtgagaaatggattcgtgacgacgacaagaagtctgaggaatcgaagatgaagtggtgggtaaagcgtctaattggtaggccaaaggatgtgcacatcagttggccataccccttcgcagaaggcaagctgtttgttttgactctaacagctggtttggaaggttaccatgtcaatgttgatgggcggcatgttacttcctttccttatcgcactggttacactcttgaggatgcaaccggcttatctctgaatggagacatcgatatcgaatccatttttgctagttccctgcccaattcgcatcctagttttgccccagagagataccttgaaatgtctgaacagtggagggcaccaccactaccaactgagcctgttgagctttttattggtattctttcagcagccagccattttgctgagcggatggctgtacggaagtcgtggatgatgtatacaaggaaatcgactaatatagtagctcggttctttgtggctctgaatgggaaaaaggaggttaatgcagagctgaaaagggaagcagagttctttcaagacattgttatagttcctttcatggatagctatgaccttgttgttttgaagaccattgctattgctgagtatggggtgcgagtcatacccgcaaaatacatcatgaaatgtgatgatgatacatttgttagaattgactcagtactggatcaagtgaagaaagttcgaagtgataagagtgtgtacgtaggaagcatgaactacttccataggccactaagatctggcaagtgggctgtaacttatgaggaatggccagaggaggcatatccaaattatgccaatggacctggctatgtaatttcagccgatattgcacgctacattgtatctgaatttgacaatcagacacttcggctatttaagatggaagatgtaaacatgggcatgtgggtcgagaagttcaacaacacgcttcggccggtcgaataccggcacgatgtcaggttctaccagtctggctgcttcgacggctacttcacggctcactatcagtcccctcagcacatgatctgcctctggagaaaactgcagtccggaagctcacggtgctgcaacgtgagatgacaatggcagcaaaaattagccgtattttggagcaaatagagacgatgttaactcgtaagctcagctcgctgttggaacaccagaaaatcatcagcattcagcgatgctgacggttcggaggagcgctcatcttctggactggacctgatatatgattcgttcattcttttggtcggtggctccgtttcaagctgctgatttctgacacctgatcaatgatgttcttgccttcttggggattctttcgcctgttgatatttatactcgcgtcaaatttatttgacctaggaatttttgaggctggtggtggtggtggtggcggcggtggtatgccggcggcatgttttgtgtataaaaaggattttatgagttttactgtttgtgagtatatattcggtggactcctattggctgacactcttaccattactgtttttatgagttatttttagctggggagtgttattagaga

SEQ ID NO: 3957 - DNA, 2718 bp, Zea mays
gactgaaaaactgaacgtttagcagaccgcagcagcttttggtggccagaagctcaaaaaagctgaaacaaaccggggcaatgaatggtggcacggtagcacgatatagggagaaaataatatagtggaccgtgagagttgagccaacagtgttcggctggcggtagtcgccgcaaaacggaaatctttcgcctccgccccgctggccgctgccgtttcattcactttccaatttcctttcctcacctccataaaaaaactcggccacggttatttatctctttcgctccgctttctcaatcactgggcctgggggagatcgagacctagagcggaggacgggtgggcggcgctgagggccttaggcgaatggcggtagaggaggccgcggagagctgcggcagccacgccgcggccgctgcgtccggcggcggcgcggcggagctcgctacgtcctcgtcatcggccgccgcggcggtgcaggcgcggaagcagcagcagcagcagcgccataagctcgaggtgtacacagaggttctccggcgcctccacgacgccggcctgcccgacgcgcgggcgcccgggttcgacgacgagctctggaaccacttcaaccgcctccccgcccgatacgccatggatgtgaacgtggagagggcggaggacgtgctcacgcacaagcggcttctggagcaggccaaggatccggctcagcgcccggctttcgcggtgcgggccgtgcaggtatctccaattcttgatgggaatcagactgatgctgattcgaatactgcaggggaggaagtcgcttcaagactgttgaacaggcagcagagcatacatcctcctcctgcctttggttcttctacaaatcttgaggcccttgctcttgaagctagcaagtctcatcaagatcacgatagcacctctgataattgtcgatccctgtacaggcccatgcatgaaatcaccttttcaaccattgacaagccaaaacttctcagtgagctgacatctctgcttggtgagcttggtctcaacattcaagaagcacatgcattttcaacaaatgatggctactcacttgatgtatttgttgttgttggttggcatgatgaggaaacagaggatttagtagaagcagtgcagaaggaaattggcaggattgaagagacacaagcatggtcttcatctcattcatggtctactccagttgaaaacatgcagattgctgagatttcagcagctggccgtgttgagataccaacagatggtgctagtgaatgggaaattgatgtaaaactgctcaagtttgggaataaagtagcatcaggatcatatggtgatctttaccggggtacatattgcagtcaagatgttgctattaaagtgctgaaacctgagagaataaatgcagacatgcagcgtgaatttgcccaggaagtatatatcatgaggaaggtacgtcacaagaatgttgtgcaatttattggtgcttccactaaacccccaaatctatatatagtgacagaatttatgtccggtggaagtgtgtatgattacctccataaacataaaggtgttttcaaacttcctactttagttggagttgctatggatgtgtcaaaaggcatgagctacttacaccagaataatattattcatcgtgatttgaaaactgcgaaccttctgatggatgaaaatgggactgttaaagttgctgattttggtgtcgcacgtgttaaagctcaatctggagtcatgactgcagaaactggtacttaccgttggatggccccagaggtcatagagcataaaccctatgatcagaaggctgatgtttttagttttggaattttgatgtgggagctactcacagggaagattccttatgagtatctgactccactacaagcagctgttggcgtggtgcagaagggattacggcctacaattccgaaacatacttatgcaatgctttctgagcttcttcagaaatgttggcagcaagaccccgctcaaagaccagacttttccgaaatattagaaactcttcagagaatagcagaggaagtcggagacgagcacgaggggaagcacaaggacagaacactgggtggtttcttttcagctctgagggggcggagccattgagacacggttgaagacttgaaatgtacatggcctcggtccatcctggaaggatctgaactacaaccagctcctgttccccgcacatagcgacagtacacagaaatactgtacagacatgctgcagccggagttgactaagtggcaattttttagcggcagccatcgcttttcgcctatctgcttgttactcctgagttccatcacaatgagaggaagcttgggaactgtgcatcataaccagtctgatttctctaacagagtctaatcttgctgtagatgaaaataataagccagatccaggccgtggcatgattcttttaaggttccatcttttagcatattttcttctacgtgccgtcattcttttctggacatgctccacccctctgttgtggaacaacgcggcaagcttgagttagctgagcaaggcacctgcatctgcatgggatctgctcggaacaaagttgggttatcttgtgctaagcttttgttccccagtttccgtgactacaaatgatatcaatttattttaaagaaatggaaaaaacatgtgtatagtctgca

SEQ ID NO: 3958 - DNA, 2316 bp, Zea mays
cactttctagtttcctttctcctcctccagccctccttaaaaaatcggccacggttatttatttctctcgccccgctccgctttcctaatctgcgagctggggggagatcgagaccctagaacggagggcgggtgtgcggcgctgagggccttagacgaatggcggtggaggagaccgcggagagctgcggcagccacgccgcgaccgctgcgtccggcggcggcgcggcggggcccgcgacgtcctcgtcatcggccgccgcggcggcgcaggcgcggaagcagcaacagcagcagcgccataagctcgaggtgtacacggaggttcttcggcgcctccacgacgccggcctgcccgacgcgcgggcgcccgggttcgacgacgagctctggaatcacttcaaccgcctccctgcccgctacgccatggatgtgaacgtggagagggcggaggacgtgctcacgcacaagcggctcctggagcaggccaaggatccggctcatcgcccggctttcgcggtgcggtccgtgcaggtatctccaattcttgatgggaatcagactgattctgattcgaacactgcaggggaggaagtcgcttcaagactgttgaacaggcagcaaagcatatatcctcctcctgccttcggttcttctacaaatcttgaggcccttgctcttgaagctagcaagtctcatgatcacgatagcacttctgataatggccgatctctatacaggcccatgcatgaaatcaccttttcaaccattgacaagccaaaacttctcagtgagctgacatctctgcttggtgagcttggtctaaacattcaagaagcacatgcattttcaacaaatgatggctactcacttgatgtcttcgttgttgtcggttggcatgatgaggaaacagaggatttagtagaagcagtgcagaaggaaattggcaggattgaagagacacaagcatggtcttcatctcattcatggtctactccagttgaaaaaatgcagattgctgagaattcagcagctgaccgtgttgagataccaacagatggtgctagtgaatgggaaattgatgtaaagcttctcaagtttgggaataaagtagcatcaggatcatatggtgacctttaccggggtacatattgcagtcaagatgttgctattaaagtgctgaaacctgagagaataaatgcagacatgcaacgagaatttgctcaggaagtatatattatgaggaaggtccgtcacaagaatgttgtgcaatttattggggcttgcactaaacccccaaacctatgtatagtcacagaatttatgtccggtggaagtgtgtatgattacctccataaacataaaggtgttttcaaacttcctgctttagttggagttgcgacggatgtgtcaaaaggcatgagctacttacaccagaataatattattcatcgtgatttgaaaactgcaaaccttctgatggatgaaaatgggactgttaaagttgctgattttggtgttgcacgtgttaaagctcaatctggagttatgactgcagaaactggtacttaccgttggatggccccagaggtcattgagcacaaaccctatgatcacaaggctgatgtttttagttttggaattttgatgtgggaactactcacagggaagattccttatgagtacctgactccactacaagccgctgttggtgtggtgcagaagggattacggcctacaattccaaagcatactcacgcaaagctttccgagcttcttcagaaatgctggcagcaggaccctacccaaagaccagacttctccgaaatattagaaactcttcagagaatagcagaggaggtcggagaggaacacgatgggaagcacaaggacagaacactgggtggtttcttttcggctttgagggggcggagccattgagacacagttgaagacttttaataataaaaatgtacatggcctcggtccgtcctttgaaggacctgagctacaaccagtgcagtgcctgttcctcgcacgtcagcaccagtacacagaaatacagacctgctgtgcagctgcagttgactgaagcggcaatttttatttagctgcagccatcgctttccgcctatccgcttgttattcctgagttccattacgcaatgtataacataggtgaggaagcttgggaactgtatcatcagtctgatttccctgaaagtgcaatcctgctgtagatgaaaaaaaaagccagattcaggccgtggcatgattcttttaagactccatcatttagcatcttttcgtttatgg

SEQ ID NO: 3959 - DNA, 2538 bp, Setaria italica
cagtggccggctgccggcagggcagtcaccgctgcaaaacgaaaatcccccctctccacagccgtttccttccttcactttccaatttcctttctcctcctcctcaaaaaatcaggcacggttatttatttctctcgcccctctacgctttcctaatccgcgagctgggggtgagatcgagacctagagcggcggggcggggctaacgcgaatggcggtggaggaggccgcggagagctgtggcagccacgccgcggccacggcggcggccgccgcgtccggcggaggggcggcggggccagcgacgtcctcctcgtcggccgccgtggcggcgcaggcgcggaagcagcagcagcagcagcgccacaagctcgaggtgtacacggaggtgctccgccgcctccacgagtctggcctgcccgaggcccgggcgcccgggttcgacgacgagctctggaaccacttcaaccgcctccccgcccgttacgccatggatgtgaacgtggagagggcggaggacgtgctcacgcacaggcggctgctggagcaggcgagggatccggcgcagcgcccggcgttcgcggtgcgggccgtgcaggtatctccaattcttgatgggaatcagactgatgctgattcgaacactgcaggggaggaagttgcttcaagattgttgaacaggcagcaaagcatacaccctcctcctgctttcggttcttctacaaatcttgaggcccttgctcttgaagttagcaagtctcaaggccaagatcatgacagcacctctgataatggtcgatctctgtacaggcccatgcatgaaatcaccttttctaccattgacaagccaaagcttctcagtgagctgacatctctgcttggtgaacttggtctaaacattcaagaagcacatgcattttcaacaaatgatggttactcactcgacgtctttgttgttgttggttggcacgatgaggaaacagaggatttagtagaagcagtacagaaggaaattggcaggattgaagagacacaagcatggtcttcatctcattcatggtctacccccgtcgaaaatatgcagattgctgagaatccagcagctgatcgtgttgagataccaacagatggttctagtgaatgggaaattgatgtaaaactgctcaaatttgggaataaagtagcatcaggatcatatggtgatctttaccggggtacatattgcagccaagatgttgctattaaagtgctgaaacctgagagaataaatgcggacatgcagcgggaatttgctcaggaagtatatattatgaggaaggtccgtcacaagaatgttgtgcaatttattggtgcttgcactaaacccccaaatctatgtatagtcacagaatatatgtccggtggtagtgtgtatgattacctccataaacataaaggtgttttcaaacttcctgctttagttggagttgcaatggatgtgtcaaaaggcatgagctacttacaccagaataatattattcatcgtgatttgaaaactgccaatcttctgatggacgaaaatgggactgttaaagttgctgattttggtgttgcacgtgttaaagctcaatctggagttatgactgcagaaactggtacttaccggtggatggccccagaggtcatagagcacaaaccctatgaccacaaggctgatgttttcagttttggaattttgttgtgggaactactcacggggaagattccttatgagtacttgactccactacaagcagctgttggggtggtgcagaagggtttacgtcctacaattccaaaacatacacatgcaaagctttgtgagcttcttcagaaatgctggcagcaggaccctgctcaaagaccagacttctctgaaatattagaaactctccagagaatatcagaggaggtcggagatgagcatgaggggaagcacaaggacaaattattgggaggtttcttttcagctctgagggggcggggccattgagacgctgttgaaatgtacatggttccagtccattttgaaggatctgagcaacaaccagcaccagttcctcgagctccagcgccagtacacagaaatatagacttgctgcagttgactaaagtggcaatttttagctgcagctatcgtgtaccgtctttctccttgttactcctgagtagcagcattacatggtgtaacataggagaggatatttgtgggctgtacattaacagtctgatttctctaacagagtgtaatcttgctgtagatgaaaataataagccagatccaggccgtggcatgattcttttaagatcccatcatttagtttgttttatgcgtcggtcattcttttctggacacgatccataatgtggtatggtgagtgactgaaacaatgcggcaagctctagttggaactggaaggcaactgcgtgcactctgctcggacctggtgaggtcaaaaatctttgggtcattcatcgacaatgttggacggatactcatggctagttttgcagggctcc

SEQ ID NO: 3960 - DNA, 2177 bp, Panicum virgatum
tgccgcgtctggcggcggcgcggcggggcccgcgacgtcctcctcgtcggccgccgcggcggcgcaggcgcggaagcagcagcagcagcagcgccacaagctcgaggtgtacacggaggtgctccgccgcctccacgagtccggcctgcccgaggcccgggcgcccgggttcgacgacgagctctggaaccacttcaaccgcctccccgcccgttacgccatggatgtgaacgtggagcgggcggaggacgtgctcacgcataggcggctgctggagcaggcgagggatccggcgcagcgaccggctttcgcggtgcgggccgtgcaggtatctccaattcttgatgggaatcagactgatgctgattcgaacactgcaggggaggaagttgcttcaagactgttgaacaggcagcaaagcatacaccctcctcctgctttcggttcttctacaaatcttgaggcccttgctcttgaagttagcaagtctcaaggccaggatcaggatagcacctctgataatggtcgatctctgtacaggcccatgcatgaaatcaccttttctaccattgacaggccaaagcttctcagtgagctgacatctctgcttggtgaacttggcctaaacatacaagaagcgcatgcattttcaacaaatgatggttactcactcgatgtctttgttgttgttggttggcatgatgaggaaacagaagatttagtagaagcagtgcagaaagaaattggcaggattgaagagacacaagcatggtcttcatctcattcgtggtctaccccagttgaaaatatgcaagttgctgagaattcagcagctgatcgtgttgagataccaacagatggtgctagtgaatgggaaactgatgtaaaactactcaagtttgggaataaagtagcatcaggatcatatggtgatctttaccggggtacttattgcagtcaagatgttgctattaaggtgctgaaacctgagagaataaatgcggacatgcagcgggaatttgctcaggaagtatttattatgaggaaggttcgtcacaagaatgttgtgcaatttattggtgcttgcactaaacccccaaatctatgtatagtcacagaatatatgtctggtgggagtgtgtatgattacctccataaacataaaggtgtcttcaaacttcctgctttaattggagttgcaatggatgtgtcaaaaggcatgagctacttacaccagaataatattattcatcgcgatttgaaaactgccaatcttctgatagacgaaaatgggactgttaaagttgctgattttggtgttgcacgtgtcaaagctcaatctggagttatgactgcagaaactggtacttaccggtggatggccccagaggtcatagagcacaaaccctatgaccacaaggctgatgtttttagttttggaattttgttgtgggaactgctcacaggcaagattccttatgagtacctgactccactacaagcagctgttggtgtggtgcagaagggattacggcctacaattccaaaacatacacatgcaaagctttctgagcttcttcagaaatgttggcagcaggaccctgctctaagaccagacttctctgaagtattagaaactctccagagaatagcagaggaggtcggagatgagcatgaggggaagcataaggacaaaatactgggaggtttcttttcagctctgagggggcggggccattgagacgctgttgaaatgtacatggtttcagttcattttgaaggatctgagctacaaccagcgccagttcctcgcacaccagcgcccagtacaaagaaatatagacctgctgcaggttgctaaaaagtggcaaattttagctgcagtcatcgtgtaccgcccgtctcctttttgtcccgagtagcattacgcggcgcaacatcggagagcattactgtggaatttacaatatcagtctggtttctctaacagagtgtaatctttctgtagatgaaaataataagccagatccaggccgtggcatgattcttttaagattccatcgtttagtttgtttataattatgttcccgtcattcttttccacacatgctccatatggtgtgttatggtgtctgaaataacgcggcaagctcgagttggaacttggaaggcaccaa

SEQ ID NO: 3961 - DNA, 1998 bp, Saccharum officinarum
gcgggcgcggaagcagcagcagcagcagcgccataagttcgaggtgtacaccgaggttctccggcgcctccacgacgccggcctgcccgacgcgcgggcgcccgggttcgacgacgagctctggagtcacttcaaccgcctccccgcccgctatgccatggatgtgaacgtggagagggcggaggacgtgctcacgcacaagcggcttctggagcaggccaaggatccggctcagcgcccggctttcgcggtgcgggccgtgcaggtatctccaattcttgatgggaatcagactgatgctgattcgaacactgcaggggaagaagttgcttcaagaccattgaacaggcagcaaagcatacatcctcctcctgccttcggttctacaaatcttgaggcccttgctcttgaagctagcaagtctcatcaagatcatgatagcacctctgataatggtcgatctctgtacaggcccatgcatgaaatcaccttttcaaccatagacaagccaaaacttcttagtgagctaacatctctgcttggggagcttggtctaaacattcaagaagcacatgcattttcaacaaatgatggctactcacttgatgtctttgttgttgtcggttggcatgatgaggaaacagaggatttagaagaagcggtgcagaaggagattggcaggattgaagagacacaagcatggtcttcatctcattcatggtctactccagttgaaaacatgcagattgctgagaattcagcagctgaccgtgttgagataccaacagatggtgctagtgaatgggaaattgatgtaaaactgctcaagtatgggaataaagtagcatcaggatcatatggtgatctttaccggggtacatattgcagtcaagatgttgctattaaggtgctgaaacctgagagaataaatgcagacatgcagcgagaatttgctcaggaagtatatattatgaggaaggtccgtcacaagaatgttgtgcagtttattggtgcttccactaaacccccaaatctatgtatagtcacagaatttatgtccggtggaagtgtgtatgattacctccataaacataaaggtgttttcaaacttcctgctttagttggagttgcaatggatgtgtcaaaaggcatgaactatttacaccagaataatattattcatcgcgatttgaaaactgcaaaccttctgatggatgaaaatgggactgttaaagttgctgattttggtgttgcccgtgttaaagctcaatctggagttatgactgcagaaactggtacttaccgttggatggccccagaggtcatagagcacaaaccctatgatcacaaggctgatgtttttagttttggaattttgatgtgggaactactcacagggaagattccttatgagtacctgactccactacaagcagctgttggtgtggtgcagaagggattacggcctacagttccgaaacatactcatgcaaggctttctgagcttcttcagaaatgttggcagcaggaccccgctcaaagaccagacttctccgaaatattagaaactcttcagagaatagcagaggaggtcggagacgagcacgaggggaagcacaaggacagaacactgggtggtttcttttcagctttgagggggcggagccattgagacacggttgaagacttgaaatgtacgtggcctcggtccatgcttgaaggacttgagctacaaccagcgcctgttcctcgcatgtcagcaccagtacacagaaatacagacctgctgcagctgcagttgactgaagtggcaatttttagctgcagccatcgctttccgccaatctgcttgttattattcctgagttccattacacaatgtaacatagaaaggaagcttgggaactgtacatcatcatcagtctgatttctctaacagagtgtaatcttgctgtagatgaaaataaaaagccagattcaggtcgtggcatgattcat

SEQ ID NO: 3962 - DNA, 2219 bp, Brachypodium distachyon
tccgcggccgtttccctttccatttttcctagcctcctccttctcctctcagaatcgcgcacgattacttcccttgcccgctttcctaaactcgcgagatcgagacctaatggcagtggaagaggcggcggagagctgcggcagccacgccgcggcggcggcatcgcgcggaggcgcgggttcgtcgtcgccgccggccgcgtcgggggcgcagtcgcggaagcatcagcagcagcagcgccacaagctggaggtgtacaccgaggtgctgaggcgcctccacgacgccggcatcccggaggagcagtcgccggggttcgaagacgagctctggagccacttcaaccgccttcccgcccgttacgcgatggatgtgaatgtggagagggcggaggacgtgctcacgcataagcggctcttggagcaggccaaggatccggcgcagcggccggctttcgccgtgcgggccgtgcaggtgtctccaattcttgatgggaatcagactgatgctgattcaaacactgcaggggaggaagttgcttcaaggttgttgaacaggcaacaaagcatccaccctcctcctgccttcggttcatctacaaacctcgaggctcttgctcttgaagccagcaagtctcaaggccaagatcatgatagcacctccgataatgttcgatctctctacagacccatgcatgaaatcaccttctctaccattgacaaaccaaagcttctcagtgagctgacatgtctgcttggcgaacttggactcaatattcaagaagcacatgcattttcaacaaatgatggctattcgctcgacgtttttgttgttgttggttggcacgctgaggaaacagaggatttagttgaagaagtaaagaaagaaatcagcaaaattgaggagacacaagcatggtcttcatctcattcatggtcttctccagttgacaatatgcagatcgtggagaactcagcacctgatcatgttgaaatacctacagatggtgctagtgagtgggaaattgatgtaaaactactcaactttgggaataaagtagcatccggatcatatggtgatctttaccggggtacatactgtagtcaagatgttgctattaaagtgctcaaacccgagagggtcaatgcagacatgcagcgtgaatttgcccaggaagtttatattatgagaaaggttcgtcacaagaatgttgtgcagtttattggtgcgtgcactaagcctccaaggctttgtatagttacagaatatatgtccggtggaagtgtgtatgattacctccataaacataaaggtgtcttcaagctccctgccttggttggagttgcaattgatgtgtcaaaaggcatgagctacttacaccagaataatatcattcaccgagatctgaaaaccgccaatcttcttatggatgaaaatgggatggttaaggtcgcggattttggggttgcacgcgttaaggttcaatctggagtaatgactgcagaaactgggacttaccgttggatggccccagaggtcattgaacacaagccctatgaccacaaggctgatgtttttagttttggaattttgatgtgggaactactcacggggaagattccttatgagtacctgacaccattacaagcagctgtaggtgtggttcagaagggattgcggcctacagtacctaaaaatgctcatgcaaagcttggtgagcttcttcagaagtgttggcagcaggaccccactcaaaggccagatttctctgaaatattagaaactcttcagagaatcgcagaggaggttggagatgagcacgagggaaagcacaaggataaaaccctcgggggattcttttcggctttgaggggtagaggacactaaagtggagcgaatgtacatggttgagatccatttggaagggttgagcctctgcgcaaagatcaatgcatgttcctgagcataccgagtgccagtacattgagatatgtctgctgcaatgaaccgaaatggcaattttctgctgtggtttgttacatcagccgccaccaatagattttctgtttattacttccgggtttcattacatggtgtaacatagaaagtgagtgcttgtgaattgtacattatttaatctgattcttctaacaggttgtagtccgcagatgaaataataagccaagtctagggcatgttgttattcttttcagtgccc

SEQ ID NO: 3963 - DNA, 2704 bp, Brachypodium distachyon
aagcgtctagttgcatgtaatatttcgacaacaatttagaatgggagtgaggagctagcagtagtatcttgtccaggatctgttttagcgaaattaatggtgaattgcgtatagacgaatgaaaacccaattcagcttctgccactgtacttgaattagagatccaggcacatggattacaataaccgaagaattaaatacgtagtacaacccttatcctaattcctacactaccaatagcagaaccgatgcaccgcaccaggcaaacccaaaagcgaattggccacagccaggttagccgttttattcaggctcgaaattccaaaaccaacaatccatttgactcgatttttttgtaagtatgtgagcaccgctagataaactcggacggtgctgcgcacgtatataaaagcactgtggttaccagtaagccacaaaatctctctcctccgcggccgtttccctttccatttttcctagcctcctccttctcctctcagaatcgcgcacgattacttcccttgcccgctttcctaaactcgcgagatcgagacctaatggcagtggaagaggcggcggagagctgcggcagccacgccgcggcggcggcatcgcgcggaggcgcgggttcgtcgtcgccgccggccgcgtcgggggcgcagtcgcggaagcatcagcagcagcagcgccacaagctggaggtgtacaccgaggtgctgaggcgcctccacgacgccggcatcccggaggagcagtcgccggggttcgaagacgagctctggagccacttcaaccgccttcccgcccgttacgcgatggatgtgaatgtggagagggcggaggacgtgctcacgcataagcggctcttggagcaggccaaggatccggcgcagcggccggctttcgccgtgcgggccgtgcaggtgtctccaattcttgatgggaatcagactgatgctgattcaaacactgcaggggaggaagttgcttcaaggttgttgaacaggcaacaaagcatccaccctcctcctgccttcggttcatctacaaacctcgaggctcttgctcttgaagccagcaagtctcaaggccaagatcatgatagcacctccgataatgttcgatctctctacagacccatgcatgaaatcaccttctctaccattgacaaaccaaagcttctcagtgagctgacatgtctgcttggcgaacttggactcaatattcaagaagcacatgcattttcaacaaatgatggctattcgctcgacgtttttgttgttgttggttggcacgctgaggaaacagaggatttagttgaagaagtaaagaaagaaatcagcaaaattgaggagacacaagcatggtcttcatctcattcatggtcttctccagttgacaatatgcagatcgtggagaactcagcacctgatcatgttgaaatacctacagatggtgctagtgagtgggaaattgatgtaaaactactcaactttgggaataaagtagcatccggatcatatggtgatctttaccggggtacatactgtagtcaagatgttgctattaaagtgctcaaacccgagagggtcaatgcagacatgcagcgtgaatttgcccaggaagtttatattatgagaaaggttcgtcacaagaatgttgtgcagtttattggtgcgtgcactaagcctccaaggctttgtatagttacagaatatatgtccggtggaagtgtgtatgattacctccataaacataaaggtgtcttcaagctccctgccttggttggagttgcaattgatgtgtcaaaaggcatgagctacttacaccagaataatatcattcaccgagatctgaaaaccgccaatcttcttatggatgaaaatgggatggttaaggtcgcggattttggggttgcacgcgttaaggttcaatctggagtaatgactgcagaaactgggacttaccgttggatggccccagaggtcattgaacacaagccctatgaccacaaggctgatgtttttagttttggaattttgatgtgggaactactcacggggaagattccttatgagtacctgacaccattacaagcagctgtaggtgtggttcagaagggattgcggcctacagtacctaaaaatgctcatgcaaagcttggtgagcttcttcagaagtgttggcagcaggaccccactcaaaggccagatttctctgaaatattagaaactcttcagagaatcgcagaggaggttggagatgagcacgagggaaagcacaaggataaaaccctcgggggattcttttcggctttgaggggtagaggacactaaagtggagcgaatgtacatggttgagatccatttggaagggttgagcctctgcgcaaagatcaatgcatgttcctgagcataccgagtgccagtacattgagatatgtctgctgcaatgaaccgaaatggcaattttctgctgtggtttgttacatcagccgccaccaatagattttctgtttattacttccgggtttcattacatggtgtaacatagaaagtgagtgcttgtgaattgtacattatttaatctgattcttctaacaggttgtagtccgcagatgaaataataagccaagtctagggcatgttgttattcttttcagtgcccatcattttgttgtgattatctttctacatgctgctca

SEQ ID NO: 3964 - DNA, 2515 bp, Oryza sativa
aaaaaggagagaaaattcaggcgaggtggctgctataaaaacacatgagcaaccagtctatctctctctctcctccaccacagccgctgcttgcttttccgatttatttttttttcttctcctgagaaaaaaaaatatcgcgcacgataatattttctcgccctcttcgcccgcttgcctttcctaattctgcgagatcgaagacctagagggcggcgctaatggcggtggaggaggcggcggagagctgcggaagccacgcggcggcgtcggccgctggtcgtcgtggtggtggaggcggcggcggtggaggggccacgtcgtcgtcttcgtctgcgtcggccggggcggcggcggcggcggcggcgcggaagcagcagcagcagcagcgccacaagctggaggtgtacactgaggtgctccgccgactccacgacagcggcgtccccgaggcccggcgcgagggcttcgacgacgagctctggaaccacttcaaccgccttcccgcacgttacgccatggatgtgaacgtggagagggcggaggacgtgctgacgcataagcggctcttggagcaggcgaaggatccggcgcagcggccggctttcgccgtgcgggccgtgcaggtgtctccaattcttgatgggaatcagactgatgctgattcaaacactgcaggggaggaggttgcttcaaggctgttgaacagacaacagagcattcaccctcctcctgcctttggttcatctacaaatcttgaggcccttgctcttgaggctagcaagtcccaaggacaagaccatgatagcacctcagataatgtcaattacagacccatgcatgaaatcaccttctccaccattgacaaaccaaagcttcttagcgagctcacatcgctgcttggcgaacttggtctaaacattcaagaagcacatgcgttttcaacaaatgatggctactcactcgatgtctttgttgttgttggttggcatgatgaggaaactgaggatttaatagaatcagtacggaaagaaattggcaagattgatgagacgcagggatggtctacaactcattcatggtcttctccagttgaaaatatgcagattggggagaattcagcagctgaccatgttgaaatacctagggatggtgccagtgaatgggagattgatgtaaagctactcaagtttgggaataaagtagcatccggatcatatggtgatctttatcggggtacatattgcagccaagatgttgctatcaaagtgctcaaacctgagaggataaatgcggacatgcagcgtgaatttgcccaggaagtatatattatgaggaaggttcgccacaagaatgttgtacaatttattggtgcatgcactaaaccccccaatctatgtatagtcacagaatatatgtcaggtgggagtgtttatgattacctgcataaacataaaggtgtattcaagctccctgctttacttggagttgtgatggatgtttcaaaaggcatgagctacttgcaccaaaacaatattattcatcgagatttgaaaactgctaatctccttatggatgaaaatgggacagttaaggttgctgattttggtgttgcacgtgttaaagctcaatctggagtaatgactgctgaaacagggacatatcgttggatggctccagaggttatagaacacaagccctatgatcacaaggccgatgtttttagttttggaattttgatgtgggagctgctcacagggaagattccttatgagtacctgacaccattacaagcagctgtaggtgtggttcagaagggattacggcctacaataccaaaaaatgctcatgcaaaactttctgagcttcttcagaaatgttggcaacaggagcctgctgaaagaccagatttctctgaaatattagaaactcttcagagaatagcagaggaggttggtgatgagcatgatggaaagcacaaggagaaaatactgggcggactattttcagctttgagggggcgtgggcactaaatggtgtgggaatacatgttttcattccatatggaagggcctgagaaaaagatcagcgtcagttccttggcaggtgcagcgccacattgagattagactgctgcagtcgacttaatgagcaattttcagatgcaagtccatcaaggtgttaactgttgtcatactatttttttggtgtacaacttccgggttccattacagctgtaacataggaagagttgttgtgaagtgtacattattgacctgattcttctactgacgagttgtaacttgtagttgaataagaagccagatttagggcgtgcattattctcccagatcctgtggtttagctatgcttatctatctactacctactgcttactttttgtcctgaattctttttcgacaatataatgttctgtgccgtcctgtttcttatgtctatgtcaggttctaaataattttgtgttcaagaaggatgtctcaacacaatgatgccc

SEQ ID NO: 3965 - DNA, 2284 bp, Oryza sativa
ctctctcctccaccacagccgctgcttgcttttccgatttatttttttttcttctcctgagaaaaaaaaatatcgcgcacgataatattttctcgccctcttcgcccgcttgcctttcctaattctgcgagatcgaagacctagagggcggcgctaatggcggtggaggaggcggcggagagctgcggaagccacgcggcggcgtcggccgctggtcgtcgtggtggtggaggcggcggcggtggaggggccacgtcgtcgtcttcgtctgcgtcggccggggcggcggcggcggcggcggcgcggaagcagcagcagcagcagcgccacaagctggaggtgtacactgaggtgctccgccgactccacgacagcggcgtccccgaggcccggcgcgagggcttcgacgacgagctctggaaccacttcaaccgccttcccgcacgttacgccatggatgtgaacgtggagagggcggaggacgtgctgacgcataagcggctcttggagcaggcgaaggatccggcgcagcggccggctttcgccgtgcgggccgtgcaggtgtctccaattcttgatgggaatcagactgatgctgattcaaacactgcaggggaggaggttgcttcaaggctgttgaacagacaacagagcattcaccctcctcctgcctttggttcatctacaaatcttgaggcccttgctcttgaggctagcaagtcccaaggacaagaccatgatagcacctcagataatgtcaattacagacccatgcatgaaatcaccttctccaccattgacaaaccaaagcttcttagcgagctcacatcgctgcttggcgaacttggtctaaacattcaagaagcacatgcgttttcaacaaatgatggctactcactcgatgtctttgttgttgttggttggcatgatgaggaaactgaggatttaatagaatcagtacggaaagaaattggcaagattgatgagacgcagggatggtctacaactcattcatggtcttctccagttgaaaatatgcagattggggagaattcagcagctgaccatgttgaaatacctagggatggtgccagtgaatgggagattgatgtaaagctactcaagtttgggaataaagtagcatccggatcatatggtgatctttatcggggtacatattgcagccaagatgttgctatcaaagtgctcaaacctgagaggataaatgcggacatgcagcgtgaatttgcccaggaagtatatattatgaggaaggttcgccacaagaatgttgtacaatttattggtgcatgcactaaaccccccaatctatgtatagtcacagaatatatgtcaggtgggagtgtttatgattacctgcataaacataaaggtgtattcaagctccctgctttacttggagttgtgatggatgtttcaaaaggcatgagctacttgcaccaaaacaatattattcatcgagatttgaaaactgctaatctccttatggatgaaaatgggacagttaaggttgctgattttggtgttgcacgtgttaaagctcaatctggagtaatgactgctgaaacagggacatatcgttggatggctccagaggttatagaacacaagccctatgatcacaaggccgatgtttttagttttggaattttgatgtgggagctgctcacagggaagattccttatgagtacctgacaccattacaagcagctgtaggtgtggttcagaagggattacggcctacaataccaaaaaatgctcatgcaaaactttctgagcttcttcagaaatgttggcaacaggagcctgctgaaagaccagatttctctgaaatattagaaactcttcagagaatagcagaggaggttggtgatgagcatgatggaaagcacaaggagaaaatactgggcggactattttcagctttgagggggcgtgggcactaaatggtgtgggaatacatgttttcattccatatggaagggcctgagaaaaagatcagcgtcagttccttggcaggtgcagcgccacattgagattagactgctgcagtcgacttaatgagcaattttcagatgcaagtccatcaaggtgttaactgttgtcatactatttttttggtgtacaacttccgggttccattacagctgtaacataggaagagttgttgtgaagtgtacattattgacctgattcttctactgacgagttgtaacttgtagttgaataagaagccagatttagggcgtgcattattctccc

SEQ ID NO: 3966 - DNA, 2249 bp, Hordeum vulgare
ccctctccctctttccattttcctccccccttttctccctctctctcccgagggcggcatcgatcgcgcacgatttacctccctccttccggaatccgcgaccgagatcggggcggtaatggcggtggaggaggtggccgagagctgcggcagccacgcggcggcggcgggcggaggcggcggcggaggcggggcggggtcctcgtccccgccgggcgccgcggggtcggggtcggtggcgggggcgcagtcgaggaagcagcagcagcagcaccaccacaagctggaggtctacaccgaggtgctggcacgcctccacgccgccgaggagcgcgcccccggcttcgacgacgagctctggagccacttcaaccgcctccccgcacgctacgccatggacgtgaacgtggagagggcggaggacgtgctcacgcacaagcgcctcctcgagctggccagggatcccgcgcagcgcccggccttcgccgtgcgggccgtgcaggtatctccaattcttgatgggaatcagactgatgctgattcacacactgcaggggaggaagttgcttcaaggctgttgaataggcaacaaagcattcaccctcctcctgcctttggttcatctacaaaccttgacgcccttgctcttgaagccagcaagtcgcaaggccaagatcaggatagcacatcggataatgttcgatctctctacagacccatgcatgaaatcaccttctctaccattgacaaaccaaagcttctcagcgagctgacatgtctgcttggtgaaattggtctcaacattcaagaagcacatgcgttttcgacaaatgatggctactcactcgacgtatttgttgttgttggttggcatgccgaggaaacagtggatttaatagaagaattaaaaaaagaaatcatcaagattgaggagacacaagcatggtctacatctcattcatggtcttctccagttgaaaatatgcagatcgtggagaactcaacagccgatcatgttgctatacctacagatggtgctagtgaatgggaaattgatataaaactactcaatttcggcaataaagtagcatctggatcatatggtgatctcttccggggtacatattgtagtcaagatgtagctattaaagttctcaaacctgagagggtaaatgtggacatgcagcgtgaatttgcccaggaagtttatattatgaggaaggttcgtcacaagaatgttgtgcaatttattggtgcatgcactaaaccccccaggctatgcatagtcacagaatttatgtccggtgggagtgtgtatgattatctccataaacataaaggtatcttcaagctgccggccttagttggagttgcaatggatgtgtcaaaaggcatgagctacttgcaccaaaacaatattattcatcgggatttgaaaaccgccaatcttcttatggatgaaaacgggatggttaaggttgctgattttggcgttgcacgtgttaaagttcagtctggagtaatgactgcagaaacagggacataccgttggatggccccagaggttatagaacacaagccctatgaccacaaagccgatgtttttagttttggaattttgttgtgggaactgctcactgggaagattccttatgagtacctgacaccattacaagcagctgtaggtgtggttcagaaggggttgcggcctacaataccaaaaaatgcgcatgcaaagctcacggagcttcttcagaagtgttggcagcaggaccctgctgaaaggccagatttctccgaaatattagaagctcttaagaaaatagcagaggaggttggagatgagcacgacggaaagcacaaggacaaaagcctgggtggattcttttcgtctctgagggggcgaggacactaaggtggcacaggtgtacatgatttgcaatccatttgaacgggccgtgaacgaagatcagcgcctgtttgtcagcatacccagtgccagtacattgagatggatgcctgctgcagtgaacttgtccggatggcaacttttcagttgtagttccactcatcggctacagccaatagttcttttttgtctggttatttacttccgggttctattacatgtaacatagggagagagtgctcgtggactgtgtacattatttaatctgattcctctaactggctgtaacttgcacatgaaataagaagcctagcttagggcgtgctgtattctttcactt

SEQ ID NO: 3967 - DNA, 2235 bp, Secale cereale
tcagtctccctcgcccgggggatcgatcgcgcgcgatttacctcccctccctccctgatttcgcgagcggccgagatcgcggcgaggccggcccggcggtaatggcggtggaggaggtggccgagagctgcggcagccacgccgccgcggcgggcggcggcggcggaggaggcggcgggggcgggggcgggaaggcggggtcctcgtcgccgccgggaggggcgggggcgcagtcgaggaagcagcagcagcagcaccaccacaagctggaggtctacaccgaggtgctggcgcgcctccacgccgccgaggagcgcgcccccggcttcgacgacgagctctggagccacttcaaccgcctccccgcacgctacgccatggatgtgaacgtggagagggcggaggacgtgctcacgcacaagcgcctcctcgagctggccaaggatccggcgcagcgccccgccttcgccgtccgggccgtgcaggggaggaagttgcgtcaaggctgttgaacaggcaacaaagtatgcaccctcctcctgcctttggttcatctacaaaccttgaggcccttgcgcttgaagctagtaagtcgcaaggccaagatcaggatagcacctcagataatgttcgatctctctacagacccatgcatgaaatcaccttctctaccattgacaaaccaaagcttctcagcgagctgacatgtctgcttggtgaaattggtctcaacattcaagaagcacatgcgttttcgacaaatgatggctactcactcgatgtgtttgttgttgttggttggcatgctgaggaaacagaggatttaatagaagaattaaaaaaagaaatcagcaagattgaggagacacaagcatggtctacatctcattcatggtcttctccagttgaaaatatgcagatcgtggagaactcaacagccgatcatgttgctattcctacagatggtgccagtgaatgggaaattgatataaaattactcaatttcgggaataaagtagcatccggatcatatggtgatctcttccggggcacatattgtagtcaagatgtagctattaaagtgctcaaacctgagagggtaaatgtggacatgcagcgtgaatttgcgcaggaagtttatattatgaggaaggttcgtcacaagaatgttgtgcaatttattggtgcatgcactaaacccccaaggctatgcatagtcacagaatttatgtccggtgggagtgtatatgattatctccataaacataaaggcatcttcaagctcccggccttagttggagttgcaatggatgtgtcaaaaggcatgagctacttgcaccaaaataatattattcatcgggatttgaaaaccgccaatcttcttatggatgaaaacgggatggttaaggttgctgattttggcgttgcacgtgttaaagttcagtctggagtaatgactgcagaaaccgggacataccgttggatggccccagaggttatagaacacaagccctatgaccacaaggccgatgtttttagttttggaattttgttgtgggaactgctcactgggaagattccttacgagtacctgacaccattacaagcagctgtaggtgtggttcagaagggactgcggcctacaataccaaaaaatgctcatggaaagctcacggagctccttcagaagtgttggcagcaggaccctgctgaaaggccagatttctctgaaatattagaagctcttaagaaaatagcagaggaggttggagatgagcacgacggaaagcacaaggacaaaagcctggggggattcttttcgtctctgagggggcgaggacactaaggtggcgcagatgtacatggtttgcaatccatttggacgggcctgagcgaagatcaacgcctgtttctcagcataccacagtgccagtacattgagatggatgcctgctgcagtgaactgggccggatggcaacttttcagttatagttccactcatcgcctacagccaatagtttctttttggggtctggttatttacttccgggttctatttacatgtaacatagggagagagtgcttgtggactgtacattatttaatctgatttcctctaacaggctgtaacttgcacatgaaataataagcctagcttagggcgtgctgtgattctttcacttgcgaattatctctttacatcctgccggcagcttgaatgttcttgcatggct

SEQ ID NO: 3968 - DNA, 2256 bp, Secale cereale
gggatcgatcgcgcgcgatttagttcccctcccttcctgatttcgcgagcggccgagatcgcggcgaggccgggccggcggtaatggcggtggaggaggtggccgagagctgcggcagccacgcggccgcggcgggcggcggcggcggaggaggcggcggcgggggcgggggcgggaaggcggggtcctcgtcgccgccgggaggggcggggcgcagtcgaggaagcagcagcagcagcaccaccacaagctggaggtctacaccgaggtgctggcgcgcctccacgccgccgaggagcgcgcccccggcttcgacgacgagctctggagccacttcaaccgcctccccgcacgctacgccatggatgtgaacgtggagagggcggaggacgtgctcacgcacaagcgcctcctcgagctggccaaggatccggcgcagcgccccgccttcgccgtccgggccgtgcaggggaggaagttgcgtcaaggctgttgaacaggcaacaaagcatgcaccctcctcctgcctttggttcatctacaaaccttgaggcccttgcgcttgaagctagtaagtcgcaaggccaagatcaggatagcacctcagataatgttcgatctctctacagacccatgcatgaaatcaccttctctaccattgacaaaccaaagcttctcagcgagctgacatgtctgcttggtgaaattggtctcaacattcaagaagcacatgcgttttcgacaaatgatggctactcactcgatgtgtttgttgttgttggttggcatgctgaggaaacagaggatttaatagaagaattaaaaaagaaatcagcaagattgaggagacacaagcatggtctacatctcattcatggtcttctccagttgaaaatatgcagatcgtggagaactcaacagccgatcatgttgctattcctacagatggtgccagtgaatgggaaattgatataaaactactcaatttcgggaataaagtagcatccggatcatatggtgatctcttccggggcacatattgtagtcaagatgtagctattaaagtgctcaaacctgagagggtaaatgtggacatgcagcgtgaatttgcgcaggaagtttatattatgaggaaggttcgtcacaagaatgttgtgcaatttattggtgcatgcactaaacccccaaggctatgcatagtcacagaatttatgtccggtgggagtgtatatgattatctccataaacataaaggcatcttcaagctcccggccttagttggagttgcaatggatgtgtcaaaaggcatgagctacttgcaccaaaataatattattcatcgggatttgaaaaccgccaatcttcttatggatgaaaacgggatggttaaggttgctgattttggcgttgcacgtgttaaagttcagtctggagtaatgactgcagaaaccgggacataccgttggatggccccagaggttatagaacacaagccctatgaccacaaggccgatgtttttagttttggaattctgttgtgggaactgctcactgggaagattccttacgagtacctgacaccattacaagcagctgtaggtgtggttcagaagggactgcggcctacaataccaaaaaatgctcatggaaagctcacggagctccttcagaagtgttggcagcaggaccctgctgaaaggccagatttctccgaaatattagaagctcttaagaaaatagcagaggaggttggagatgagcacgacggaaagcacaaggacaaaagcctggggggattcttttcgtctctgagggggcgagggcactaaggtggcgcagatgtacatggtttgcaatccatttggacgggcctgagcgaagatcagcgcctgtttgtcagcatacccagtgccagtacattgagatggatgcctgctgcagtgaactgggccggatggcaacttttcagttatagttccactcatcgcctacagccaatagtttctttttggggtctggttatttacttccgggttctattacatgtaacatagggagagagtgcttgtggactgtacattatttaatctgatttcctctaacaggctgtaacttgcacatgaaataataagcctagcttagggcgtgctgtgattctttcacttgcgaattgtctactttaaaaaaagaaaaaaaaaaaaaaaaaaaaaacaaaaaaaaaagtctactgcgttagaataccaactgcttacttga

SEQ ID NO: 3969 - DNA, 1968 bp, Triticum aestivum
tacaccgaggtgctggccgggcctccacccgcgccgaggagcgcgcccccggcttggacgacgaccctctggagccacttcaaccgcctccccgcgcgctacgcgatggatgtgaacgtggagagggcggaggacgtgctcacgcacaagcgcctcctcgagctggccaaggatccggcgcagcgcccggccttcgccgtgcgggccgtgcaggtatctccaattgttgatgggaatcagactgatgctgattcacacactgcaggggaggaagttgcttcaaggctgttgaataggcaacaaagcatccaccctcctcctgcttttggttcatctacaaaccttgaggcccttgcgcttgaagctagtaagtcgcaaggccaagatcaggatagcacctcagataatgttcgatctctctacagacccatgcatgaaatcacgttctctaccattgacaaaccaaagcttctcagcgagctgacatgtctgcttggtgaaattggtctcaacattcaagaagcacatgcattttcgacaaatgatggctactcacttgacgtgtttgttgttgttggttggcatgctgaggaaacggaggatttgatagaagaattaaaaaaagaaatcagcaagattgaggagacacaagcatggtctacatctcattcatggtcttctccagttgaaaatatgcagatcgtggagaactcaacagccgatcatgttgctatacctacagatggtgccagtgaatgggaaattgatataaaactactcaatttcgggaataaagtagcatccgggtcatatggcgatctttaccggggtacatattgtagtcaagatgtagctattaaagtgctcaaacctgagagggtaaatgtggacatgcagcgtgaatttgcccaggaagtttatattatgaggaaggttcgtcacaagaatgttgtgcagttcattggtgcatgcactaaacccccaaggttatgcatagtcacagaatttatgtccggtgggagtgtgtatgattatcttcataagcataaaggtatcttcaagctccctgccttagttggagttgcaatggatgtgtcaaaaggcatgagctacttacaccaaaataatattattcatcgggatctgaaaaccgccaatcttcttatggatgaaaacgggatggttaaggttgctgattttggtgttgcacgtgttaaagttcagtctggagtaatgactgcagaaaccgggacataccgttggatggccccggaggttatagaacacaagccctacgaccacaaggctgatgtttttagttttggaattttgttgtgggaactgctcactgggaagattccttacgagtacctgacaccattacaagcagctgtaggtgtggttcagaagggattgcggcccacaataccaaaaaatgctcatgcaaagcttgcggagctccttcagaagtgctggcagcaggaccctgctgaaaggccagatttctccgagatattagaagctctcaagaaaatagcagaggaggttggagatgagcacgacggaaagcacaaggacaaaagcctggggggattcttttcgtctctgagggggcgaggacactaaggtggcgcaggtgtacatggtttgcaatccatttggacgggcctgagcgaagatcagcgcctgtttgtcagcatacccagtgccagtacattgagatggatgcctgctgcatcagtgaactgggccggatggcaacttttcagttgtagttcccactcatcggctgcagccaatagtttttttttgtctggttatttacttccgggttctattacatgtaacatagggagagagtgcttgtggactgtacattatttaatctgattcctctaacaggctgtaacttgcacatgaaataataagcctagcttagggcgtgctgtgattctttcaaaaaaaaaa

SEQ ID NO: 3970 - DNA, 3809 bp, Oryza sativa
aactgccttagttattggtaaaatctgctataagacatccaaagtttacggtttttgccgctgaaggatatcgacatatcgtctgcctccattggttaatgatcagagttaatccacaaccatccactaatgttgcgggtgtccagcgatcaattgcccctttttagcccctccaaagaaaacatccttacggtgttctctaccaaaaagcacacaaattgcgtgtatcctatagaaattttttgcctaattcatacgtaaaaggaggccttgactttgaaattggtaggggagcaaggccgatctgggctgggttccattgggccgaatgcatcgaggacccacctgtcagacgggtccatgtaagagtctccaagaccaggtgcacgcagccacgcagcggagcaccaccagatctcccttggaccggttccatcgtctccgccgtggaccagcgccaaccctcgccaccgcacgtcgccgggctccggcgaggccgccggagtgtcgtcgggaagcggagggcctcctccgtgccgcgcctccctccgcccctcaccccttcctcctcatggctaggtcctgacctgaggtggggctccgcggctactgctccccgcctcgccccgcccccgcccccgccccctgcctctccgccgcggcgccactccgggctccggcacctccctctccgtgcgctcctgcgggaagttgtgtggagctatctctgatgctgtttatgcaaagacttatgctcacttcttgattagaaatggacagtagccgagattctgaagaagaaaggcctcaaaggaaggacaatggcgaagaaactgaaaatggggaagatggtggaaatgctttgagcctcaaggatgttgccaatgagcttcttggttgtgttgtccatagtgaggaagaggcatacaaactgtattgtgactatggacatagaattggttttagtgtccgcaagggtaaacagtcttacttcattggcacgaagaatattcgtacaaaagattactactgctcaaaagaagggcttaagtacgatgagccagttacagaagcaaattttaatcgaccagacacaagaactaattgcaaagcaatgatccgctttagagttgatgagaaaggacgctggacagtcatacgctttgtcccaacgcataatcaccagttggctaaacctggggaaagacacatgttgagatctgcgaagtcgcttgctgttggaaaatcaggtgtcatagatccacaagcatctacggaatcacatccaataaatggtttctctcatatgataggaagtgatattgtggagcctcctgggtatactataagggattgctacaatcatgtgagcatgcagggtataacgataatcgaggcaggagacagccaaagtcttgtgaactatttcaagcgtagaaccaatgaggaaggtatgttctattgggatgttcaagttgatcaagaaggtcgtatgaccaactttttcttcagggatgccaaaagtagaaatgattttgactgctttggagatgctgttatatttgacacaaccttccgcacaaataaatacagcctggtatgtgctccttttgttggagttaaccaccattggcagaatattgtttttggatgtgcattcttgttagatgagtcctcagcttcctatgtttggttatttaaatcattcctcgagtcaatgggtggccggtctccaaaatcaattttcactgatcaggatgacgctattacgcaggcagttgagctggtttttcctaacacgcagcactgtttttcctattggcatattctgaaaaatgcacagtctcatttaggcacggtaaatacctctcaaacatttcaaaatatgtttattaagtgcatgcaaggacctaactcagaaacggagcttgaggaatcatgggccacaatgttaaatgaatataagttacaggagaatagctggcttagcgacctttataggtcccgcaataaatggtgctcagcatttaataaagatactttcgatggtgggatcaattcatctcagtggggggaggtctcaaacaatacatttactggaatatctgatgaatctacccctcttacacgatttgcccttttactagaaaaggttttcaagggtctacgtagaaatgaatctgaagaggattttcgctgtagccaaactgctccagttcgtgcaattaaacacagtacagttctgaagcaggccgcagaatcctacacgcataagatatacaaattatttgaggcagaatttctggatgggtgcggagcaacttcatgccatgaaagttcttgtggtgggaacttgttgaggtttgaaattactatgcaggggaggggatcaaaagtgtggaccgttcttcttgatacctccacgatggaaatctcttgtggttgcagaaagtttgaaaggatgggtcttctttgttcacatgctctgaaagccttcagcctgcaaaatgtggacacaattcctgagaagtacatttcgaaacgatggacaaaagatgccaggagaagcatgtataagcttagtcaagatgattcaacacaacaggaatgcactgaggctgaacttgcatatcgcaaccgggcaacgcagtatgcatgtagccttatagcgaagagccaggaactggatgaatcaagaaagatattctgggacacccttgaaacaggagaaaaagcacttgatgtattctttgaaattagaagtttgcgtagtcaagctgcaaaagatgtcagtaaaagggacaaaaagaagaaaaaatcatctaaaggaccaagcacaaaaaaagcaaaaccaaccccagcaacttcctctgctgtacctgaacttcttgcccaaactaatgtgcaccagtttcaatctgcacaagatgctcagggtaacacgacaattggtagaccgttgtactatcaggctttttcatctgccccaattcaaccaaaccagatctacatgcatccgaacatgcacacaatgcctctttgtgcaccacaggatttctcggcatattctgcaatgcgtcccaattcgaattttggtggtgcaaagaatgtctgaaggacagtaaggaatctgctaagacgtcttttggaaaatgctgcttggacatggatgcagccaaccacctggatggattttgtcaaccttcccggaggtgtgatgttgcttttggatgttaatttctggctcgcaactgttgatgtgtgtaactattctggtctttgacgtttctgttctgttgaagtggagttctagtaatgtcaattaggtgactgtaggcttgtaagttataattggagtgtagatgctggatgaatagaggccaggaacatgttgcttccattgtcttaaggaaaaggttgtaactgggagtagtcactagctatttacaggatcagattctttgggctaaaagatgatcagctggcgcccttgttgcctcttggcccatggtgctactagttgtcaagagcagatagcatcccttctcgaaggagttgagctgcagaacaatgtgaaaaggaagctgaaatggaagctcatgcagattcagtgaagtgcaccgtctctgcatgggaggcagtagttccaaactgaccttgttatatgtttttttttgtgaagattttggatctaatttagtgtacctgtacaatctgactgctgattaagatgacacagcagtattgatctgatattgaaactgtctatgctcttcgattgttcatacttttacaattttctttaacga

SEQ ID NO: 3971 - DNA, 3404 bp, Oryza sativa
cggagcaccaccagatctcccttggaccggttccatcgtctccgccgtggaccagcgccaaccctcgccaccgcacgtcgccgggctccggcgaggccgccggagtgtcgtcgggaagcggagggcctcctccgtgccgcgcctccctccgcccctcaccccttcctcctcatggctaggtcctgacctgaggtggggctccgcggctactgctccccgcctcgccccgcccccgcccccgccccctgcctctccgccgcggcgccactccgggctccggcacctccctctccgtgcgctcctgcgggaagttgtgtggagctatctctgatgctgtttatgcaaagacttatgctcacttcttgattagaaatggacagtagccgagattctgaagaagaaaggcctcaaaggaaggacaatggcgaagaaactgaaaatggggaagatggtggaaatgctttgagcctcaaggatgttgccaatgagcttcttggttgtgttgtccatagtgaggaagaggcatacaaactgtattgtgactatggacatagaattggttttagtgtccgcaagggtaaacagtcttacttcattggcacgaagaatattcgtacaaaagattactactgctcaaaagaagggcttaagtacgatgagccagttacagaagcaaattttaatcgaccagacacaagaactaattgcaaagcaatgatccgctttagagttgatgagaaaggacgctggacagtcatacgctttgtcccaacgcataatcaccagttggctaaacctggggaaagacacatgttgagatctgcgaagtcgcttgctgttggaaaatcaggtgtcatagatccacaagcatctacggaatcacatccaataaatggtttctctcatatgataggaagtgatattgtggagcctcctgggtatactataagggattgctacaatcatgtgagcatgcagggtataacgataatcgaggcaggagacagccaaagtcttgtgaactatttcaagcgtagaaccaatgaggaaggtatgttctattgggatgttcaagttgatcaagaaggtcgtatgaccaactttttcttcagggatgccaaaagtagaaatgattttgactgctttggagatgctgttatatttgacacaaccttccgcacaaataaatacagcctggtatgtgctccttttgttggagttaaccaccattggcagaatattgtttttggatgtgcattcttgttagatgagtcctcagcttcctatgtttggttatttaaatcattcctcgagtcaatgggtggccggtctccaaaatcaattttcactgatcaggatgacgctattacgcaggcagttgagctggtttttcctaacacgcagcactgtttttcctattggcatattctgaaaaatgcacagtctcatttaggcacggtaaatacctctcaaacatttcaaaatatgtttattaagtgcatgcaaggacctaactcagaaacggagcttgaggaatcatgggccacaatgttaaatgaatataagttacaggagaatagctggcttagcgacctttataggtcccgcaataaatggtgctcagcatttaataaagatactttcgatggtgggatcaattcatctcagtggggggaggtctcaaacaatacatttactggaatatctgatgaatctacccctcttacacgatttgcccttttactagaaaaggttttcaagggtctacgtagaaatgaatctgaagaggattttcgctgtagccaaactgctccagttcgtgcaattaaacacagtacagttctgaagcaggccgcagaatcctacacgcataagatatacaaattatttgaggcagaatttctggatgggtgcggagcaacttcatgccatgaaagttcttgtggtgggaacttgttgaggtttgaaattactatgcaggggaggggatcaaaagtgtggaccgttcttcttgatacctccacgatggaaatctcttgtggttgcagaaagtttgaaaggatgggtcttctttgttcacatgctctgaaagccttcagcctgcaaaatgtggacacaattcctgagaagtacatttcgaaacgatggacaaaagatgccaggagaagcatgtataagcttagtcaagatgattcaacacaacaggaatgcactgaggctgaacttgcatatcgcaaccgggcaacgcagtatgcatgtagccttatagcgaagagccaggaactggatgaatcaagaaagatattctgggacacccttgaaacaggagaaaaagcacttgatgtattctttgaaattagaagtttgcgtagtcaagctgcaaaagatgtcagtaaaagggacaaaaagaagaaaaaatcatctaaaggaccaagcacaaaaaaagcaaaaccaaccccagcaacttcctctgctgtacctgaacttcttgcccaaactaatgtgcaccagtttcaatctgcacaagatgctcagggtaacacgacaattggtagaccgttgtactatcaggctttttcatctgccccaattcaaccaaaccagatctacatgcatccgaacatgcacacaatgcctctttgtgcaccacaggatttctcggcatattctgcaatgcgtcccaattcgaattttggtggtgcaaagaatgtctgaaggacagtaaggaatctgctaagacgtcttttggaaaatgctgcttggacatggatgcagccaaccacctggatggattttgtcaaccttcccggaggtgtgatgttgcttttggatgttaatttctggctcgcaactgttgatgtgtgtaactattctggtctttgacgtttctgttctgttgaagtggagttctagtaatgtcaattaggtgactgtaggcttgtaagttataattggagtgtagatgctggatgaatagaggccaggaacatgttgcttccattgtcttaaggaaaaggttgtaactgggagtagtcactagctatttacaggatcagattctttgggctaaaagatgatcagctggcgcccttgttgcctcttggcccatggtgctactagttgtcaagagcagatagcatcccttctcgaaggagttgagctgcagaacaatgtgaaaaggaagctgaaatggaagctcatgcagattcagtgaagtgcaccgtctctgcatgggaggcagtagttccaaactgaccttgttatatgtttttttttgtgaagattttggatctaatttagtgtacctgtacaatctgactgctgattaagatgacacagcagtattgatctgatattgaaactgtctatgctcttcgattgttcatacttttacaattttcttt

SEQ ID NO: 3972 - DNA, 1675 bp, Zea mays
gagaatccgacgagtaccacgcagcaccgcgtgatacataaatacgggcacggcaaaccccaaaactcagcaagccgcccagcacgaccgccagccatcaccggccagtgagacggtacagcaaatttcccccgtcgcgcccggtcattacgacggcgccggccgagcagacgccgccgccacgatgccgcccgccaccggcgccgtcgccgacactgcccccgccgcggggaccgtgctcctcggcaggtacgagctcggcggcctcctgggccgcggcgcctccgccaaggtgtacctggcgcgggacctgctcaccggccgctccgtggccatcaagtcgttccccaacccacgcgccggcggcggcgccggcgttggcgtcaacgccgccatcgagcgggaggcgtgcatcctccggcgcctgcggcaccgccacgtggtgcggctccacgagatcctggcgacgcgcaagaaggtccacttcgtgctggacctcgccggcggcggcgagctgttctcgctggtggacgcgtcggggcgcatgacggaggacctggcgcggcactacttccggcagctggtgtccgccgtgcgctactgccacgcgcgcggcgtgtaccaccgcgacatcaagcccgagaacctgctgctggacgagggcggcgcgctgaaggtggccgacttcgggctgggcgccgtgggcggcggcggaggaggaggaggaggagaaggcctccggcacacgatgtgcggcaccccggcgtacgtggcccccgagatcctgtcgcgcaaggggtacgagcccgggaaggtggacatctggtcctgcggcgtggtgctgttcgtgctggcggccgggtacctccccttcaacgacgccagcctggtgaacatgtaccgcaagatctacgcgggcaggttccggtgccccgggtggttctcgccggcgctgcgcgacctgctgcggcgcgtgctggacccggacccgtcggcgcgcattgacgcggacggcatcgtggcgcacccgtggttccgccacggcggcgaggaggaccttggcggcctggtgcacggcgggtacgaggaggtagaggaggaggaggaggaggccaaggcggacgaggacagggagccgaccgcgttcgacatcctcagcttctccccgggctcggacctgtcggcgctgttcgtgggcgcggggggaggcggcaaggagcgcgtgttcgtgggcgagcctgccgcggccgtgctgggccgcgtggaggcggccgcgcggaagggcgggtaccgcgcgcggagggacgggaagagggcgacggtgtacgtggaggaggaggaggaggagggcggcggcggcgtcctggcaaaagtgagcgtgtttaggctcgcggacgccgtgtccgttgtggaggtggtgaagggcgacggcgccgacgccgcgctggtctggaccgagctgctggagccggccgtgaagcccccggcgctgagctgatgaggtggggtggaagccgcgttctggttgcgattcttttgtttcttcttttttgtcgtcgcctgctatatatcattggcgagatcgtcgtctgtaaattattcactcgctccgtggctatatccaacaaagcaagcaaggaagaagaagaagaatccttgcggtttctgagagtca

SEQ ID NO: 3973 - DNA, 2040 bp, Zea mays
cttcgcgatacataaatacgggcacggccgtggcggcaaacctctcaactccgactgccgccacccgccagccagccacccagcacaaccacgatcatcggcccgtgaggtggtacgtgaaaattaccccgtcgcgcccgaccattacaacggcgccggccgagcaaacgccgccgccacgatgccgcccgccaccggcgccgtcgcatccgccgccgggaccgtgctccttgggaggtacgagctcggcggcctcctgggccgcggcgcgtccgccaaggtgtacctggcgcgggacctgcgcaccggccggtccgtggccatcaagtcgttccccaacccgcgcgccgccagcgaccggcccgtggccatcgagcgggaagcaggcatcctccggcgcctgcggcaccgccacgtggtgcggctccacgagattctggcgacgcgcacaaaggttcacttcgttctcgacctcgccgccggcggcgagctgctctcgctcgtggacgcgtcgggccgcatgacggaggacctggcgcggcactatttccggcagctggtgtgcgccgtgcgctactgccacgcgcgcggcgtgtgccaccgcgacatcaagcccgagaacctcctgctggacggggccggcgcgctgaaggtggccgacttcgggctcggcgcagtggccggcgccggcggggacctcctccggcacacgacgtgcggcaccccggcgtacgtggcgccggagatcctgtcgcggaaggggtacgagtacgacccggcgaaggtggacatctggtcctgcggcgtcgtgctgttcgtgctggcggccgggtacctgcccttcaacgacgcgagcctggtgaacatgtaccgcaagatctacgcgggcaggttccggtgccccgcgtggttctcgcccgcgctgcgcgacctgctgcggcgcgtgctgcacccggacccgtcggcgcgcgctgacgcggacagcatcgtggcgcacccctggttccggcacggcgccagcgacgaggagatgggacgcctgatgcacggcggcggaggagatgaagacgaagaagcgtgggtcggggcggcggcggacgaggacgacgcgggcagggagccgaccgcgttcgacatcctgagcttctcccccgggtgcgacctgtcggcgctgttcctgggcggggggtgcaaggagcgggtgttcgtgggcgaggccgccgcgggcgtgctgggccgcgtggaggcggccgggcggaagggagggtaccgcgtgcggaaggaagggaagaggggcgtgcgcgtggagggggaggagggcggcgtcgtggccaaagtgagcgtggttaggctcgccgacgccgtgtccgtggtggaggtggtgaaggacgacggcgccgacgccgcgctgttctggaccgagctgcttgagccggccgtgtgcgtgcccgccaccgcgttgtgtcatgtgtgaatattttgttggttcttgtgatgcgtcctgctgtgcgaggctatgctatggatcaagcaaagcaagcgaggaaggaggaagaagatgtgctgtagagttggttggtccgcgctagattgctggtgggtgccgacgaatacgatgcagggtaagctcacctcccaactcccattggatgttgtgttgcttttcatcagtgaatttggcagtcggtcggatagatagatagagatgaggaggcgtatgcagccggggatggagactcaagcatcgttgtgatcaataatgcaaggccgtccgtcattagtgtgatcgagtgccatggacatggacatggacatggaccaccaccaatcaagggaggcttcgtggatcactaggtttcgtccagctgccagcgctatccacaacaacaatccataacccatccaaccagctaagggcttgttcggttagctctcaatccatgtggattgagtgggattggatgggtttgaatcccaaacaagtcaaacttcttctcaattttttccaatcccatccaatccatgtgtattgggaataac

SEQ ID NO: 3974 - DNA, 1788 bp, Setaria italica
cggcgcgtttacataaataccggcgtggccatcaatccccaactcaaacagccgagccgcaaagccacccgggttttcagcagctcctccaccccgatcgttctcctctccgtcgccggcctgctagggacagggaaaaaaaattcccccgtcgcgcccgctcattacgacggcgccagccgagcagaagccgccgccacgatgtcgcccgccaccggcgccgtcgcatccgccgcgccgggagaggaatctcccgccgggacggtgctcctcggcaggtacgagctcggcggcctcctcggccgcggcgcgtccgccaaggtgtacctcgcaagggacctcctcaccggcgagtccgtcgccatcaagtccttccccaacccccgcgcctccggcggggccgaggagggacgccggcccgcggccattgagcgggaggcggccatcctccgccgcctgcgccaccgccacgtggtgcgcctccacgagatcctagccacgcgcaagaaggtccacttcgtcctcgacctcgccgccggcggcgagctcttctcgctcgtcgacgcctccggccgcatgacggaggacctcgcgaggcactacttccggcagctcatctccgccgtgcgctactgccacgcgcgcggcgtgttccaccgcgacatcaagccggagaacctgctcctcgacgaggccggcgcgctcaaggtcgccgacttcgggctcggcgccgtggccgacggcggcaacctccgccacacgctctgcggcaccccggcgtacgtggctcccgagatcctgtcgaggaaagggtacgacccggcgaaggtggacatctggtcctgcggcgtggtgctgttcgtgctcgccgccgggtacctccccttcaacgacgccagcctcgtgaacatgtaccgcaagatctacgcgggcaagttccggtgcccgagctggttctcgccggcgctgcgcgaccttctccgccgcgtgctgcaccccaacccggacgctcgcattgacgcggacggcatcgtggcccacccctggttctgcgacggcgccagcgacgaggagctggcgcgcctcatggtaggcgggcacgaggaggcctggttcaagcccgagttcaaggaggacatggcgagggagatgacggcgttcgacatcctgagcttctcgcctgggtccgacctgtccgcgctgttcggcgccgggccgggcaaggagcgggtgttcgtgagcgagcccgccgccgacgtgctgagccgcgtagaggcggccgggcggaaggaagggtaccgcgtgaggagggaagggaagcggggcaccgggccggtctacctcgaggaggagagcggcggcatcgtggcgaaagtgagcgtcttcaagctcgctgacgcggtgtgcgtggtggaggtggtgaagggcgacggcgcggaggccgcgctgttctggaccgagcggctgcagccggccgtgaagcccccggtgctgagctgagcctgagcagcgccgccgagggtgaagccgggttcctgctcctggtgccggccgggaacgggattcgttcgtgacgtctacaaactttgttgtgaaaaattcttttggttcttcggtgtgtgttggtattgtacgtatggtgcctgtcacgctcggtgattagagcactaagcgagatttggtgccccgtccgcgaaatcatgtgtaaaatactaccaaggcagcaacaatgaatccttgcgatgttgagacgagcaaccagtcttttgccaggctcagcggatgctt

SEQ ID NO: 3975 - DNA, 1682 bp, Panicum virgatum
gcccagccgcaaagccaccccgggtttccagcagctccggcacgatcgccttcgcccagtgattgagaggacaggaaaaaaaaattcccccgtcgcgcccgcccattacgacggcgccggccgagcagacgccgccgccacgatgtcgcccgccaccggcgccgtcgcatccgccgcggcgggagaggaatctcccgccgccgccgccacggttctcctcggcaggtacgagctcggcgacctcctcggccgcggcgcgtccgccaaggtgtaccgcgcgcgggacctcctcaccggccgctccgtcgcgatcaagtcattccccaacccccgcgccgccggcgccgagaaggggcgccgccccgtggccattgagcgcgaggcggccatcctccgccgcctgcgccaccgccacgtggtgcgcctccacgagatcctagccacgcgcaagaaggtccatttcgtcctcgacctcgccgccggcggcgagctcttctcgctcgtcgacgcctccggccgcatgacggaggacctcgccaggcactacttccggcagctcatctccgccgtgcgctactgccacgcgcgcggcgtgttccaccgcgacatcaagccggagaacctgctcctcgatgaggcaggcgagctcaaagtcgccgactttggcctcggcgccgtggccgacgacgcaacctccgccacacgctctgcggcaccccggcgtacgtggcgccggagatcctgtcgaggaaagggtacgacccagccaaggtggacatctggtcctgcggcgtggtcctgttcgtgctcgccgccggctacctccccttcaacgacgccagcctcgtcaacatgtaccgcaagatctacgcgggcaggttccggtgcccgagctggttctcgccgtcgctgcgcgacctgctgcgccgccttctggacccgaacccggactcccgcatcgacgcggacgacatcgtgggccacccgtggttctgccacggcgccggcgacgaggagctggcccgcctcatgcgcggccacgaggaggagccctggttcaagcccgagttcaaggaggaggacatggcgagggagatgaccgcgttcgacatcctgagcttctccgccgggtccgacctgtcggcgctcttcggcgccgggcatggcaaggagcgggtgttcgtcagcgaggccggcgctgccgtgctgagccgcgtggaggcggccgggcggaaggaagggtaccgcgtgaggagggaagggaagcggggcaccgggccggtctacctggaggaggagagcggcggcggcatcgtggcgaaggtgagcgtcttcaagctcgccgacgcggtgtcagtggtggaggttgtgaagggcgacggcgcggaggccgcgctgttctggaccgagcggctcgagccggccgtgaagcccccggtgctgtcgtgctgagctgagcaggccgccgccgagggttcctggcttcctgctcctggccctgggaggcgcctccgccgcttgccgggaatgggatccgtttcctttggttgtgatggttcctcaaaaattcatttggttgtttggccgtgtgtgtgttgtatggtgcctgtcacgctcggcgagcatcagagcactaagcgagcgaggtttggtgccgggtcggccaaaatcatcatcatcat

SEQ ID NO: 3976 - DNA, 4116 bp, Zea mays
ggggctccattgcttgccgtctcctaccacgaatggtcccggattagtacacgtattcggtacccgtttcaagtaccctgtccgttttcatccctaatatgaagatcaaagaagaaagtctgtctgggccgtgctttgctttgctctgctcgggtcagttaattaactaccatgcggtagctaaggaaggggctccattgcttgccgtctcctgccacgaatggtctggtcgctgtcttcttctgaggacctaacccaagacggtaggtaagtgccagcttaaagtctatctaaaggcggaccaccactgtccacctgggcggcgatggcgaccgccgcgagggagaggcgcctgccgccggcgctgcccctggcgactctcatcggccgggagctccgcgcggggggctccgagcgcccggccctgcgctacggccacgccggctttgccaagcgtggcgaggactacttcctcgtcaagcccgactgcctccgcgtccccggggaccccgcatccgcgttctccgtctttgccgtgttcgacggccacaacggcgtgtcggcggcggtctacagcaaggagcatctgctcgagcacgtcatgagcgcgctgtcgccggacatcggccgcgaagactggctgcaggcgctgccgcgcgcgctcgtcgccggcttcgtcaaggccgacatcgatttccagcgcaagggggaggtgtccggaaccacggcgacactggtggtcatcgatgggttcacggtcacggtggcgtcggtgggtgactcgcgctgcatcctggacacgcagggcggcgagttgcagctgctaaccgtggaccaccgcctggaggagaatgcagaggagcgggagcgcgtcacggccagcggtggggaagtaggccggctcaatctctttggcggccaggaggtcggccctctccggtgctggcctggtggcttgtgcctctcaagatccatcggggacatggatgttggagagttcattgtgcccattccacatgtcaagcaagtcaagctatcaaacaccggaggaagactgataatagcatctgatggcatatgggacgcgttgtccaatgaagcagctgcaaaagcatgcagaggattgcctgcagaactggcagcgaagcttgtcgttaagcaagctctgaaaacaagcgggctaaaggatgacaccacctgtgtcgtagttgacattatcccgtccgatcatctgacatcgccacaattgtctccaaagaaaaatcagaacaagttgaagtcactttttcgtagaaggtcgcatagttcagttagaaagcttggaggcaagtctgcctccattggttccgtggaggagttatttgaagaagggtctgcaatgctagaagaaaggttgggtaggaatctgtccttgaaagcagcttcaccacctttccgctgtgcaatctgccaagtggaccaagagcccttccaagatttgatggcagataatggaggtggttactgctcttcccagtacgctccatggggtggcccatgtctctgtttggactgtcggaaaaagaaagatgcaatggaaggaaaaagatgtagccgctctacagcatgcaggtgaaacaatcaaaatgctgagaaaaaggagcaacgagagacactaaggacgtgtttggtttgcgaattcagttgatccggcatgagctgctcctgcatgaggtcgtccgatgtttttctgggagtgaaccggtgctgcataattgcacttctaacgagcactacatggagtatctgatgtcggacgacacagatctatgatgtaaaccaaacaaatatattaggttcggatataggatcggatgattccggagaccgttgtccggcaaaccaaacacgttgtaaattaaatcgctggatccaagagtatgctgaaactaactgtattgacgaccaaggtttgatgttgttgagctcaaataacttgagcttgtagttttgatgtgccctgtagtgtgccttgtgatggtttttgtgggaataggaaacatgtaaaatactccttgtgttattgctgaattagagctgttgatttttttaataaaaaaaattacatagatgaatagctatgatgagcaaaaatcgcaaatgttattattacagcagcaataacatgaaagcggaaacaagcaaacacagctgcatagggacgacgacactggtcccctggctcggaatcctcaatggcatggcgcactcgtcgccgttgaagaagaccttggacgggaagccgtccccggcgatgatgtcgatgccgggggtcttcttcttggtgaaggagaagacggactgctgcttcccgggcaccgggtaatctacgccgctcatgttcctctccccgagcaggaagttgaggccctgggcgcccctgacgaagatggtgctgttcccgacgcccgtggcgttgaaggagtaggcctgttcgaagccgtcgtacgccttgtccatgacgatggccgtgaaccagtccggcatgtccgtgccgtcccagttgaagagcgtgaggcgcgcgctccatcctccggtgaagtcggtggcgacgtgccagttgacgctgacgccgcagaagtcgccgcagggcatgggtttgggcacgccgaggtgcttctggtccgcccactcgagcgcctcgctggcccgccggtcgaacggcatgagcagcgcctgcggcggcagcagcatcgccggcgccgtggtgctgcaggtcggcgcggacgaggggcagccgcacgcgcacgtccggcaggggaccaccgactcgttgtagaaggaggagaaggagacgcagcacctgggcggcttcttgggcgacgtggtgatgttgcacaccacctgccacgtcgccacggccaccgtgatcgacgtgagcccgctggggtccgggtactccgacgggctcaccgagatgggtgggtcgcacgcgtactccgggttcagcgcggacgcggcgccggtgacgttgaaccctgtgggcgggtagagcttggtccggttgaggtcgggcggcatcttgtacaccaccatctggaacgccgacttggagcgcgcgacatccatggacttgggcaggatggtgccgttccggcagcagtggtcgatccggccgatctccgtgtcgttggcccgcgacggcggcaggtcgtggacgacgggcctgcggtcgcagttgagcaccgccttggagaagtcgaggtccttgtagtactggccctggggaccgtagaggcattcggccgtgtccacctcccgcgggtaggcgcctcgcatggagctgatgaactccccgtgctcccacctccacgacagctgccaggcgtcgaggcggccgagcagcgcgtcgttctccagcgtgacgagcgctaggtaggtggtgtcgtacgactggagcacgtcgtaggtgatgaccaggtcgccggtgcggcgcgggaggaagccactctccaccaggccgccggtggggtccccacccgccgtgaacacgcagcaggtggtgaggttcgtcggcgacgacgtggcgttggtggccggcgggcaggtgtaggaagggtcggcgagcgagagaaacgaggggagcgggacgtagggctccggcccggcgaagagcgtgcctacgaggctgaccgtggcctgtgtcttggcggggtccccggccgtggcgatcggggtgaggaggtccgtctgcgggtacccggtgaaggacgtgggcgtgggcctgccggcggcgtcccccgccgtggtgttgtagggcagggcggcgcccgaggtgagcacggccccgtcgacggagacgaggatctcgccgtgcacgaaggtgagcagcagcgcccaggagcgtagcgggcgggtgccggcgttgacgacggtggcgctggcgctgaaggagtagggctgggagttgggcgccgccacgtgaggcctgatcttgtcccggcgctgcagcgtgtaggtgaggaggatcccgttgcagccggcgtcgggctgtgccgaggcggtgtgcgcgaggagcacaaggaagatgaagggcatggcggccatgcggacgacgacgggcagcatggccatggc

SEQ ID NO: 3977 - DNA, 1744 bp, Panicum virgatum
aaggccaccaaccaacccctctcctctgctctcccttggaacgaatgctcgcttgaattcttaggaccggacctcctgctcccatggcgaccgccgccagggtcagggagacgcgtctgccgccgccaccgctgcccctggctacgctcatcggccgcgagctccgcgccggcggctccgagcgcccggccctgcgctacggccacgcaggcttcgccaagcgcggggaggactacttcctcgtcaagcccgactgcctccgcgtccccggagatccctcatcggccttctccgtcttcgctgtgttcgacggccacaacggcgtctccgccgcggtctacagcaaggagcatctgctcgagcacgtcatcagcgcgctgccgcccgacatcggccgcgacgactggctgcaggccctgccgcgcgcgctcgtcgcgggctttgtcaaggccgacatcgatttccagcgcaagggcgaggtctcgggaaccacggcaacgctggtcgtcatcgacggcttcaccgtcacggtggcgtccgtgggcgactcgcgctgcatcctcgacacgcagggcggcgaattgcagctgctcaccgtcgaccaccgcctcgaagagaatgcagaggagcgggagcgcgtcacggccagcggtggggaagtcggccgcctcaatctcttcggtggccaggaggtcggtcctctccggtgctggccgggtggcctgtgcctttcaagatccatcggggacatggatgttggggagttcattgtgccaattccacacgtcaaacaagtcaagttatcgaatgtcggaggaaggctaataatagcatccgatggcatatgggatgcgctatccaatgaagcagctgcaaaggcatgccgaggattgcctgcagaactggctgcaaagcttgtggttaagcaagctcttaaaacaagtgggctcaaggacgacaccacctgtgtagttgttgacattatcccatctgatcatttgacatcaccgcaattgtctccaaagaaaaaccagaacaagttgaagtcacttttccgtagaaggtcgcatagttcagttggaaaacttggaggcaagtctgcctcatttggttctgtggaggagttgtttgaagaaggatctgcgatgttagaagaaaggttgggtaggaatttgtccttgaaagcagcttcaccacctttccgttgtgcaatctgccaagtggaccaagaaccatttgaaggtttgatgacagataatggtggcggttactgctcttccccatacgcgccatggggtggtccacatctttgtttggaatgtcggaaaaagaaagacgcaatggaaggtaaaagatccagccgctctacagcatgcaggtgaaacgaattaagactctgctgcttaagtcaagccagctgctcagtgcagaaactaagaggggataataagctgctggatccaagtataataattaattgtttggtgaaactaactgtattttcagcctggtacaaaagatattggctgctaagtgctaaccagtttgttgtttacgtacaactccgagtgaaaagtttgatgttcttgaggaaatagttgaaataatttggagcttgtagttttgatgtagcatagtgtgccttgcgcaggggaaaaaattgacctgcctagtgttgtgtgtgaatcattctttaaataaatagcttatagtatctactaggatgctctttggattaattgtt

SEQ ID NO: 3978 - DNA, 1861 bp, Pennisetum glaucum
ctgccccctcctccgcgccacgaatgctgtcttcttccactactactgctatcaggaggaggacctaggcaggcggtaggtgcgtgcggccaccgatggcgaccgccgcccgggaggcgcgtctgctgccgccaccgctgcccctcgccaccctcatcggccgcgagctccgtgccggcggctccgagcgccccaccctgcgctacggccacgccggattcgccaagcgcggggaggactacttcctcgtcaagcccgactgcctccgcgtccccggagatccctcgtcggcgttctccgtcttcgccgtcttcgacggccacaacggcgtctccgccgcggtctacagcaaggagcacctgctcgagcacgtcatcagcgcgctgccgccggacatcggccgcgaggactggctccaggcgctcccgcgagcgctcgtcgccggatttgtcaaggccgacatcgacttccagcgcaaaggcgaggtgtcggggaccacggcaacgctggtcgtcatcgacggcttcaccgtcacggtcgcgtccgtcggggactcgcgctgcatcctcgacacgcagggcggcgaactgcagctgctcaccgtcgaccaccgcctcgaggagaacgcggaggagcgggagcgcgtcacggccagcggcggggaagtcggcaggctcaatctcttcgggggccaggaggtcggtcctctccgctgctggccaggtggcttgtgcctttcaagatccatcggggacatggatgttggggagttcattgtgcccattccacatgtcaaacaagtcaagttatcaaatgccggaggaaggctaattatagcgtcagatggcatatgggatgcactatccaatgaagcagctgcaaaggcatgccgaggattgcctgcagaactggctgcaaagcttgtggttaagcaagctctgaaaacaagcgggctcaaggatgacacaacatgtgtagttgtggacattataccatccgatcatttgacatcaccgcaattgtctccaaagaagaatcagaacaagttgaagtcacttttccgtagaaggtctcatagttcagttggaaagcttggaggcaagtctgcttcgattggttctgtggaggagttatttgaagaagggtctgccatgttagaagaaaggctgggtaggaatttgtccatgaaagcagctgcttcaccgcctttccgttgtgcaatctgccaagtggaccaagaaccatttgaaggtttgctgacagataatggtggtggttactgctcttccccatatgcgccatggggcggtccacatctttgtttggactgtcggaaaaagaaagacgcgatggaaggtaaaagatctagccactctacagcatgcaggtgaaatgaatcaagactacgctgaaagccaagcctgctgcttggcttgctgggtgcagaaactaaagagacgataataagctgctggatcagcgtataattgtttgctgaagagtaactaactgtattcacagcctggtacaaaatattggctgctaagtgctaaccagtttgttgtctacctacaaccccgactgaaaagtttgatattcttgagaaattagttgaaaataatttggagcttgtagttctgatgtaccccccttatagtgttgtatcgccttgtgcagggaaaaattgacctgcctagtgctgtcgatggtgttctttggattaattgtgggatgtttcttctcttttttggctggaactgaagtacaaaacgtgtactgatgtgtaaaacacctgcttgtgctggattggcttgcagacatgactaaagtaaaaaaaaaaaaaaaaaaaaagtaactacta

SEQ ID NO: 3979 - DNA, 2207 bp, Setaria italica
ggcacagcaaccaatcgcctggccaggtcacttaactacctactaatccaaaggaaaagggataatcgcagtgagcaccctcacctgatgggctgaccgaccaaccagctgggcttagctcacctccacaccactccaccgtctccctcgaattatagaggagagcgaggagggctttgtctctccttccaattccattgctgcttctgcttgttggcttcctccgatcctctccgtctccgcggcgcctctgcctcttcctcttcctcttcctcttcctcttcctctgccgctctccctctcccccaaatcccacccaatttcaggcctttgcagcaccaccaccaagctctgctctgctctgcgtcccttcctccgcgccacgaatgctgtgttctaccactactgtaattattaggaggacctaggcaggcggtaggtgcggccaccgatggcgaccgccgccagggagacgcgtctgctgccgccaccgctgcccctcgccacgctcatcggccgggagctccgtgccgccggctccgagcgcccgaccctgcgctacggccacgcaggcttcgccaagcgcggggaggactacttcctcgtcaagcccgactgcctccgcgtccccggagatccctcatcggcattctccgtcttcgccgtcttcgacggccacaacggcgtctccgcggcggtctacagcaaggagcatctgctcgagcacgtcatcagcgcgctgccgccggacatcggccgcgacgactggctccaggcgctgccgcgcgcgctcgtcgccggatttgtcaaggccgacatcgatttccagcgcaaaggcgaggtgtcgggaaccacggcaacgctggtcgtcatcgacggcttcaccgtcacggtcgcgtccgtcggggactcgcgctgcatcctcgacacgcagggcggcgaattgcagctgctcactgtcgaccaccgcctcgaggagaatgcggaggagcgggagcgcgtcacggccagcggcggggaagtcggccgcctcaatctcttcgggggccaggaggtcggtcctctccggtgctggccaggtggcttgtgcctttcaagatccatcggggacacggatgttggggagttcattgtgcccattccacatgtcaaacaagtcaagttatcaaatgccggaggaaggctaattatagcgtcagatggcatctgggatgcactatccaatgaagcagctgcaaaggcatgccgaggattgcctgcagaactggctgcaaagcttgtggttaagcaagctctgaaaacaagtgggctgaaggatgacaccacctgtgtagttgtggacattataccatccgatcatttgacatcaccgcaattgtctccaaagaaaaatcagaacaagttgaagtcacttttccgtagaaggtctcatagttcagttggaaagcttggaggcaagtctgcttcaattggttctgtggaggagttatttgaagaagggtctgcgatgttagaggaaaggctcggtaggaatttgtccttgaaagcagcttcaccacctttccgttgtgcaatctgccaagtggaccaagaaccatttgaaggtttgatgacagataatggtgatggttactgctcttccccgtatgcgccatggggcggtccacatctttgtttggactgtcggaaaaagaaagacgctatggaaggtaaaagatctagccgctctacagcatgcaggtgaaatgaatcaagactctgctgaagacaagcctgctgctgggtgcagaaactaaagagaggataataagctgctggatccaagtataattgtttgctgaagagtaactaactgtattctcagcctggtacaaaatattggctgctaagtgctaaccagtttgttgtctacgtacaaccccaactgaaaagtttgatattcttgaggaattagttaaaaataattcggagcttgtagttttgatgtaccctatagtgtgtctcgccttgtgcagggaaaattggcctgcctagtgttgtctgtggatctttctttgaatagctatcgatggtgctctttggattaattgtggaatgtattttttgctggaactgaagtacgaaacgtgtgctgatgtgtaaaacacctgctctgctcgtgctgaattggcttgcagacatgctgttttatctttgagttttgagct

SEQ ID NO: 3980 - DNA, 1860 bp, Setaria italica
caccaccaccaagctctgctctgctctgcgtcccttcctccgcgccacgaatgctgtgttctaccactactgtaattattaggaggacctaggcaggcggtaggtgcggccaccgatggcgaccgccgccagggagacgcgtctgctgccgccaccgctgcccctcgccacgctcatcggccgggagctccgtgccgccggctccgagcgcccgaccctgcgctacggccacgcaggcttcgccaagcgcggggaggactacttcctcgtcaagcccgactgcctccgcgtccccggagatccctcatcggcattctccgtcttcgccgtcttcgacggccacaacggcgtctccgcggcggtctacagcaaggagcatctgctcgagcacgtcatcagcgcgctgccgccggacatcggccgcgacgactggctccaggcgctgccgcgcgcgctcgtcgccggatttgtcaaggccgacatcgatttccagcgcaaaggcgaggtgtcgggaaccacggcaacgctggtcgtcatcgacggcttcaccgtcacggtcgcgtccgtcggggactcgcgctgcatcctcgacacgcagggcggcgaattgcagctgctcactgtcgaccaccgcctcgaggagaatgcggaggagcgggagcgcgtcacggccagcggcggggaagtcggccgcctcaatctcttcgggggccaggaggtcggtcctctccggtgctggccaggtggcttgtgcctttcaagatccatcggggacacggatgttggggagttcattgtgcccattccacatgtcaaacaagtcaagttatcaaatgccggaggaaggctaattatagcgtcagatggcatctgggatgcactatccaatgaagcagctgcaaaggcatgccgaggattgcctgcagaactggctgcaaagcttgtggttaagcaagctctgaaaacaagtgggctgaaggatgacaccacctgtgtagttgtggacattataccatccgatcatttgacatcaccgcaattgtctccaaagaaaaatcagaacaagttgaagtcacttttccgtagaaggtctcatagttcagttggaaagcttggaggcaagtctgcttcaattggttctgtggaggagttatttgaagaagggtctgcgatgttagaggaaaggctcggtaggaatttgtccttgaaagcagcttcaccacctttccgttgtgcaatctgccaagtggaccaagaaccatttgaaggtttgatgacagataatggtgatggttactgctcttccccgtatgcgccatggggcggtccacatctttgtttggactgtcggaaaaagaaagacgctatggaaggtaaaagatctagccgctctacagcatgcaggtgaaatgaatcaagactctgctgaagacaagcctgctgctgggtgcagaaactaaagagaggataataagctgctggatccaagtataattgtttgctgaagagtaactaactgtattctcagcctggtacaaaatattggctgctaagtgctaaccagtttgttgtctacgtacaaccccaactgaaaagtttgatattcttgaggaattagttaaaaataattcggagcttgtagttttgatgtaccctatagtgtgtctcgccttgtgcagggaaaattggcctgcctagtgttgtctgtggatctttctttgaatagctatcgatggtgctctttggattaattgtggaatgtattttttgctggaactgaagtacgaaacgtgtgctgatgtgtaaaacacctgctctgctcgtgctgaattggcttgcagacatgctgttttatctttg

SEQ ID NO: 3981 - DNA, 1870 bp, Zea mays
actccactccactgccgtctcttctgcttcttctaatcctcttgtcccgcgaaccccagtcgctaccgagagcacaccaatcctcatcacctccgagattttcatcgcctgccgcgcaatctcgggatcctagccgtccgcacatcgccgcggccttcctccgcgccacgaatggtgttctctggccgctgtcttttcccgaggacctaacccaaggcggtaggtaccagctaaaagtctaaaggcgaccaccggaccgggcggcaatgacgaccgccgcgagggagaggcgcctgccgccgacgctgcccctggccacgcttatcggtcgcgagctccgtgcggggggctccgagcgcccggccctgcgctacggccacgccggcttcgccaagcgcggcgaggactacttcctcgtcaagcccgactgcgtccgcgtccccggggaccccgcatcggcgttctcagttttcgccgtgttcgacggccacaacggcgtgtcggcggcggtctatagcaaagagcatctgctcgagcacgtcatgagcgcgctgccgccggacatcgggcgcgacgactggctgcaggcgctgccgcgcgctctcgtcgccggctttgtcaaggccgacattgatttccagcgcaagggggaggtgtcaggaaccacggcgacactggtggtcatcgatgggttcacggtcacagtggcgtcggtgggagactcgcgctgcatcctggacacgcagggcggcgagttgcagctgctaaccgtggaccaccgcctggaggagaatgcagaggagcgggagcgcgtcacggccagcggtggggaagtaggccggctcaatctcttcggtggtcaggaggttggtcctctccggtgctggcctggtggcttgtgcctttcaagatccattggggacatggatgttggggagtacattgtgcccattccacatgtcaagcaagtcaagctatcaaacgctggaggaaggctgataatagcatccgatggcatatgggatgcattatccaatgaagcagctgcaaaagcatgcagaggattgcctgcagaactggcagcgaagcttgtcgttaagcaagctctgaaaacaagcgggctaaaggatgacaccacctgtgttgtagttgacattatcccatccgatcatttgacatcaccacaattgtctccaaagaaaaatcataacaagttgaagtcactttttcgtagaaggtcgcatagttctgttggaaagctcgggggcaagtctgcctccattggttctgtggaggagttatttgaagaaggctctgcaatgttagaagaaaggttgggcaggaatttgtctttgaaagcagtttcagcaccttttcgctgtgcaatctgccaagtggaccaagagcccttcgaagatttgatgagagataatggaggtggttactgctcttccccatgcgctccatggggtggtccatatctctgtttggactgtcggaaaaagaaagatgcaatggaaggtaaaagatctagctgctccacagcatgcaggtgaaacagtccttgcctcaagcagaaaagaaccgatgagagaggataataagttgctggacccaagtataattgtttgctgaaactaactgtattgccagcccggtaaaagacatatttggctggtagtaagacctaactagtctgttacctgcgcacaatccgaatggaaaagtttgttgtcgttgaggacatagctcaaataacttgagcttgtagttttgatgtaccctgtagcgtgccttgtgcagggaaaaattgacctgcctattgctgtttttttttataaaatagctatcgagggtgattaatcgtgga

SEQ ID NO: 3982 - DNA, 1745 bp, Hordeum vulgare
atcatgagcacgcacgacagcatcccaaatcccaactcgcggcctcgccgtcgctccggtcctcgccggccggcatcccactcccagccagatccgaccccccgacgcgtcccgccattgtctccgtccccggccttttccccggcagggaatggtgcactgtggcccgcggtaggcagacacgagcgcgactgcgggggcaagaagcggcggcggcggcgagatggccggcgcggagagggagaggagaaagcttccgcctgcgctgcccctggccacgctgatcgggcgcgagctccgcgcggggggctccgagcgcccggcgctgcgctacggccacgccggcttcgccaagcgcggggaggactacttcctcgtcaagcccgactgcctccgcgtccccggcgacccctccaccgccttctccgtcttcgccgtgttcgacggccacaacggggtgtcggcggcggtgttcagcaaggagcacctgctggagcacgtgatgagcgcgctcccgccggacatcggcggccgcgaggaatggctgcaggcgctgccccgcgcgctcgtcgccggcttcgtcaaggccgacatcgacttccagcgcaagggggaggtgtcggggacgacggctacgctcgtggtcgtcgacgggttcacggtcaccgtggcctcggtcggggattcccggtgcatcctggacacgcagggcggcgagctgcagcttctaaccgtcgaccacaggctggaggagaacgtcgaggagagggagcgtgtcacggccagcggtggggaggtcggccgtctgaatctcttcggcgggcaggaggttggccctctccgttgttggccaggtggtttgtgcctctcaagatccattggagacatggatgttggggagtacattgtgccggttccacatgtcaagcaagtgaagctctcaagtgtcggaggaaggctgataatggcgtcggatggcatatgggatgcactatccaatgaggcagcagcacagtcatgccgaggattgcctgcagaactcgctgcgaagcttgtggttaagcaagctctgaaaaaatgcgggctgaaagatgataccacctgtgtggtggttgacatcatcccatccgatcatcgtttgacgtcgccacagttatccccaaagagaaatcagaacaagctcaagtctcttctttttcgtagaaggtcacacagttcagttggaaagtttggaggcaagtccgcctctattggttctgtggaggagctatttgaagaaggctctgcaatgttggaagaaaggttgggtaggaatctgtccttaaaagcagcttcaccgccttctcgctgtgcaatctgccaagtggaccaagaaccatttgaaggcttgatggaggagaatggaggcagccactgttcttctccatacgcgccttggggaggcccttatctctgcctggagtgtcggaaaaagaaagacgcaatggagggcaaaagaccaagctgctcgacggcatgtaggtgaaaaggaagcatgacttgtgtcaaaaggatgcgtccttctcagtgtaaaaactaaaaagatggagataagtttgttggtgattcaattattattgtttgctgaacctaactagattctcagcccggtataaattgtatttggctgctaaccggtttgttgcctatgaaaaatcctgatattggaatttttttaatatatttttgaggaaactctggtgcag

SEQ ID NO: 3983 - DNA, 1914 bp, Secale cereale
tcctcgccggccggcagcccagtccccagatccgaacccccgactcgtcccgccattgttgccgtccccgaccttctcccggcagggaatggtgcactgtggtccgcggtaggcagacgcgagcacgaccgcgggcgcaagaagaggcggcggcgagatggccggcgcggagagggagaggagaaagatgccgctgccgccggcgctgcccctggccacgctgatcgggcgcgagctccgcgccgggggctccgagcgcccggcgctgcgctacggccacgccggcttcgccaagcgcggggaggactacttcctcgtcaagcccgactgcctccgcgtccccggcgacccctccaccgccttctccgtcttcgccgtgttcgacggccacaacggggtctcggcggcggtgttcagcaaggagcacctgctggagcacgtcatgagcgcgctcccgccggacatcggcagccgcgaggactggctgcaggcgctgccccgcgccctcgtcgccggcttcgtcaaggccgacatcgacttccagcgcaagggggaggtgtcggggacgacggctacgctggtggtggtcgatgggttcacggtcaccgtggcgtcggtcggggattcccggtgcatcctggacacgcagggcggcgagctgcagctgctaaccgtggaccacaggctggaggagaatgtcgaggagagggaacgtgtcacggcgagcggtggggaggtcggacgtctgaatctcttcggcgggcaggaggttggccctctgcgttgttggccaggtggtttgtgcctctcaagatccattggagacatggatgttggggagtacattgtgccggttccacatgtcaagcaagtgaagctctcaagtgtcgggggaaggctgataatggcatctgatggcatatgggatgcactatccaatgaggcagcggccaagtcatgccgaggattgcccgcagaactcgctgcaaagcttgtggttaagcaagctctgaaaaaatgtgggctgaaagatgataccacctgtgtggtggttgacatcatcccatccgatcatcatttgacatcaccacagttatccccaaagagaaatcagaacaagctcaagtctcttctttttcgtagaaggtcgcacagttcagttggaaagtttggaggcaagtctgcctctattggttctgtggaggagctattcgaagaaggctctgcaatgttggaagaaaggttgggtaggaatctgtccttgaaagcagcttccccaccttctcgctgtgcgatctgccaagtggaccaagaaccatttgaaggattgatggaggagaatggaggtagccactgctcttctccatacgcgccgtggggaggcccatatctttgtctggagtgtcggaaaaagaaagacgcaatggagggcaaaagaccgagctgctcgacagcatgtaggtgaaaaggaagcatgacttgtgtcaaaagtatgcttcttctccgtgtaaaaactaaagagatggagataagttgttggtgattcaattattattgtttgctgaacctaactagattctcagcccagtataaattgtatttggctgctaaccagtttgttgcctatgaacaaacctaatattggaagtgtttttaaatatatttttgaggaaactacggtgcggactgtaccattatgtggggagaaatgatctgcctatttattgtgttatggtcgatcatttctattatcagtcttggaatactctgcttatttaaccaccgggttttggttatttccacggttgtttccatgtataagccttttcttacgcgcacacatgatcttttttgtcttctaaataaatgtgtactctctctatcccataatataagatgttattatgaccagtc

SEQ ID NO: 3984 - DNA, 1846 bp, Triticum aestivum
atttttcgtggcctccccgtcgctccgatcctcgccggccggccggcagcccagccccagatccgaacccccgcggcgccccgccattgtcgccgtccccgaccttcccccggcagggaatggtgcactgtgggcggcggtaggcagacacgagcacgaccgcgggggcaagaagcggcggcggcgagatggccggcgcggagagggagaggagaaagatgccgctgccgccggcgctgcccctggccacgctgatcgggcgcgagctccgcgcggggggctccgagcgcccggcgctgcgctacggccacgccggcttcgccaagcgcggggaggactacttcctcgtcaagcccgactgcctccgcgtccccggcgacccttccaccgccttctccgtcttcgccgtgttcgacggccacaacggggtgtcggcggcggtgttcagcaaggagcacctgctggagcacgtgatgagcgcgctcccgccggacatcggcagccgcgaggactggctgcaggcgctgccccgcgcgctcgtcgccggcttcgtcaaggccgacatcgacttccagcgcaagggggaggtgtcggggacgacggctacgctggtggtcgtcgacgggttcacggtcaccgtggcgtcggtcggggattcccggtgcatcctggacacgcagggcggcgagctgcagctgctaaccgtcgaccacaggctggaggagaatgtcgaggagagggagcgtgtcacggcgagcggtggggaggtcggccgtctgaatctcttcggcggtcaggaggttggccctctccgttgttggccaggtggtttgtgcctctcaagatccattggagacatggatgttggggagtacattgtgccggttccacatgtcaagcaagtgaagctctcaagtgtcggaggaaggctgataatggcatctgatggcatatgggatgcgctatccaatgaggcagcagccaagtcatgccgaggattgcccgcagaactcgctgcaaagcttgtggttaagcaagctctgaaaaaatgtgggctgaaagatgataccacctgtgtggtggttgacatcatcccatctgatcatcatttgacatcgccacagttatccccaaagagaaatcagaacaagctcaagtctcttctttttcgtagaaggtcacacagttcagttggaaagtttggaggcaagtccgcctctattggttccgtggaggagttatttgaagaaggctctgcaatgttggaagaaaggttgggtaggaatctgtccttgaaagcagcttcgccgccttctcgctgtgcgatctgccaagtggaccaagaaccatttgaaggcttgatggaggagaatggaggtagccactgctcttctccatacgcgccttggggaggcccgtatctttgtctggagtgtcggaaaaagaaggacgcgatggagggcaagagaccgagctgctcgacagcatgtaggtgaaaaggaagcatgacttgtgtcaaaagtatgcttcttctccgtgtaaaaactaaagagatggagataagttgttggtgattcaattattattgtttgctgaacctaactagattctcagcctggtataaattgtatttggctgctaaccagtctgttgcctatgaacaatcctaatattggatttttttaaaatatattatcgaggaaaatacggtgcagactgtaccattgtgtggggagaaacgatctgcctatttattgtgtgtttttgtgtgttagggcctatcatttctattattaatcttggaatgtatttttgcctgaagcgaagtatgagctgagccaactct

SEQ ID NO: 3985 - DNA, 2030 bp, Oryza sativa
ctcatatgacaagcttcctaattatacctgcccctgcttgtcctgcgctgttcctctctatcgactctctcactcctgcacatcacaggcaggcaggcaggcacaggctgtgtccccaacacaacacaagactactactcccaaatccccaatttcattctccttgatcccacccagccactcaatcccagatccgaatcccacctctccgtctcattctccggcgccggccagaaatgctgccctcctcctcctttaggcgttggggggagctagagctctagctagctagctaggtgcgacgcgacgacgtgatggctggtattgctaaggagaggcggctgccgccggcgctgccactcgccactctcatcggccgcgagctccgcgccgggggctccgagcgcccctccctccgctacggccacgccggcttcgccaagcgcggcgaggactacttcctcgtcaagcccgactgcctccgcgtccccggggacacctccaccgccttctccgtcttcgcggtgttcgacggccacaacggggtctcggcggcggtctacagcaaggagcatttgctcgagcacgtcatgagcgcgctgccgccggacatcggccgcgacgactggctacaggcgctgccgcgggcgctcgtcgccggcttcgtcaaggccgacatcgacttccagcgcaagggggaggtgtcggggaccaccgcaacgctggtggtcgtcgatggattcacggtcacggtggcgtcagtcggggactcgcggtgcatcctggacacgcagggtggtgaggtgcagctgctcaccgtcgaccaccgcctggaagagaatgccgaggagcgggagcgggttaccgccagcggtggggaggtcggccgcctcaatctcttcggcggccaggaggttggtcctctccggtgctggccaggtggcctgtgcctttcaagatctatcggggacatggatgtcggggagttcattgtgccgattccacatgtgaagcaagtgaagctctcaaacattggaggaaggttgatcatcgcatcagatggtatatgggatgcactaccctctgaagcagcagcaaaggcatgccgaggtttacctgcagaactggctgcaaagcttgtggttaagcaagctctcaaaaaaagtgggctgaaagatgacaccacttgtgtggtggttgatatcatcccttccgattatcgtttgacatcgccgcagttgtccccaaagagaaaccagagcaagttcaagtctcttcttttcggtagaaggtcacacagttcaattggaaagcttggaggcaagtctgcctcttttggctctgtggaggaattatttgaagaaggctctgcaatgttggaagaaaggttgggtaggaatttgtccttgaaagcaacctcggcacctcttcgatgtgctatctgccaggtggaccaagaaccatttgaaagtatgatgactgagaaaggaggcagttactgctcttccccatgcgccccctggggaggtccatatctttgtttggagtgtcgaaaaaagaaagacgcaatggagggtaaaagatcaagccactctacagcgtgcaggtgaaacagagcaggggattctggacaaggttgatgttgagtgtaaaaactaaagatggaataataagttgctggattgaattattattttctgaaactaactgcatcctcagcctggtataaactatgtctggctgctgctaaccggtttatcgtctgcgcacaactctgatggatttttttttcttttaatattcttgaggaaatagctcacataacttggagcttgtagttttggattgtatcctctagtgtgtattgtgtaggaatgggcatgcctaatgctgtgtgtgactttttatttgagctagtataccagaaggctctttgtaatggatgaattaatgtactttgctggaatcaaattaattgtcaagcatatacagtacttaataatcacctttctttctttgtgtgttgaatt

SEQ ID NO: 3986 - DNA, 1991 bp, Oryza sativa
gtcctgcgctgttcctctctatcgactctctcactcctgcacatcacaggcaggcaggcaggcacaggctgtgtccccaacacaacacaagactactactcccaaatccccaatttcattctccttgatcccacccagccactcaatcccagatccgaatcccacctctccgtctcattctccggcgccggccagaaatgctgccctcctcctcctttaggcgttggggggagctagagctctagctagctagctaggtgcgacgcgacgacgtgatggctggtattgctaaggagaggcggctgccgccggcgctgccactcgccactctcatcggccgcgagctccgcgccgggggctccgagcgcccctccctccgctacggccacgccggcttcgccaagcgcggcgaggactacttcctcgtcaagcccgactgcctccgcgtccccggggacacctccaccgccttctccgtcttcgcggtgttcgacggccacaacggggtctcggcggcggtctacagcaaggagcatttgctcgagcacgtcatgagcgcgctgccgccggacatcggccgcgacgactggctacaggcgctgccgcgggcgctcgtcgccggcttcgtcaaggccgacatcgacttccagcgcaagggggaggtgtcggggaccaccgcaacgctggtggtcgtcgatggattcacggtcacggtggcgtcagtcggggactcgcggtgcatcctggacacgcagggtggtgaggtgcagctgctcaccgtcgaccaccgcctggaagagaatgccgaggagcgggagcgggttaccgccagcggtggggaggtcggccgcctcaatctcttcggcggccaggaggttggtcctctccggtgctggccaggtggcctgtgcctttcaagatctatcggggacatggatgtcggggagttcattgtgccgattccacatgtgaagcaagtgaagctctcaaacattggaggaaggttgatcatcgcatcagatggtatatgggatgcactaccctctgaagcagcagcaaaggcatgccgaggtttacctgcagaactggctgcaaagcttgtggttaagcaagctctcaaaaaaagtgggctgaaagatgacaccacttgtgtggtggttgatatcatcccttccgattatcgtttgacatcgccgcagttgtccccaaagagaaaccagagcaagttcaagtctcttcttttcggtagaaggtcacacagttcaattggaaagcttggaggcaagtctgcctcttttggctctgtggaggaattatttgaagaaggctctgcaatgttggaagaaaggttgggtaggaatttgtccttgaaagcaacctcggcacctcttcgatgtgctatctgccaggtggaccaagaaccatttgaaagtatgatgactgagaaaggaggcagttactgctcttccccatgcgccccctggggaggtccatatctttgtttggagtgtcgaaaaaagaaagacgcaatggagggtaaaagatcaagccactctacagcgtgcaggtgaaacagagcaggggattctggacaaggttgatgttgagtgtaaaaactaaagatggaataataagttgctggattgaattattattttctgaaactaactgcatcctcagcctggtataaactatgtctggctgctgctaaccggtttatcgtctgcgcacaactctgatggatttttttttcttttaatattcttgaggaaatagctcacataacttggagcttgtagttttggattgtatcctctagtgtgtattgtgtaggaatgggcatgcctaatgctgtgtgtgactttttatttgagctagtataccagaaggctctttgtaatggatgaattaatgtactttgctggaatcaaattaattgtcaagcatatacagtacttaataatcacctttctttctttgtgtgttgaatt

SEQ ID NO: 3987 - DNA, 1580 bp, Brachypodium distachyon
tcggcggcggcggtgatggccggcgccgagagggagaaggctaggctgccgccggcgctgcccctggccacgctgatcgggcgcgagctccgcgccgggggctccgagcgccccgcgctgcgctacggccacgccggcttcgccaagcgcggcgaggactacttcctcgtcaagcccgactgcctccgcgtccccggcgacccctccaccgccttctcagtcttcgccgtgttcgacggccacaatggggtgtccgcggcggtgttcagcaaggagcatctgctggagcacgtgatgagcgcgctgccgccggacatcggcggccgcgaggaatggctgcaggcgctgccacgcgcgctcgtcgccggatttgtcaaggccgacatcgagttccagcgcaaaggggaggtgtccgggacgacggcgacgctggtggtcgtagatgggttcacggtgactgtggcgtctgtcggggactctcggtgcattctcgacacgcagggcggcgagctgcagctgctcaccgtggaccaccggctggaggagaatgtcgaggagagggagcgtgtcaccgcgagcggtggggaggtcggccggttgaatctcttcggcgggcaggaggtcgggcctcttcgttgctggcctggtggcttgtgcctctcaagatccattggagacatggatgtcggggagtacattgtgccggttccacatgtgaagcaagtgaagctctcaaatgttggaggaaggcttataatagcatcagatggcatatgggacacactatccaatgaagcagcagcaaaatcgtgccggggattgcccgcagaactggctgcaaagcttgtggttaagcaagctctgaaaaaatgtgggctgaaagatgacactacttgtgtggtagttgacatcatcccatccgatcgtttggtatcgccacagttatccccaaagaggaaccagaacaagctcaagtcccttctttttggtagaaggtcacacagttcagttggaaagtttggaggcaagtctgcctcttttggctccgtggaggagttatttgaagaaggctctgcaatgttggaagaaaggttgggtcggaatctatccttgaaagcagcttcgccaccttctcgctgcgcaatctgccaagcggaccaagaaccattcgaaggtttgatggcagagaatggaggtagccactgctcttccccgtacacgccttggggaggcccttatctctgtctggagtgtcgaaaaaagaaggacgcgatggaaggcaaaagatctagctgctctacagcttgtaggtgaaaaatgaaaaaaaaaatcatgataagttgttggtgatcccgttattactgtttgttgaacctaactacattccctgcctggtataaattatactatctggctgctaaccagcttgttgcctacgtgcaatcctaattgaagttttttgtattagcaaactatgatcaatgtgaattgtaccacaccattattgcgtagggagaaatgacctgcctattttatcgtgtgtattgttttgagaaagccgagtatatgagggttagtcc

SEQ ID NO: 3988 - DNA, 1938 bp, Brachypodium distachyon
cactcgccctccctcccggtttataagcctctgctcctcctcttctcgtaatctcatctcacttctcgccgcggacgcaatccaaatcccagttcgtgcctccccgtcgcgccgcccgattctcgccggcgcctgccgtccagcccagatcccaagtccccgccgcgcaatcgccattgccccacacgtcattgagcgagcttttttttttcttttcccgaggggaatgctggcctgtaggtggtggtagtaggtgggtaggtgcggctgtgttggaatttggaaaaggagtcggcggcggcggtgatggccggcgccgagagggagaaggctaggctgccgccggcgctgcccctggccacgctgatcgggcgcgagctccgcgccgggggctccgagcgccccgcgctgcgctacggccacgccggcttcgccaagcgcggcgaggactacttcctcgtcaagcccgactgcctccgcgtccccggcgacccctccaccgccttctcagtcttcgccgtgttcgacggccacaatggggtgtccgcggcggtgttcagcaaggagcatctgctggagcacgtgatgagcgcgctgccgccggacatcggcggccgcgaggaatggctgcaggcgctgccacgcgcgctcgtcgccggatttgtcaaggccgacatcgagttccagcgcaaaggggaggtgtccgggacgacggcgacgctggtggtcgtagatgggttcacggtgactgtggcgtctgtcggggactctcggtgcattctcgacacgcagggcggcgagctgcagctgctcaccgtggaccaccggctggaggagaatgtcgaggagagggagcgtgtcaccgcgagcggtggggaggtcggccggttgaatctcttcggcgggcaggaggtcgggcctcttcgttgctggcctggtggcttgtgcctctcaagatccattggagacatggatgtcggggagtacattgtgccggttccacatgtgaagcaagtgaagctctcaaatgttggaggaaggcttataatagcatcagatggcatatgggacacactatccaatgaagcagcagcaaaatcgtgccggggattgcccgcagaactggctgcaaagcttgtggttaagcaagctctgaaaaaatgtgggctgaaagatgacactacttgtgtggtagttgacatcatcccatccgatcgtttggtatcgccacagttatccccaaagaggaaccagaacaagctcaagtcccttctttttggtagaaggtcacacagttcagttggaaagtttggaggcaagtctgcctcttttggctccgtggaggagttatttgaagaaggctctgcaatgttggaagaaaggttgggtcggaatctatccttgaaagcagcttcgccaccttctcgctgcgcaatctgccaagcggaccaagaaccattcgaaggtttgatggcagagaatggaggtagccactgctcttccccgtacacgccttggggaggcccttatctctgtctggagtgtcgaaaaaagaaggacgcgatggaaggcaaaagatctagctgctctacagcttgtaggtgaaaaatgaaaaaaaaaatcatgataagttgttggtgatcccgttattactgtttgttgaacctaactacattccctgcctggtataaattatactatctggctgctaaccagcttgttgcctacgtgcaatcctaattgaagttttttgtattagcaaactatgatcaatgtgaattgtaccacaccattattgcgtagggagaaatgacctgcctattttatcgtgtgtattgttttgagaaagccgagtatatgagggttagtccatctttgaatgtgtcatctttgctggtgatcgaacaactgtttactaggtttgttttgaaccaaagt

SEQ ID NO: 3989 - DNA, 2007 bp, Setaria italica
tctccctctgatcggcggattaaaatcctcgcccccatttccagcccctttctgttcactgccctcgccaaattcccccaatcccagctcgccgccgacggcattgcgtcgccattgcctccgaatccgagtgcgcgtcgcgtgatcccggatccagcttggcgtctttacccgccgtcgcctccgacccaacattttccgcgcaaggcatggtgccgtcccggcggttttttgggagagtgcttcttctgtaggaccgcggcgagaggctgtgatggcgggcgccgccacggaggggaagctctccccggctctgcccctggccacactgatcggccgcgagctccgcggcgacggctccgagcgcccgctcgtgcggtacggccactccggcttcgccaagcgcggcgaggactacttcctcgtcaagcccgactgcctccgcgtcccaggcgacccttcctccgcgttctccgtcttcgctgtgttcgacggccacaatggcgtgtcggcggcggtgttcagcaaggagaaattgctggagcacgtgatgagcgccgtgcctcagggcatcagccgcgaggactggctacaggcgctgccgcgcgcgctcgtcgctggattcgtcaagacagacattgacttccagcgcaagggggagacttcagggacaacggcgaccctggttgtggttgatgggttcacggtcaccgtggcttcagtgggagattccaggtgcattctggatacacaaggtggcgaggtctcgttgctgactgtggatcaccggctagaagagaatgcagaggagagggagcgggtcacagcaagtggaggggaggtcagccggcttaatctctgtggaggacaagaggttggtcctctccgatgctggcctggtggattgtgcctttcaaggtcaattggggatactgatgtcggcgagttcattgtaccgattccacatgtcaagcaagtgaagctcccaaatactggtggaagactaataattgcttcagatggaatatgggatgctctgtcctcagagactgctgctcaggcatgtcggggattgcctgcagaactggctgcgaagcttgttgttaagcaagctctgaagactagcgggttgaaagacgacaccacatgcgtggttgttgacatcattccatctgatcattgttcaacaccaccagcattgtctccaaagagaaatcagaacatgttgaagtctcttatttttggtaggaggtcacatagttctgtcggaaagctcagcaaatctgcttcattgagctctgtggaagaaatatttgaggagggatctgcaatgttggaagaaaggttgggtagaaatttcccatcaaaagctaatctgcctcccttccgctgcgctatctgccaagtggaccaagagccgttcgaaggtttaatgacggacaatgtaggtggctgctgctcagccccatcaacaccatggggtggtccttatctttgttcagactgtaggaaaaagaaggatgcgatggaaggtaaaagatcaagccgctcaacaacgtgcaggtgaaggtactgataggaaaccaccgggtcctgtccatgccaactagtcttcgatttcggttttctgctgcttgtaaaaagagaagaataaaccgtttgttgtttgatccaagtattgtgtggtgaaactaactgcactccagcctgaactgaaaaaattgggggtaactaacaagcctggtttctatcaacagtgcggatggcatttttcgtttgctcagagaagatagctaacaaacttgaagcctttagtattgtgaaccctaacatgtaaagagaaatgagtagcctaacaatgtgtttgataacgatggcacggctcctcattgctgatttagaatgcattttgtatggagccggtcgcttgaacgtttgattctatcccaatcaatctaggacagtatttggtgtatggctgaagtggatttcattgtatttgccttc

SEQ ID NO: 3990 - DNA, 2265 bp, Oryza sativa
tatgaacacacttttctttaatccaactcagatttcttaatccaaaagttgctaaccactatcgaccagctggcctcgctgctgctgcaagcttgcagaaatgcaggcatttggcaagcacatttgcaccgaggccccctatttcacctacgaattacaaaaagatcccacctcttctactatcgtcagctaattaaatcgttgttcctcagttcggtacttcttcttccttcactctccccaccaaattcccccaaatcgcagctgttcgccacccgcattgcgccgccattgcctccaaatccgagtactccttgagtaatctcagatccatctcgggttcctcccgccgttggcagcagccggagcttttttccgcggaagaaatggcgccgtttcggtgagttcttggcagtttgggatgatgcttggtgggtaggaggactaggagtgcggcggctcggggagaggctgcgatggagagcgccgccggggaggaggggaaggctgccccgtcgcttcccctggcgaccctgatcggccgcgagctccgcggcggcggctccgagcggccgctcgtccggtacggccacttcggcttcgccaagcgcggcgaggactacttcctcgtcaagcccgactgcctccgcgtcccgggcgacccttcctccgccttctccgtcttcgccgtgttcgacggacacaatggcgtgtcggcggcggtgttcagcaaggagcacctgctggagcacgtgatgagcgccgtgccgcagggcatcggccgcgacgactggctgcaggcgctgccgcgcgcgctggtcgcgggcttcgtgaagacggacatcgacttccaacgcaagggggaggcatcagggacgacagcgacgctggtcgtcgtcgatgggttcacggtcacggtggcgtctgttggggactccaggtgcatattggacacgcagggcggtgtgatctcgctgctaaccgtggaccatcgtctcgaggagaatgtagaggagcgggagcgcgtcaccgcgagtggaggggaggtcagccggctcaacctgtgtggtggacaggaggtgggacctctcagatgctggccaggtggattgtgcctttcaagatcgattggggatactgacgttggggagttcattgtgccaattccacatgtcaagcaagtgaagctatcaaatgctggagggaggctaataattgcatcagatggaatttgggatgcactgtcctcagaagctgctgctcaggcatgccgaggattgcctgcagagctggctgcaaagcttgtcgtgaagcaagcactgaagacaagtgggctgaaagatgacaccacctgtgtggttgttgatatcatcccatctgatcattcttcaacacctccatcactatctccaaagaaaaaccagaacaagttgagatctcttctttttggtaggaggtcacatagttctgttggaaagcttggaaacaagtctgcttcatttgactctgtggaggaattatttgaagagggttccgcaatgttggatgaaaggttgggtaggaattttccatcaaaagcaaactcgtccccatctcgctgtgcaatctgccaagtggatcaagcaccttttgaagatttagtgacagataatggaggtggttgctgttctgccccatcgacaccatgggttggcccttatctttgttcagattgtaggaaaaagaaggatgcaatggaaggtaaaagatctagtcgctcaacagcgtgcaggtgaaattgccaataggactaactggtccttgttcgtgcaaactggtctcctggttcggttgtctgccacatgtaaaaagaggataataatctgtttgctgctggatccaagtattattggtgaaactaactgcaatctagcctgaactgaacaaattgggctactaacaatcttgggagtctatcaacagcgcagatgaaaatttctgtttgcactgggaagatagctcacaggatttcaaccccgtagttttttttttttttgaaccttagtatgtaaagtgaaatgtctagcttaacaatgtttgtaagagatggcaattggcaaggctccttgttctaccttggaatgtatatgcttgtggagccgaacagactaatttatttatctcatgctatcctaatcaatggtaatgtctttcggtgttctacgtggactgattttcattgtattaggcttttgggcatctggtgtttcctttaccttctaagtt

SEQ ID NO: 3991 - DNA, 2025 bp, Oryza sativa
agctaattaaatcgttgttcctcagttcggtacttcttcttccttcactctccccaccaaattcccccaaatcgcagctgttcgccacccgcattgcgccgccattgcctccaaatccgagtactccttgagtaatctcagatccatctcgggttcctcccgccgttggcagcagccggagcttttttccgcggaagaaatggcgccgtttcggtgagttcttggcagtttgggatgatgcttggtgggtaggaggactaggagtgcggcggctcggggagaggctgcgatggagagcgccgccggggaggaggggaaggctgccccgtcgcttcccctggcgaccctgatcggccgcgagctccgcggcggcggctccgagcggccgctcgtccggtacggccacttcggcttcgccaagcgcggcgaggactacttcctcgtcaagcccgactgcctccgcgtcccgggcgacccttcctccgccttctccgtcttcgccgtgttcgacggacacaatggcgtgtcggcggcggtgttcagcaaggagcacctgctggagcacgtgatgagcgccgtgccgcagggcatcggccgcgacgactggctgcaggcgctgccgcgcgcgctggtcgcgggcttcgtgaagacggacatcgacttccaacgcaagggggaggcatcagggacgacagcgacgctggtcgtcgtcgatgggttcacggtcacggtggcgtctgttggggactccaggtgcatattggacacgcagggcggtgtgatctcgctgctaaccgtggaccatcgtctcgaggagaatgtagaggagcgggagcgcgtcaccgcgagtggaggggaggtcagccggctcaacctgtgtggtggacaggaggtgggacctctcagatgctggccaggtggattgtgcctttcaagatcgattggggatactgacgttggggagttcattgtgccaattccacatgtcaagcaagtgaagctatcaaatgctggagggaggctaataattgcatcagatggaatttgggatgcactgtcctcagaagctgctgctcaggcatgccgaggattgcctgcagagctggctgcaaagcttgtcgtgaagcaagcactgaagacaagtgggctgaaagatgacaccacctgtgtggttgttgatatcatcccatctgatcattcttcaacacctccatcactatctccaaagaaaaaccagaacaagttgagatctcttctttttggtaggaggtcacatagttctgttggaaagcttggaaacaagtctgcttcatttgactctgtggaggaattatttgaagagggttccgcaatgttggatgaaaggttgggtaggaattttccatcaaaagcaaactcgtccccatctcgctgtgcaatctgccaagtggatcaagcaccttttgaagatttagtgacagataatggaggtggttgctgttctgccccatcgacaccatgggttggcccttatctttgttcagattgtaggaaaaagaaggatgcaatggaaggtaaaagatctagtcgctcaacagcgtgcaggtgaaattgccaataggactaactggtccttgttcgtgcaaactggtctcctggttcggttgtctgccacatgtaaaaagaggataataatctgtttgctgctggatccaagtattattggtgaaactaactgcaatctagcctgaactgaacaaattgggctactaacaatcttgggagtctatcaacagcgcagatgaaaatttctgtttgcactgggaagatagctcacaggatttcaaccccgtagttttttttttttttgaaccttagtatgtaaagtgaaatgtctagcttaacaatgtttgtaagagatggcaattggcaaggctccttgttctaccttggaatgtatatgcttgtggagccgaacagactaatttatttatctcatgctatcctaatcaatggtaatgtctttcggtgttctacgtggactga

SEQ ID NO: 3992 - DNA, 2226 bp, Sorghum bicolor
tctcactctctgatcagctgattaaaatcctcgtccccttttgccgtctctctgttcacggccctctcgccaaattcccccaaatccaagcgcgtcgccgacggcattgcgtcgccattgcctccaaatccgagtgcgactcgcgtgatcccagatcccgctcgtcgttttccccgccgtgacctctggcctgagcattttccgcgcggaaaatggcgccgtttcggccggctcttggaagggcgcttcttctgtagagccgcggcaagaggctgcgtgcgatggcagcgctcgccgccagcgaggggaatctttccccgacgctgcccctggccactctgatcggccgcgagctccgcggcgacggcaccgagcgcccgcacgtgcgctacggccactctggcttcgccaagcgcggcgaggactacttcctcgtcaagcccgactgcctccgcgtccccggagacccttcctcctctttctccgtcttcgctgtattcgacggccacaatggcgtgtcggcggcggtgttcagcaaggagaaattgctggagcacgtgatgagcgccgtgccgcagggcatcagccgcgaggactggctacaggcgctgccgcgcgcgctcgtcgcaggattcgtcaagacagacattgacttccagcgcaagggtgagacatcaggaacgacggcgacacttgttgtcgttgatgggttcacggtaactgtggcgtcagtgggggactctaggtgcattctggatacacatggaggcgaggtctcattgctgactgtggatcaccggctagaggagaatgcagaggagcgtgagcgcgttacggcgagcggaggggaggtcagccgacttaacctctgtggtggacaggaggtcggtcctctcagatgctggccgggtggattgtgcctttcaaggtccattggggatactgatgtcggcgagttcattgtaccgattccacatgtcaagcaagtgaagctcccaaatactggtggaagactaataattgcatcagatggaatatgggatgctctgtcctcagaaattgctgctcaggcgtgccggggattgcctgcagaactggctgccaaacttgttgttaagcaagctctgaagacaagtgggttgaaagatgacacaacatgtgtggttgtcgacatcatcccatctgatcattgttcaacaccaccagcattatctccaaagaaaaatcagaacaagttgaggtctcttatttttggtaggaggtctcatagttctgttggaaagctcaccaaatctgcttctttgggctctgtggaagaaatatttgaggaggggtctgcaatgttggaagaaaggttgggtagaaatttcccatcaaaagcaaatctgcccccatttcgctgtgcaatctgccaagtggaccaagaaccattcgaaggtttaatgacggacaatgtaggtggctgctgctcagccccatcaacaccatggggtggtccttatctttgctcagactgtaggaaaaagaaggatgcgatggaaggtaaaagatcgaatcgctcagcaacatgcaggtgaaagtactgataggagtcactgggtcctgtccatgcaaacttgcaaagtagtctccaatttcggttttctgctccttgtaaaaagagaagaataaaccgtttattgtttgatggaagtattgttcggtgaaactaactgcactccagcctgactgaaaatcagggtactaacaagcctgatttctattgacagcgcctatcaaactttcgtttgctctgagaagatagctgacagaacttgaagctgtagtttaaattgtgaacccgtagcatgtaaagggagttgagtagcttaacagtattttatagaacgatggtgcggctcctcattgctgctttggaatgtattttgtatggagctgaagacccatatgtttggttctatcctagtcgattctatgggcagtatttggtattttgactggactggatttccttgtatttgtcgtcctgcccgcgatcatattgttgcaactgggtggttacatatctgtaggaacgaagttctggtttcgtgtgaagttgggtgccatgaatgctgataagctggcctcttctgaatttttccttcctgcaaccgtccttcagctaacggttgtacgtctgtcagatgtgttatcgtacaagtttgaacacatttgtagctcaat

SEQ ID NO: 3993 - DNA, 2345 bp, Sorghum bicolor
acgcagctggggctgaccatgaccagtgaccaccgcactggcaaactggccggagattttgcacgaaccaccctattttctgctaaatatctcgataagatcctgcgccttctcactctctgatcagctgattaaaatcctcgtccccttttgccgtctctctgttcacggccctctcgccaaattcccccaaatccaagcgcgtcgccgacggcattgcgtcgccattgcctccaaatccgagtgcgactcgcgtgatcccagatcccgctcgtcgttttccccgccgtgacctctggcctgagcattttccgcgcggaaaatggcgccgtttcggccggctcttggaagggcgcttcttctgtagagccgcggcaagaggctgcgtgcgatggcagcgctcgccgccagcgaggggaatctttccccgacgctgcccctggccactctgatcggccgcgagctccgcggcgacggcaccgagcgcccgcacgtgcgctacggccactctggcttcgccaagcgcggcgaggactacttcctcgtcaagcccgactgcctccgcgtccccggagacccttcctcctctttctccgtcttcgctgtattcgacggccacaatggcgtgtcggcggcggtgttcagcaaggagaaattgctggagcacgtgatgagcgccgtgccgcagggcatcagccgcgaggactggctacaggcgctgccgcgcgcgctcgtcgcaggattcgtcaagacagacattgacttccagcgcaagggtgagacatcaggaacgacggcgacacttgttgtcgttgatgggttcacggtaactgtggcgtcagtgggggactctaggtgcattctggatacacatggaggcgaggtctcattgctgactgtggatcaccggctagaggagaatgcagaggagcgtgagcgcgttacggcgagcggaggggaggtcagccgacttaacctctgtggtggacaggaggtcggtcctctcagatgctggccgggtggattgtgcctttcaaggtccattggggatactgatgtcggcgagttcattgtaccgattccacatgtcaagcaagtgaagctcccaaatactggtggaagactaataattgcatcagatggaatatgggatgctctgtcctcagaaattgctgctcaggcgtgccggggattgcctgcagaactggctgccaaacttgttgttaagcaagctctgaagacaagtgggttgaaagatgacacaacatgtgtggttgtcgacatcatcccatctgatcattgttcaacaccaccagcattatctccaaagaaaaatcagaacaagttgaggtctcttatttttggtaggaggtctcatagttctgttggaaagctcaccaaatctgcttctttgggctctgtggaagaaatatttgaggaggggtctgcaatgttggaagaaaggttgggtagaaatttcccatcaaaagcaaatctgcccccatttcgctgtgcaatctgccaagtggaccaagaaccattcgaaggtttaatgacggacaatgtaggtggctgctgctcagccccatcaacaccatggggtggtccttatctttgctcagactgtaggaaaaagaaggatgcgatggaaggtaaaagatcgaatcgctcagcaacatgcaggtgaaagtactgataggagtcactgggtcctgtccatgcaaacttgcaaagtagtctccaatttcggttttctgctccttgtaaaaagagaagaataaaccgtttattgtttgatggaagtattgttcggtgaaactaactgcactccagcctgactgaaaatcagggtactaacaagcctgatttctattgacagcgcctatcaaactttcgtttgctctgagaagatagctgacagaacttgaagctgtagtttaaattgtgaacccgtagcatgtaaagggagttgagtagcttaacagtattttatagaacgatggtgcggctcctcattgctgctttggaatgtattttgtatggagctgaagacccatatgtttggttctatcctagtcgattctatgggcagtatttggtattttgactggactggatttccttgtatttgtcgtcctgcccgcgatcatattgttgcaactgggtggttacatatctgtaggaacgaagttctggtttcgtgtgaagttgggtgccatgaatgctgataagctggcctcttctgaatttttccttcctgcaaccgtccttcagctaacggttgtacgtctgtcagatgtgttatcgtacaagtttgaacacatttgtagctcaatacatttttg

SEQ ID NO: 3994 - DNA, 1604 bp, Brachypodium distachyon
gaactcgccgccgtccgcattgcgacgccattgcctccaaatacgaggaaacgtcgcgcgatctcagatccagcttcgtgccttatcctcggggtcactgagcagaccttttccgtgcaagcaatggcgtcatttgagtggcctcttggggggatgtttcttaggtagggctgcagcaggggtttgtgatggagagcgcctcaagggaggagaggctgcccccggcgctgcctctggccacgctgatcggccgcgagctccgtggcggcggctccgagcgcccgctcgtgcggtacggccactccggcttcgccaagcgcggcgaggactattttcttgtcaagcccgactgcttccgcgttcctggggacccttcctccgccttctccgtcttcgccgtcttcgacgggcacaatggcgtgtcggcggcggtgttcagcaaggagcacttgctggaggacgtcatgagcgccgtgccgcagggcatcagccgtgaagactggctgcaggtgctgcctcgcgcgcttgtcgcgggctttgtcaagacagacattgacttccagcgcaagggggagatgtcagggacgacggcaaccctggtcgtcgttgatgggttcactgttacggtagcatcggttggggactccaggtgcatcctggacactcagggtggtgtggtctcgctgctaactgtggaccacaggctggaggagaatgcagaggagcgggagcgtgtcacagcgagtggaggtgaggtcagccggctgaacctctgcggcggacagcaggtgggtcctctccgatgctggccaggtggattgtgtctttcacgatcaattggagataccgatgttggggagttcatcgtgccaattccacatgtcaagcaagtgaagctttcaaatgctggaggtaggttaataattgcatcagatggaatatgggatgcagtgtcctcggaaactgcagcacaggcttgccggggattacctgcagaactggctgcaaagctggtcgttaagcaagctctgaagacaagtggtcttaaagatgacacaacctgcgtagttgttgatatcatcccatctgaccattgttcaacaccgccaccattatctccaaataaaaatcagaacaagttgagatcccttctttttggtaggaggtcccatagttctgttgggaagcttggtaacagaaaaaagtctgcttcctttggttttgtggaggaattatttgaagagggctctgcaaagttggaagaaaggctgggtaggaattccccatcaaaagctaaattccccccatttcgctgtgcgatctgccaagtggaccaagtgccattcgaagatctaatgacagataatggaggtggttactgttctgccccatcaacaccttcggctggtccttatctttgttcagactgtaagaaaaagaaggatgcgatggaaggtaaaagatctagcccctcgactgtatgcagttgaaagtatcaattggaccgactggtctgtatccatgaaatctaggtgtggtttggttttctgatctttgtaaaaagaggagaataatctgtttattgctggattgaagtattattc

SEQ ID NO: 3995 - DNA, 1948 bp, Brachypodium distachyon
ataagaatcctttccgcacttcccgtctgttctgccttcactcgcctcgctgaattccccaaacccgaactcgccgccgtccgcattgcgacgccattgcctccaaatacgaggaaacgtcgcgcgatctcagatccagcttcgtgccttatcctcggggtcactgagcagaccttttccgtgcaagcaatggcgtcatttgagtggcctcttggggggatgtttcttaggtagggctgcagcaggggtttgtgatggagagcgcctcaagggaggagaggctgcccccggcgctgcctctggccacgctgatcggccgcgagctccgtggcggcggctccgagcgcccgctcgtgcggtacggccactccggcttcgccaagcgcggcgaggactattttcttgtcaagcccgactgcttccgcgttcctggggacccttcctccgccttctccgtcttcgccgtcttcgacgggcacaatggcgtgtcggcggcggtgttcagcaaggagcacttgctggaggacgtcatgagcgccgtgccgcagggcatcagccgtgaagactggctgcaggtgctgcctcgcgcgcttgtcgcgggctttgtcaagacagacattgacttccagcgcaagggggagatgtcagggacgacggcaaccctggtcgtcgttgatgggttcactgttacggtagcatcggttggggactccaggtgcatcctggacactcagggtggtgtggtctcgctgctaactgtggaccacaggctggaggagaatgcagaggagcgggagcgtgtcacagcgagtggaggtgaggtcagccggctgaacctctgcggcggacagcaggtgggtcctctccgatgctggccaggtggattgtgtctttcacgatcaattggagataccgatgttggggagttcatcgtgccaattccacatgtcaagcaagtgaagctttcaaatgctggaggtaggttaataattgcatcagatggaatatgggatgcagtgtcctcggaaactgcagcacaggcttgccggggattacctgcagaactggctgcaaagctggtcgttaagcaagctctgaagacaagtggtcttaaagatgacacaacctgcgtagttgttgatatcatcccatctgaccattgttcaacaccgccaccattatctccaaataaaaatcagaacaagttgagatcccttctttttggtaggaggtcccatagttctgttgggaagcttggtaacagaaaaaagtctgcttcctttggttttgtggaggaattatttgaagagggctctgcaaagttggaagaaaggctgggtaggaattccccatcaaaagctaaattccccccatttcgctgtgcgatctgccaagtggaccaagtgccattcgaagatctaatgacagataatggaggtggttactgttctgccccatcaacaccttcggctggtccttatctttgttcagactgtaagaaaaagaaggatgcgatggaaggtaaaagatctagcccctcgactgtatgcagttgaaagtatcaattggaccgactggtctgtatccatgaaatctaggtgtggtttggttttctgatctttgtaaaaagaggagaataatctgtttattgctggattgaagtattattcagtgaaactaactgtactctagcctaagctgaacaaatagggctactaacaagcttgatgtctatcagtgcggattaaattttcattcgctctgagaagatggctccagaaatttaagacctgtttttctgtacctttagcctgtaaagtgaaatggcctgcttaaaaatctttgagaaagcaacggcaaggcttctcatttctgctttggaacgtattttgtacggaaccaaatggattaaggtttgatgctatccttactgaagttccatctttta

SEQ ID NO: 3996 - DNA, 2167 bp, Secale cereale
aaggccggactacctctgtcccttctgcggttctgcctttactcccttcaccgaattccccaaaccccagctcgcggccgcccgcattgcgacgccggccccggaatacgagggcccgtcgcgtcgtctcagatccagctcggagccttccccgccggggccgccgaccagagcttttccccgcgagaaatggtgtcatttgagtgggttcttgggaagacgcttcttcggtaggactgcagcagggggctgtgatggagagcgcctccaatgaggagatgctgcccccggcgctgcctctggcgacgctgatcggccgcgagctccgcggcggcggctccgagcgcccgctcgtgcggtacggccactccggcttcgccaagcgcggcgaggactacttcctggttaagcccgactgcctccgcgtccccggcgacccttcctcggccttttctgtcttcgccgtgttcgacggtcacaatggcgtgtcggcggcggtgtttagcaaggagcacttgctcgacgatgtgatgagcgccgtgccgcagggtatcaaccgcgaggactggctgcaggtgctgccgcgcgcgcttgtggcgggcttcgtcaagacagacattgacttccagcgcaagggggaaatgtcagggacgacggcgacgttggtcgtcatcgatggattcacagtgaccgtggcgtcagtcggagactccaggtgcatccttgacactcaaggtggtgtggtctctctgctgactgtggaccataggctagaggagaatgcagaggagcgggagcgtgtcaaggcgagtggaggggaggtcagccggctgaacctctgcggtggacagcaggttggccctctccgatgctggccaggtggactgtgtctttcaagatcaattggggataccgatgttggggagttcatcgtgccaattccacatgtcaagcaagtgaagctctctagtgctggaggaaggctaataattgcatcagatggaatatgggatgcagtgtcctcagagattgcagcacaggcgtgcagaggtttgcctgcggaattggctgcaaagcttgttgttaagcaagctctaaagacaactggactgaaagatgacacaacttgtgtagttgttgatatcatcccatctgatcattgttcaacaccaccaccattgtctccaaagcaaaatcacaacaagttgaggtctcttctttttggtaggaggtcccatagctctgttggaaagcttggtaaaaaaaaaagtctgcttcatttggatttgtagaggaattatttgaagaaggctctgcaatgttggaagaaaggttgggtaagaattccctgtcaaaagcaaatttgcccccatttcgctgtgcgatctgtcaagtggaccaagtgccattcgaggatttaataacagatgatgggggaggttactgctctgccccgtcaacaccatcgagcggtccttatctttgttccggctgtagaaaaaagaaggatgcaatggaaggtaaaagatctagtcgctcgactgcatgcacttgaaagtaccaatagcactgactggtgctcgtccatgagaactagtattctggctcagttttctgctctatgtgaagagagagaataactgtgttctggcctgaactgaagaattatttgggtgaaactaactgtgttctggcactaattgggccactaacaagcttggtgtctatcgagagcgctgatgaagtttccatttgctctgagaagatggctcccagaaattcagcactaggttttctgtgtaccttagcctgtaaagtgaaatgactagcttaaaactgtttcaggaagcgacggcaaggctcctcgttgctgctttgaaatgtaccttgtatggaaccgaactgactagtgtttgatgcccatccttatcgaggctaccactgcattctgggttggtttttgttgtgcttgtcatgtaatttcactactaaatctgatcagcagggagacagtggcgcaacttgtctgggggtaagataaaactcttgactggagattgattgatctcataacccaaatgctgtaacaattaaaagtaaaaaaaaaaaaaaacaaaaaaataaaaactctctgtagtacaactacactctacttactcgtgtcgta

SEQ ID NO: 3997 - DNA, 3430 bp, Brachypodium distachyon
aactagattggcatgtacttaaaagggcacttactttattttaggattctacaatgaaatcctaaatttgctagcaattctactagaccgaaacaaaagcggaaccctcaaattcttttttgaaattaaactaagcgcgctattctaaatcgaagtaaagtcaacaaactctctagtgtattatattacggctttatcgcattcatagaaaggagataaaatgagaaatctttgccattcaatctgagaatatcataaagtataagttataagtggcataatttttttataagaatgttttatcaattcattttcattccatttgtacccctggcaaattagaactttcgtcgaaattgtctctattcatatgtatgaaatacatatatgaaatacgtatgtggagttccctagaatttcatgtgattcagtaaacagaatatagattccatgattgctagatcgatccgtaggggttgatgaagagtgagctgataatggaatttttcttcgataaacaggaaacttaagattaagatgctccggaatgggaatgagggaatgtccacaatacccggatttagtcagatccaatttgagggattttgtaggttcattaatcaaggcttggcagaagagcttgagaagtttctaacaattaaagatccagatcacgaaattgcatttcaattatttgcgaaaggatatcaattgctagaaccctcgataaaagaaagggatgctgtgtatgaatcactcacctattcttccgaattatatgtatctgcgagattaatttttggtttcgatgtgcaaaagcaaaccatttctattggaaacattcctataatgaattccttaggaaccttataataaatggaatataccgaattgtgatcaatcaaatattgctaagtcctggtattactaccgctcggaatagaccataagggaattctatctacaccgggactataatatcagattggggagggagatcggaattagcaattgataaaaaagaaaggatatgggctcgcgtgagtagaaaacaaaagatatctattctagttctatcatcagctatgggttcgaatctgagagaaattctagataatgtttcctaccctgaaattttcttgtctttcccgaatgctaaggagaagaagaggattgagtcaaaagaaaaagctattttagagttttatcaacaatttgcttgtgtaggtggggacctggtattttcggagtccttatgtgaggaattacaaaagaaattttttcaacaaaaatgtgaattaggaaggattggtcgacgaaatatgaatcggagactgaatcttgatatacctcagaacaatacattcttgttaccacgagatgtattggccgctacggatcagttgattggaatgaaatttggaacgggtatacttgacgatgacgatatgaatcacttgaaaaataaacgtattcgttcggttgcagatctgttacaagatcaattcggactggctcttggtcgtttacaacatgcggttcaaaaaactatccgtcgagtattcatacgtcaatcgaaaccgactccccatactttagtaactccaacttcaacttcgattttattaataactacttatgagaccttttttggcgcataccccttatctcaagtttttgatcaaacgaatccattgacacaaactgttcatgggcgaaaagtgagttgtttaggtcctggagggttgactgggagaactgcaagttttcggagccgagatattcatccgagtcactatgggcgtatttgtccaattgacacgtccgaaggaatcaatgttggacttactggatccttagcaattcatgcgaaaattgatcacttgtggggatctgtagagagtccgttttatgaaatatctgctgagaaagcaaaagaaaaaaaagagagacaggtggtttatctatcaccaaatagagatgaatattatatgatagcagcaggaaattctttatccttgaatcaaggtattcaggaagagcaggttgttccagctagatatcgtcaagaatttctgactattgtatgggaacagattcatgttagaagtatttttcctttccaatatttttctattgggggctctctcattccttttattgagcacaatgatgcgaatcgggctttaatgagttctaatatgcagcgccaagcagttccgctttctcggtccgagaagtgcattgttggaactggattggaacgccaaacagctctagattcgagggtttccgttatagccgaacgcgagggaaagatcatttctactgatagtcataggatccttttatcaagtagtgggaagaccataagtattcctttagtaaaccaccggcgctctaacaaaaatacttgcatgcaccaaaaaccgcgggtgccgcggggtaaatccattaaaaaaggacaaattttagcagagggagctgccacagttgggggggaacttgctttaggaaaaaacgtattagtcgcttatatgccatgggaaggttacaattttgaagacgcggtactaattagcgaacgtttggtatatgaagatatttatacctcttttcacatccgtaaatatgaaattcagacggatacgacaagtcaaggctctgctgaaaaaataactaaagaaataccacatctagaagaacatttactccgcaatttggacagaaatggagttgttaggttgggatcctgggtagaaactggcgatattttagtaggtaaactaacgcctcagatagcgagcgaatcgtcgtatatcgcggaagctggattattacgggctatatttggccttgaggtatccacttcaaaagaaacttctctcaaattacctataggtggaagagggcgcgttatcgatgtgaaatggatccagagggaccccctcgacataatggttcgtgtatatattttacagaaacgtgaaatcaaagttggggataaagtagccggaagacatgggaataaggggatcatttccaaaattttgactagacaagatatgccctatttgcaagatggaacacctgttgatgtggtcttcaatcccttaggagtaccctcccgaatgaatgtgggacaaatatttgaaagctcgctcggattagccggggatctgctaaagaaacattatagaatagcaccctttgatgagagatatgagcaagaggcttcaagaaaacttgtgttttcagaattatatgaagccagtaaggaaacaaaaaatccatgggtatttgaacccgagtacccgggaaatagcagaatatttgatggaagtacaggagaccccttcgaacaacctgttctaatagggaagtcctatatcattaaaattaattcatcaagttgatgagaaattcatgg

SEQ ID NO: 3998 - DNA, 9734 bp, Cajanus cajan
ataaatggggaaagtgaaaatccttgggggtggaaatgcgggaatgtctacaatacccgggttgaatcagatacaaattgaagggttttgtaggttcattgatcagggcttaacagaagaactttctaagtttccaaaaattgaagatacagatcaagaaattgaatttcaattatttgtggaaacatatcaattggtagaacccttcataaaagaaaaagatgctgtatatgaatcactcacatattcctctgaattatatgtatccgcaggattaatttggaaaaccagtagggatatccaagaacaaacgatttttattggaaacattcctctaatgaattccctgggaacttctatagtaaatggaatatacagaattgtaatcaatcaaatattgcaaagccccggtatctattaccggtcagaattagaccataacggaatttcggtctatactggcaccataatatcagattgggggggaagattagaattagagattgatagaaaagcaaggatatgggctcgtgtgagtaggaaacagaaaatctctattctagttctatcatcagctatgggttcgaatttaagagaaattctagagaatgtttgctaccctgaaatcttcttgtctttcctgaacgataaggagaaaaaaaaaatagggtcaaaagaaaatgccattttggagttttatcaacaatttgcttgtgtgggtggagatccggtattttctgaatctttatgtaaggaattacaaaaaaaattttttcaacaaagatgtgaattaggaagaattggtcgacgaaatatgaaccgaaggctgaatcttgatatacctcagaacaatacatttttgttaccacgagatatattggcagctgcggatcatttgattggaatgaaatttggaatgggtacacttgacgatatgaatcatttgaaaaataaacgtattcgttccgtagcggatctcttacaagatcaatttggattggctctggttcgtttagaaaatatggttaaaggaactatatgtggagcaattagacataaattgataccaactcctcagaatttggtgacttcaactccattaacaaccacttatgaatctttttttggattacacccattatctcaagttttggatcgaaccaatccattgacacaaatagttcatggtagaaaattgagttatttgggccctggaggattgacagggcgaactgctagttttcggatacgagatatccatcctagtcactatggacgcatttgcccaattgacacgtctgaaggaatcaatgttggacttatcggatccctagcaattcatgcgaggattgtgcattgggggtctatagaaagtccattttatgaaatttccgaaagatcaaaaagaatacggatgctttatttatcaccaagtagagatgaatactatatggtagcgacaggaaattctttggcgctgaatcgaggtattcaggaggaacaggttgttccagctcgataccgtcaagaatttctgactattgcatgggaacaggttcatcttcgaagtatttttcccttccaatatttttctattggagcttccctcattccttttatcgagcataatgatgcgaatcgagctttaatgagttctaatatgcaacgtcaagcagttccgctttctcagtccgaaaagtgcattgttggaactggattggaacgccaagtggctctagattcaggggttctcgctatagctgaacacgagggaaagatcatttataccgacactgacaagatcattttatcgagaaatggggatactctaagcattccattaattatgtatcaacgctccaacaaaaatacttgcatgcatcaaaaaccccaggttcagcgaggtaaatgcattaaaaagggacaaattaaagggacaaattttagcggatggtgctgctacagttggcggcgaactcgctttgggaaaaaacgtattagtagcttatatgccatgggagggttacaattctgaagatgctgtactcattagtgaacgtctgatctatgaagatatttatacttcttttcacatacggaaatatgaaattcagactcatgtgacaagtcacggtccggaaagaatcactaatgaaataccacacctagaagcccatttactccgaaatttagacaaaaatggaattgtgatactgggatcttgggtagagacgggcgatattttagtaggtaaattaacgcctcaaatggcgaaagaatcctcgtatgccccggaagatagattattacgagctatacttggcattcaggtatccacctcaaaggaaacttgtctaaaactacctataggtggtaggggtcgagttattgatgtgagatggatccagaaaaaggggggttctagttataatccagaaacggttcgtatatatatttcacagaaacgtgaaatcaaagtaggtgataaagtggctggaagacatggaaataaaggtatcgtttccaaaattttgtctagacaagatatgccttatttgcaagacggaagacccgttgatatggtcttcaatccattaggggtaccttcgcgaatgaatgtaggacagatatttgaatgctcactcgggttagcggggggtatgttagatagacattatcgaatagcaccttttgatgagagatatgaacaagaggcttcgagaaaactagttttttctgaattatatgaagccagtaagcaaacagcgaatccatggatatttgaacccgagtatccgggaaaaagcagaatatttgatggaagaacaggggatccttttgaacaacctgttataataggaaagccttatatcttgaaattaattcatcaagttgatgataaaatacacggacgttccagtggacattatgcacttgttacgcaacaaccccttagaggaagggccaagcaagggggacaacgggtaggagaaatggaggtttgggctctagagggatttggtgttgctcatattttacaagagatgcttacttataaatcggatcatattagagctcgccaagaagtactcggggctacgatcattggaggaacaatacctaaacctgaggatgctccagaatcttttcgattgcttgttcgagaactacgatctttggctctggaactgaatcatttccttgtatctgagaagaacttcgagattcataggaaggaagcttaatcggaatgaatcataatttttcttctatgattgatcagtataaacatcaacaactccgaattggatcagtttctcctcaacaaataagtgcttgggccaataaaatcctacctaatggagagatagttggggaggtaacaaaaccctatacttttcattacaaaaccaataagcctgaaaaagatggattattttgtgaaagaatttttgggcctataaaaagtgggatttgtgcttgtggaaattatcgagtaatcggagataagaaagaagacccaaaattttgtgaacaatgcggagtagaatttgttgattctcggatacggagatatcaaatgggctatattaaactggcatgcccagtaacccatgtgtggtatttgaaacgtcttcctagttatatcgcgaatcttttagataaacctcttaaagaattagagggtctagtatattgcgatgtggggagatcctattggatcctatccaaatttttcgtttgctaggcccgtagttaaaaaacctactttcttacgattacgaggttcattcgaatatgaaatccaatcctggaaatacagcatcccacttttttttactacccaaggtttcgatacatttcgaaatcgagaaatttctactggagcaggtgctatccgagaacaattagccgatctggatttgagaattattattgattcctcgttggtagaatggaaagaattaggggaagagggatccacgggcaatgaatgggaagatcgaaaagttggaagaagaaagaattttttggttcgacgcatggaattagctaagcattttcttcgaacaaatatagaaccagaatggatggttttatgtctattaccagttcttcctcccgaattgagaccgattattcaaatagatgggggtaaactaatgagctcggatattaatgaactctatcgaagagttatctatcggaacaatactcttatggatctattaacaacaagtagatcgacgccaggggaattagtaatgtgtcaggagaaattggtacaagaagccgtggatacacttcttgataatggaatccgcggacaaccaatgagggacggtcataataaggtttacaagtcgtttgcagatgtaattgagggcaaagagggaaggtttcgcgagactctgcttggcaaacgggttgattattcggggcgttctgtcattgtcgtaggtccttcactttcattacatcgctgtggattgccccgcgaaatagcaatagagcttttccagacatttgtaattcgcggtctaattagaaaacattttgcttcaaacataggagttgctaagagtaaaattcgggaaaaagaaccgattgtatggcaaatacttcaagaggttatgcaagggcatcccgtattgctgaatagagcgcctactctgcatagattaggcatacaggcgttccaacccattttagtggaaggacgtgctatttgtttacatccattagtttgtaagggattcaatgcagactttgatggggatcaaatggctgttcatgtgcctttatctttggaggctcaagcagaagctcgtttacttatgttttcccatatgaatctcttgtctccggctattggggatcccatttccgtaccaactcaagatatgcttattgggctttacgtattaacgagcgggaatcgtggaggtatttgtgcaaacaggtataatccatgtaatcgcagaaattataaaaatgaaagaattaacgataataactataagtatacgaaagaaaaagaactttttttttgtaattcctatgatgcaattggagcttatcgacagaaaagaataaatttcgatagtcctttgtggcttcggtggcgactagatcaatgcgttatttcttcaagagaagttcctatcgaagttcactacgaatctttgggtacctatcatgagatttatgggcactatctagtagtaagaagtataaaaaaagaaatgcgttgtatatacattcgaaccactgttggtcatatttctttttatcgagaaatcgaagaagctatacaaggcttttgcagagcctattcatatggtatctaatcatatagatcgtatctaagctaagtaaatttatgatatcggtgtaaattcgggtttctccggttcaactaggatcatagttttaaaaatttctacacgaatcaagatgaagaaaaggaagttttccaatcattgactcaaacccattgtcgaaccgaatcccactgagtggaatatggaggtacttatggcagaacgggccaatctagtctttcacaataaagtgataggtggaactgccattaaacgacttattagcagattaatagatcacttcggaatggcatatacatcacacatcctggatcaagtaaagactctgggtttccggcaagctactgctacatccatttcattaggaattgatgatcttttaacaataccttctaagggatggctagtccaagatgctgaacaacaaactttattttggaaaaacatcaccattatgggaatgtacatgcggtagaaaaattacgtcaatccattgagatatggtatgctacaagtgaatatttgcgacaagaaatgaatcctaattttaggatgactgacccttttaatccagtccatataatgtctttttcgggagctagaggaaatgcatctcaagtacaccaattagtaggtatgagaggattaatgtcggatccacaaggacaaatgattgatttacccattcaaagcaatttacgcgaagggctatctttaacagaatatataatttcttgctacggagcccgtaaaggggttgtagatactgctgtacgaacatcagatgctggatatcttacacgcagacttgttgaagtggttcaacacattgttgtacgtagaacggattgtggcaccattcgagggatttctgtgagtcctcggaataggaggatgccggaaagaattttgatacaaacattaattggtcgtgtattagcagacgatatatatataggttcacgatgcattgccattcaaaatcaagatcttgggattggacttgtcaaccgattcataacctttcaaacacaaccaatatctattcgaaccccctttacttgtaggagtacatcttggatctgccgattgtgttatggccggagtcctactcatggcgacctggtggaactgggagaagctgtagggattattgcgggtcaatctattggagaaccgggcactcaactaacattaagaacttttcataccggcggagtattcacagggggtactgcagaacatgtacgagccccttctaatggaaaaataaaattcaatgaggatttggttcatcctacacgtacacgtcacgggcatcctgcttttctatgttatatagacttgtatgtaactattgaaagtgaagatattatacataacgtgactattccaccaaaaagttttctattagttcaaaacaatcaatatgtagaatcagaacaagtgattgctgagattcgcgcgggaacatacactttgaattttaaagagagggttcgaaaacatatttattctgcctcagagggagagatgcattggagtaccgatgtgtaccatgcacccgaatttacatatagtaatgtccatatcttaccaaaaacaagtcatttatggatattatcaggaaggtcgtgcaggtccggtgcaatctctttttcactccacaaggatcaagatcaaatgagcattcattctctttctgccggaggaagatatatttctaaccttgtagtaagtaatgatcaagttcaagtaagacacaaattctttagttcaaatccttctggtaaaaaaaaaagtgggattcctgattattcagggcttaatcgaatcatatgtataggtcattttaatttcatatattctgctattctccacgataattcggatttattggcaaagaggcgaagaaatagattcatcattccattccaatcgattcaagaacgagacaaagaactaatgcccccttccggtatctcgattgaaatacctatcaatggtatttttcgtagaaatagtattcttgcttatttcgatgatcctcaataccgaaaaaagagttcaggaattactaaatataggactataggagttgattccattttcaaaaaagaggatttaattgagtatcgaggagtcaaagaattgaagccaaaataccaaatgaaagtagatcgattttttttcattcccgaggaagtgcatattttacctgaatcttcttccataatggtacagaacaatagtatcattggagtagatacaccaatcactgtcaatataagaagtcgagtaggcggattggttcgagtggagaagaaaaaaaaagggattgaattaaaaatattttctggggatatctattttcctggagagatggataagatatcccgacacagtggcatcttgataccactcggaacggtaaaaaaaaaaaattctatggaatccaaaaaattcaaaaattggatctatgtccaatggatcacacctaccaagaaaaagtattttgttttggttcgacccgtaattatatatgaaatagcggacggtataaatttagtaaaacttttcccccacgatctgttgcaggaaagggataatctggaacttaaagttgtcaattatattctttatggaaatggaaaacaaattcagggaatttctgacacaagcattcaattagttcggacttgtttagtcttgaattgggatcgagacaaaaaaagttcttctatcgaagagacccgcgcttcctttgttgaagtaagtacaaatggtttgattcgagatttcctaagaatggacttagtgaaatcccatatttcgtatatcagaaaaaggaatgatctgtccggttcaagattgatcgctgataatgagtcagatcgcaccaaaatcaatccatttttttctatttattccaaggcaaagattcaacaaccacttagccaaaatcacggaactattcggatgttgttgaatagaaataagaaatgccgatcttttataattttgtcatcatctaattgttttcaaatacgatcattcaatgatgtaaaatattacaatgggataaaagaagaaattaatcaaattcaaagagatcttataattccaattcataattcgttaggccctttaggactaacctttcaagttgcaaagttttattcattttaccgtttaataactcataatcagatctcgataactaaatatttgcaacttgacaatttaaaggaaacttttcaagtatttaaatattatttaatagacgaaaacgggagaatttataaacccgatctatgtcgtaacattgttttgaatccattccattttaattggtattttctccatcataattatcagcataattattgtgaaaaaacatttacaataattaaccttgggcaatttctttgtgaaaatgtatgtatagctaaaaacggacaacacctaaaatcgggtcaagttctaattgttcaaattgattctgtagtaataagatcggctaacccttatttggcgactccaggagcaactgttcatggccattatggagaaatactttctgaaggagatatattagttacatttatatatgaaaaatcgagatctggtgatataacacagggtcttccaaaagtggaacaggtattagaagtgcgttcgattgattcaatatcgatgaacctagaaaagagagttgagggttggaacgagcgtataaccaaaattcttggcattccctggggattcttgattggtgctgagctaactatagtgcaaagtcgtatttctttggttaataagatccaaaaggtttatcgatcccagggggtgcagatccataatagacatatagaaattattgtgcgtcaaataacatcaaaagtcttggtttcagaagatggaatgtctaatgttttttcacccggcgaactaattggattgttgcgagctgaacgaacgggacgcgctttggatgaagcaatctgttaccgagccctattattgggaataacgaaaacatctctgaatactcaaagttttatatccgaagcgagttttcaagaaactgctagagttttagcaaaagccgctctccgaggtcgcatagattggttgaaaggtctgaaagagaacgttgttttaggggggacgatacccgttggtaccggattcaaaagattaatgcgccgttcaaggccaaggcaacataagaagattaccttggaaaaaaaaaaattggagggagaaatgagagatattttgttccaccacagagaattatttgattttttcatttcaaagaatttatgtgatacatcagagcaatcatttcgaggatttaatcattcctaagagcggattcatccc

SEQ ID NO: 3999 - DNA, 2364 bp, Zea mays
ctagagccggcctaccgcggggtacgtggcgacacctctcctgcaacgtgtccggcgcggacgacaggcatcgccgtcgccgtcacccaatggcctcggtgtccgtcgtgctgctacagcgctcctcctcgcgcgtccgaggatatatacggctccagcgcatcgccagctcttcagttacgttggttttggagggcgaggggcattggtggtggagcaacagccgcggccgcgacgagaggtttggcgcaagaacggtgcaccatatggcgggatcagtagagggggaaaacggcggcgtgccggtgggtggtcaagttgcgatggcgccgggcgtggtgaccggcggtgtggaggatgcctatggcgaggaccgcgcgaccgaggaccagactgtcacaccgtgggccgtctgcatcgcaagtggtcactccctgctgagggatccaaggcacaacaaagggctctctttcacggagaaagagcgggacacgcactacctgcgaggattattgcctccggtagtgctatctcaggacctccaggagaagaggatgttgcagaatgttaggcagttccaggtcccgttgcagcgctacactgcgctaatggaccttcaggagagaaatgagaggctattttacaagctcttgattgacaatgtcgaagaactgcttcctgttgtgtatacaccaacagtgggggaagcttgccagaagtatgggtcgatcttcagacgaccgcagggtttatacatcagcctcaaggagaagggaaggatcttggaggtactgaggaactggacagagaagagtattcaggttattgtggtcactgatggtgagcgcattttaggcctgggagatcttggttgccagggcatgggaattcctgtggggaagcttgcactgtatactgctcttggaggtgtacggccatccgcttgcttacctattaccattgatgtgggaacaaataatgaagacctactgaaggatgaattctacattggcttaaagcaaagaagagcaactggccaggaatactctgaatttctggatgagtttatggccgcagttaggcagaactatggacaaaaagttcttgtccagtttgaggactttgcaaaccacaatgcatttacacttcttgagaagtacaggacaaaccatcttgtatttaatgatgatatccagggcacggctgctgtagttcttgcagggattattgctgctctgaagtctgttggtgggactctagctgatcatacattcttgttcttcggtgcaggagaggctggtacgggcattgctgaactagttgctctcgagatatccagacaggcaaatgtttcagtagaagaggctcgcaaaaagatctggctggttgattcaaagggactaattgtggcctcacgtgaagagactctccagccatttaagaagcgatatgcacatgagcatgaacctgtcaaagatcttttaggtgctgttaaggctatcagaccaactgcactcataggatcagctggtgtaggtcaaagtttcactaaagaggtgattgaggttatgtcttcgattaatgagagacccattgtccttgctctatcgaacccgacgtcacagtctgaatgtactgctgaacaagcatatacatggagtcaggggcgtgccatatttggcagtggaagcccatttgatccggtgaaatataatgacaagctgtttgtgcctgcccaggcaaacaatgcatacattttccctgggtttggtctaggggtggtgatctcaggagccgtccgggtgtcagacgatatggttcttgctgctgctgaagcactagcggaacaggtaaccccggagcatattgagaaaggcctgatctacccgcccttctccatcatcaggaagatttcagctaacatagctgcccatgtcgccgcaaaagcttatgatctcggaatggctacccagctccctcggccaaaagacctggtgaagtacgctgagagctgcatgtacagccccgtctaccgatcgtacaggtgatgtgagcggacagtgctggatgcacctgaggatatatatgcatacctgctatgcttgttgttcatgtcgtcactgtgacgagtccgctgctgatactgcacgtgcgtactctatgtatgtagctgtgtaataaagttcaggggatgtaaattgacactcctaccaagtatgctgatgtatgttctcatgcgtgtcggggtttcttatacatggtttgtgttagatttagtatgaagatgacctctattttatttgatacaaatcgaataaattgtaggtttatattaaggccatgttcgtttttcttctaggatta

SEQ ID NO: 4000 - DNA, 2137 bp, Pennisetum glaucum
cgagctgaacaacggcgtcgtcaccggcggcgtggaggacgcctacggcgaggaccgcgccaccgaggaccagccggtgacgccgtgggccgtctgcatcgcaagtggtcactccctgctgagggatccaagacacaacaagggtctctccttcacggagaaagagcgggatgctcactacctcagagggttgttgcctcctgtagtgctatcacaggatctccaggagaagaggatgctgcagaacgttcggcagttagaggtcccattgcagcgttacatggccttaatggaccttcaggagaggaatgagagactattttacaagctcctgattgacaatgtggaggaactgcttcctgttgtgtatacacctacagttggggaggcttgtcaaaagtatgggtcgatcttcagacgaccccagggtttatacatcagcctcaaagagaaggggagaatattggagatactgaggaattggccagaaaagagtattcaagttattgtcgtcactgatggtgaaagaattttgggtttgggagatcttggctgccagggcatgggaattcctgtgggaaagcttgcactgtacactgctcttggaggtgtccggccatccgcttgcttgcctattaccatcgatgtgggaacaaataatgaagatctactaaaggatgagttctacattgggttgaagcaaagaagagcaactggccaggaatactctgaacttcttgatgagttcatgacagcagttaggcagaactatggacagaaggttcttgttcagtttgaggattttgcaaaccacaatgcatttacacttcttgagaagtacagggaaaaccatcttgtatttaatgatgatatccagggaactgctgcggtagtacttggagggcttattgctgctctcaagtctgttggtggcactctagccgatcacacattcctgttctttggtgcaggcgaggctggcacaggcattgctgagctagttgctctggagatatccagacaggccaaagtttcagtagaagaggctcgcaaaaagatctggcttgttgattcaaagggactggttgtgacctcacgtaatgagactcttcagccgtttaagaaacgatatgcacatgagcacgaacctgttaaggatctcctaggtgctgtcaaggcaatcaaaccaactgctctaataggatcagctggtgtgggtcaaagtttcacaaaagaggtgattgaggctatgtcttcgattaatgagaggcctatcatcctcgctctatcaaacccaacgtcacagtctgaatgtactgccgaacaggcatatacatggagtcagggccgcgcgatatttggaagtggaagcccatttgacccggtgaagtataatgacaagctgtttgtgcctgcccaggcaaacaatgcatacattttcccgggatttggtctaggtgtggttatctcaggggcggtccgggtgacggacgatatggttcttgctgctgctgaaggactagctgaccaggtaaccccggagcacatcgacaaaggcctcatctacccacccttttccatcatcaggaagatatcagccaacattgctgcccgcgttgccgcaaaagcctacgatcttgggttggctagccagctccctcgcccaaaggacctggtgaagtacgccgagagctgcatgtacacacctgtctaccgatcttacagatgaagggcgacagtgctgagttgctgacactggatggattgtgtacaactccgctttgaggaatggtgtattgctgatcttactgtggtatctactgctgagccgctatgcttccttgtgaattgtgataaaatgtgtggtaaagctcgctattagggagccggttatgcttgttcgtatgtaattgtatgtagtcgtgtaataaagttcacggggatgtagaatgtattcctacgaagtatatgtgatatggacatatggttgttgggaacactgcttctcccctctttcaactctttgatagcagcatggatgacaaattgacaacgacaccagcaacacgtataacaaaattatattagctgctacttgcaactgctgccacaaacggcaaactctgaacgctgccac

SEQ ID NO: 4001 - DNA, 3025 bp, Panicum virgatum
ggctgttgcagcggtggtggtgttgctgttgcagcggcggcgggaggtttggcgcgagaaaggcgcacggtatggcggcatcaggggagggggacaaccgcaacggcgtcgtgaccggcggcgtggaggacgcctacggcgaggaccgcgccacagaggaccagccagtcacgccgtgggccgtctgcgtcgcaagcggtcactccctgctgagggatccaaggcacaataaggggctctccttcacggagaaagagcgggacgcgcactacctgagaggattgttgccgccggtagtgctatcacaggatctccaggagaagaggctgctgcagaatgttcggcagtttgaggtcccgttgcagcgttacatggccttaatggaccttcaggagagaaatgagagactattttacaagctcctgatcgacaatgtggaagaattgcttcctgttgtgtatacaccaaccgtgggggaggcttgccagaagtatgggtcgatcttcagacgaccccagggtttgtacatcagcctcaaagagaaggggaggatattagaggtattgaggaattggccagagaagagtattcaagttattgtcgttactgatggtgagagaattttaggcttgggagatctcggctgtcagggcatgggaattcctgtggggaaacttgcactgtatactgcacttggaggtgtccggccgtccgcttgcttgcctatcaccattgatgtgggaacaaacaatgaagatctactaaaggatgagttctacattgggttaaagcaaagaagagcaactggccaggaatactatgaacttctggatgagttcatgacagcagttaggcaaaactatggacagaaggttcttgtccagtttgaggactttgcgaatcacaatgcatttacacttcttgagaagtacagggcaaatcatcttgtatttaatgatgatatccagggaactgctgccgtagtacttgcagggcttatagctgctctgaagtctgttggtggcactctagccgatcataaattcctgttctttggtgcaggagaggctggtacaggcatcgctgaactagttgctctggagatatccagacagggaaaggtctcggtagaagaggctcggcaaaagatctggcttgttgattcgaagggactggttgtggcctcacgtaatgagattcttcagccattcaagaaacgatacgcacatgagcatgaacccgttaaggatctcttggacgctgtcaaggccattagaccaaccgcgctaataggatcagctggtgtgggtcgaagtttcacaaaagaggtgattgagactatgtcttcgattaatgagagacccatcatcctcgctctatcaaacccaacgtcacagtctgaatgtactgctgaagaggcatatacatggagtcagggccgtgcgatatttgggagtggaagcccgtttgacccggtgaagtataacgccaagctgtttgtgcctgcccaggcaaacaatgcatacattttcccggggtttggtctaggtgtggtgatctcaggagcggtccgggtgacagatgatatggtccttgctgctgctgaaggactagctgaccaggtaacccccgagcatattgacaaaggcctcatctacccacccttttccatcatcaggaagatatcagccaacatcgctgcccgtgttgctgcaaaagcctacgacctcgggttggctagccagctccctcgcccaaaggacttggtgaagtacgctgagagctgcatgtacacccctatttaccgatcttacagatgaaggacgataatgccgagttgcagacattggacgaactctgtacgactccactcgaagaactgcgtatgcaactattgttaaatgtctggcaaagttcggtagtaaatagcccatccagcttgttcatatgttcagtagtcgtgtaatgaagttcatggggctgtacaacatatttctacgaagcatatgaatatgagagcgtatgtgacatgagttggtaatgcagttttcgcgtagcaggtgtatacttacatttggatagatagtgaagttacgcataacgtagtgaagtttcgcagaacgcgctgttgcatcaccaccgccctctcgcagcacgttgaggttctttcatatacaaaatctgcaggacattgttcgggtcacttcttcattctatcaactctctgatagaagcatggatgacaatgaagccagcaacaagtataacaaagctaccatctggatgactggatcccttttgctattgccaaaatttcgccacaagtataacaaaactagctgctacttgctgctgccacaacccatgaaatatgcacagcactgtaaaatatgcactcccacaagtagcatggtttctttacaactctttcctttcgcaatccaactttttttttttgctgaaaactctttccctttgtatttgtaggaagtagcagggcaaattgcatcttgcaatgaagagagggcagaagtacttgggttgctgcaagccactgtcacgaaagtcatacatggatgatctgatctgatctgatcagacctgtcttgactcttgattgcgtatcatcagaaatttgggaggtgcgtatcctccagaaagattttggatgcaggttcttcttgtcagctctgaacagccagcctatgttggactcgcaggaagcacacagtgcaatcgtccatgtgtatcctggaaaccagctgtgaattttggacgggtcaccacgcagtgcaaggtttgtgacactgtgtactgtaatcaactctttcacagaactgtaagaaccaatagcgtcggagctggatatcatcaccatgtcgcttcgtcttgcaatagaagtcagacaaattctgcatcgtatgatattgaaagctttgagaagctgaatctctcgctgtagtcgatatgagattccatcaatctcaagtaattcttgccttagagatatgagatcggaagattg

SEQ ID NO: 4002 - DNA, 2405 bp, Oryza sativa
gggcggcggcgtcatcgtggcctcggcgcccgccgcgcggcgcgcgggcgcgctcctatgtacgctgctggcacggggctcctccaggcctccagctactacgcgtcgtggcttctcgcgctgcattccgagagacgacgaagcggtggtggtggtggcggcggcgctgcaggcaaggcgcgaggacggtgagcggcatggcggggcgaggagaggggaacggcgctgcgacgatggcgggggtggccaccggtggcgtggaggacgcctacggcgaggaccgcgccaccgaggaccagcccatcacgccgtgggccgtctgcgtcgccagcggtcactctctgctgagggatccacggcacaacaaggggctatcattcacggagaaagagcgagacgcccactacctgcggggtttgctgcctccagtcgtgctctcccaagaacttcaggagaagaggcttctgcaaaatgtgcggcagtttcaggttcctctgcaacgttacatggctctgatggaccttcaggagaggaatgagaggcttttctacaagctcctgatcgacaacgttgaggaattgctccccgttgtgtacacgccgacggtgggcgaggcttgccagaagtacgggtcaatctttagacgaccacagggtctgtacatcagtcttaaagagaaggggagaatattggagttactgaggaactggccagagaagagcattcaggttattgttgttactgatggtgagcgcattttaggtctcggggatcttggttgccagggtatgggaatccctgtgggaaagcttgcactatacacagcccttggaggtgtccggccttctgcttgcttacctatcaccattgatgtgggaacaaacaatgaggatttactgaaggacgagttctacattggattaagacaaaaacgagccactggccaggaatatagtgatcttctggatgaattcatggctgctattaagcagaactatggacagaaggtgctagtccagtttgaagacttcgcaaattacaatgcatttacccttcttgagaagtaccgtgcaaacaatcttgtcttcaatgatgatattcagggaacggctgctgtagtgcttgcaggcctcattgctgctcagaaatttgtcagtgggactttagctgatcacacattcttattctttggcgcaggagaggctggtacaggcattgctgaactagtggctctcgagatatcaaatcagtccaaagttccagtggaagatgctcgcaaaaagatctggctacttgattcaaaggggttgattgtcagttcacgtaaagattctcttcagccctttaagaagcgatatgcccatgagcatgaaccagtcaaagatctactggatgctgttaaggttatcaaaccgactgcattgataggttcagctggtgtgggtcaaagtttcacaaaagaggtgattgaggctatgagttcaattaatgagagaccaatcatcctcgcactatccaatccaacatcacaatctgaatgtactgctgaacaggcatattcatggagtaagggccgtgcaatatttgggagtggaagtccatttgatccagttaaatacaatgacaagcttttcgtgcctgcacaggcaaacaatgcatatatattcccaggatttggcctaggcgtagtgatttcaggagcgataagggtgaaagatgaaatgatccttgctgctgctgaaggcttagctgaccaggtgaccccagagcatgttgacaaaggccttatttatccacccttttcctgcatcaggaagatatcagccaacatcgcagcccgcgttgctgcaaaagcctatgaccttggattggctagccatctccctcgcccaaaagacttggtgaagtacgctgagagctgcatgtacagccccatttaccgttcttatagatgaagtgatgctcaccttagtgtacagcttcatttggctacagcatgctgtcttgtattacagtaataatttgcggttggacctatatcgtacggcagtagcattttatccctgaactgtgcttgtacatatttgccctgtcatcatgtaataaataacccaagtctgctattgcagaatttggttcagtatgattttactttgtatatggcattgctcgtacgattgcaacaaaggtgtatacactatccacacacggatgaacatgtttgtttttgcattttttaacgaaagcatcaaggcacattctgtgatatatgtacaattttctgggcatgtgccagatgctggaccatggcagctggggcacgataagtggggtaatacgcaggcatctatgttattgacaaactctcgcgtctaatacaagaaagccgcacgattagcaaagct

SEQ ID NO: 4003 - DNA, 2109 bp, Setaria italica
ggggtcaggggagctgaagaacggcggcgtaaccggcggcgtggaggacgcctacggcgaggaccgcgccaccgaggaccagccggtcacgccgtgggccgtctgcatcgcaagtggtcactctatactgagggatccaaggcacaacaaggggctctccttcacggagaaagagcgggatgctcactacctaagaggattgttgcctcctgtagtgctatcacaagatctccaattgctttttctccaccttgagaagaggctgctgcagaatgttcggcagttcgaggtcccgttgcagcgttacatggccttaatggacctccaggagaggaatgagagactattttacaagctcctgatcgacaatgtggaggaactgcttcctgttgtgtatacaccaacagtgggggaggcttgccagaagtatgggtcaatcttcagaagaccccagggtttatacatcagcctcaaagagaaggggagaatattggaggtactaaggaattggccagaaaagagtattcaagttattgtcgttaccgatggtgagagaattttaggcctgggagatctcggctgccagggcatgggaattcctgtgggaaagcttgcactgtatactgctcttggaggtgtccggccatctgcttgcttgcctattaccattgatgtaggaacaaataatgaaaatctactaaaggatgagttctacattgggttaaagcaaagaagagcaactggccaggaatactctgaacttctggatgagttcatgacagcagttaggcagaactatggacagaaggttcttgtccagtttgaggactttgcgaaccacaatgcatttacgcttcttgagaagtacagggaaaaccatcttgtatttaatgacgatatccagggaactgctgcggtagtacttggagggcttattgctgctctgaagtctgtcggcggcactctagccgatcacacattcctgttctttggtgcaggcgaggctggcacaggcattgctgagctagttgctctggagatatccggacaggcgaaggtttcagtagaagaggcacgcaaaaagatctggcttgttgattcaaagggattgattgtgacctcacgtaatgagactcttcagccgtttaagaaacgatatgcacatgagcacgaacctgttaaagatctcctaggcgctgtcaaggccatcagaccaactgcactaataggatcagctggtgtgggacaaagtttcacaaaagaggtgattgaggctatgtcttcgattaatgagagacctatcatcctcgctctatcaaacccaacgtcacagtctgaatgtactgctgagcaagcttatacatggagtcggggccgcgcgatatttggaagtggaagcccatttgacccggtgaagtataatgacaagctattcgtgcctgcccaggcaaacaatgcatacattttcccagggtttggtctaggtgtggtgatctcaggggcggtccgggtgacagacgatatggtccttgctgctgctgaaggactagctgaccaggtaaccccggagcatatcgacaaaggcctcatctacccacccttttccatcatcaggaagatatcagccaacatcgccgcccgcgtggcggcaaaagcctacgatctcgatgacagttatgagccatcccgttcttctgcttttgggttggctagccagctccctcgcccaaagaacctggtgaagtacgccgagagctgcatgtacacccctgtctaccgatcttacagatgaagggcgacaatactgagttgttgacactggacgaattctgtacaactccacctgaggaatcgcatatgcctattgctgtggcatctactgctgagccgctatgcttccctgtgatcgtcgtgtaaaatgtgtggtaaagctcgctattgacgagtcgattctgcttgttcgtttgtaaatgtatgtagtcgtgtaatagagttcacggggctgtagaacgtattcctacgaagcatatgtgagtgtatgtgacatgatttttttgagctatgcgacatgaattggtaagcctgcagtctcacgtaaggaaccgttgc

SEQ ID NO: 4004 - DNA, 2058 bp, Oryza sativa
caggcctccagctactacgcgtcgtggcttctcgcgctgcattccgagagacgacgaagcggtggtggtggtggcggcggcgctgcaggcaaggcgcgaggacggtgagcggcatggcggggcgaggagaggggaacggcgctgcgacgatggcgggggtggccaccggtggcgtggaggacgcctacggcgaggaccgcgccaccgaggaccagcccatcacgccgtgggccgtctgcgtcgccagcggtcactctctgctgagggatccacggcacaacaaggggctatcattcacggagaaagagcgagacgcccactacctgcggggtttgctgcctccagtcgtgctctcccaagaacttcaggagaagaggcttctgcaaaatgtgcggcagtttcaggttcctctgcaacgttacatggctctgatggaccttcaggagaggaatgagaggcttttctacaagctcctgatcgacaacgttgaggaattgctccccgttgtgtacacgccgacggtgggcgaggcttgccagaagtacgggtcaatctttagacgaccacagggtctgtacatcagtcttaaagagaaggggagaatattggagttactgaggaactggccagagaagagcattcaggttattgttgttactgatggtgagcgcattttaggtctcggggatcttggttgccagggtatgggaatccctgtgggaaagcttgcactatacacagcccttggaggtgtccggccttctgcttgcttacctatcaccattgatgtgggaacaaacaatgaggatttactgaaggacgagttctacattggattaagacaaaaacgagccactggccaggaatatagtgatcttctggatgaattcatggctgctattaagcagaactatggacagaaggtgctagtccagtttgaagacttcgcaaattacaatgcatttacccttcttgagaagtaccgtgcaaacaatcttgtcttcaatgatgatattcagggaacggctgctgtagtgcttgcaggcctcattgctgctcagaaatttgtcagtgggactttagctgatcacacattcttattctttggcgcaggagaggctggtacaggcattgctgaactagtggctctcgagatatcaaatcagtccaaagttccagtggaagatgctcgcaaaaagatctggctacttgattcaaaggggttgattgtcagttcacgtaaagattctcttcagccctttaagaagcgatatgcccatgagcatgaaccagtcaaagatctactggatgctgttaaggttatcaaaccgactgcattgataggttcagctggtgtgggtcaaagtttcacaaaagaggtgattgaggctatgagttcaattaatgagagaccaatcatcctcgcactatccaatccaacatcacaatctgaatgtactgctgaacaggcatattcatggagtaagggccgtgcaatatttgggagtggaagtccatttgatccagttaaatacaatgacaagcttttcgtgcctgcacaggcaaacaatgcatatatattcccaggatttggcctaggcgtagtgatttcaggagcgataagggtgaaagatgaaatgatccttgctgctgctgaaggcttagctgaccaggtgaccccagagcatgttgacaaaggccttatttatccacccttttcctgcatcaggaagatatcagccaacatcgcagcccgcgttgctgcaaaagcctatgaccttggattggctagccatctccctcgcccaaaagacttggtgaagtacgctgagagctgcatgtacagccccatttaccgttcttatagatgaagtgatgctcaccttagtgtacagcttcatttggctacagcatgctgtcttgtattacagtaataatttgcggttggacctatatcgtacggcagtagcattttatccctgaactgtgcttgtacatatttgccctgtcatcatgtaataaataacccaagtctgctattgcagaatttggttcagt

SEQ ID NO: 4005 - DNA, 2559 bp, Brachypodium distachyon
caccttggctcgcattgcaaccggagttgaggcttgttcacggtggtgcagcagcaggattataacagcaggggcgagagcagagcagtacggcagcagcactatggcgggaagatcaggggaaggagcgccgtcgtccgacgccgcgatggcgggcgtggccaccggcggcgtggaggacgcctacggcgaggaccgcgccaccgaggaccagcccgtcactccctgggccgtctgcatcgcgagtgggcattccctgctgagggatccgcggcacaacaaggggctctccttcacggagaaagagcgtgacgcgcactacctgcgtggcctgctgcctccggtggtcctgtcccaggagctccaggagaagcggctgctgcagaacgtgcgggagctccaggtcccgttgcagcgctacatgttcctcatggatcttcaggagagaaacgagaggctcttctacaagctcatgatcgacaacgtcgaggagctgctccccgtcgtgtacacgccgaccgtcggcgaggcgtgccagaagtacgggtccatcttcagacggtcgcagggtctgtacatcagtctcaaagacagggggagagtactggaggtgctgaggaactggcgggagaagagtattcaggttatcgttgtcacggacggggagcgcattttaggtcttggagatcttggctgccagggcatgggaattccggtgggtaagcttgcgctgtacacggcccttggtggtgtcaggccatctgcttgcttacctatcaccattgatgtgggaacaaacaatgaagagttactgaatgatgagttctacattgggttacggcaaaaaagagccactggccaggaatacgctgaacttctggatgagttcatggctgccgttaagcagaactatgggcagaaggttcttgtccagtttgaggacttcgctaatcataatgcatttacccttcttgagaagtacaggccaacccatcttgccttcaatgatgatattcagggaacggctgcggtggttcttgcaggcctcattgctggtctgaagtttgttggtggaactttagctgatcacacattcttgttcttcggtgctggagaggctggcacagggattgctgaactagtagctttggagatatcaatgcagtccaaggtttcacaagaagatgctcgcaaaaatatctggctagtcgattcaaagggattgatcgtgagttcacgtaaagattctatacagccctttaagaagctgtatgcacatgagcacgaaccagtcaaagatcttttaagtgccatcaaggatatcaaaccaactgcactaataggatcagctggtgtgggacagagttttacaaaagaggtgattgaggccatgtcatcgatcaacaagaggccaatcatccttgcgctatccaacccaacatcaagatctgaatgtaccgctgaacaggcatactcatggagtcagggccgtgcaatatttggcagtggaagcccatttgatccagtgaaatataatgagaagctttttgtacctgcccaggcaaacaatgcatacatcttcccaggtttcggtttaggtgttgtgatctccggagcgatacgggtgaaagacgatatggtgcttgctgccgctgaaggcctggccgagcaggtcagctcagagcatttcgacaaaggtctgatctacccacccttctccagcatcaggaagatatcagccaacattgcagctcgtgttgccgcgaaagcctacgacctcggactggctagtcatcttcctcgcccaagagacttggtgaagtacgccgagagctgcatgtacagccctatctaccgttcttacagatgaagccatgatggtgctgcatatgccagagtctgacttggaataatgcacgactgcgccagattgtgatttaggccgcttccgttgtacaagagcttgtttaaattgttattgtgagatttgccgtgtataagatgcttgtatggaatgttgttacctgatcagactgcgggatccttgcttacttccattgtgagcacgtgctgaataatttcccttcttcgctgggttaatatctggccaacatcgagttggttgtcctgggtgatcaatgatcttttaactttgagaacactaccagtaaaatggaagacagatgccatcaatatttgctacaacaaaagagatcaatgtaaagttcgatcgtttacgatgccccagtcgatcaaaattcttttatggtgatactactatgccaacacaactgggagttgtccgaggcaaaactacagaatgagagaagtcgattctagaagaaaagtcaggttagaagggtgatgagaattgcattccaaaaggcgaccacgacctacatggacgatcggtcctgtgctgattgtgtatcgtctaaaatttgggaactgcgtataccccagaaggattttggaacaagattcttcttggctgcgctgaacagccagccaatgttggactcacaggcagcacacagtgcaatcgtccaagtatatctg

SEQ ID NO: 4006 - DNA, 2156 bp, Triticum aestivum
ccacgcgtccgcctcctccttctggcgccccctttatgcgcgggctacgacgcagcagcctggctcgcattgcatccaccaccagagcggcgtcggcgcgtcagtgcagcagcagcatattaggaggagcgagagcggcgccgtactgcaccatggcgggacgatcgggggaggaagcggacgccgcgatggcgggcgtggccaccggcggcgtggaggacgcctacggcgaggaccgcgccaccgaggaccagcccgtcacgccgtgggccgtctgcatcgccagtggccactccctgctgagggatccgcggcacaacaaggggctgtcgttcacggagaaggagcgggacgcgcactacctgcgcggcctgctgcctccggtggtcctgtcccaggagctccaggagaagcggctgctgcagaacgtgcggcagcttgacgtcccgctgcagcgctacatgttcctcatggacctccaggagaggaacgagaggctcttctacaagctcatgatcgacaacgtggaggagctgctccccgtcgtctacacgcccaccgtcggcgaggcctgccagaagtacggctccatcttcaggcgctcgcagggcctctacatcagcctcaaagacaaggggagagtactggaggtgctgaggaactggccggagaagagtattcaggtcatcgttgtcaccgacggcgagcgcatcttaggcctcggagatcttggctgccagggtatgggaattcccgtggggaagcttgcgctgtacacggcccttggtggtgtcaggccatctgcctgtttacccatcactattgatgtggggacgaacaatgaagagctactgaacgacgagttctacattggattacggcagagaagagctacgggccaggaatacactgagcttctggatgagttcatggttgccgtgaagcagaactatggacagaaggttcttgtccagtttgaagacttcgcaaatcacaatgcgtttacccttctcgacaagtacaaggcgacccatcttgtcttcaatgatgatattcagggaacggctgcggtggttcttgcgggccttatggctggtctgaagtttgctggtggaactttagctgatcacacattcttattcttcggtgccggagaggctggtacaggcattgctgaactagttgctttggagatatcgatgcagtccaagacttcacaggaagaggctcgcaaaaatatctggcttgttgattcaaagggattgatcgtgagttcgcgtaaagattctatacagcccttcaagaagctatatgcacatgagcatgaaccagtcaaagaccttttaagtgccatcaaggatatcaaaccgactgcactaataggatcagctggtgtgggtcaaagtttcacaaaagaggtgatcgaggctatgtcttcgattaacaagaggccaatcatccttgcgctatccaacccaacatcaaagtctgaatgtacagctgagcaggcatattcatggagtcagggccgtgcaatatttgggagtggaagcccgtttgatccggtgaaatataacgacaagcttttcgtacctgcccaggcgaacaatgcatacatcttcccaggatttggtttaggtgtagtgatctccggggcgataagggtgaaagacgatatggtccttgctgctgctgaggccttagccgaacaggtcacggcggagcatttcgacaaaggtctgatctatccacccttctccagcatcaggaagatatcagctaacatcgcggctcgtgtcgctgcgaaagcctacgacctcggactggcaagccatctccctcgcccaaaagacttggtgaagtacgctgagagctgcatgtacagccccatctaccgttcatacagatgaagccatggcgcctcatactccggccacaaataatgttcggttgaacctagactgtaactttgtacattgctcccatcgggctcgtatgcttgtttcgtcgtatttcccttgttatcgtatcatctataaatgaattgtaatggcagaccaacaccacagtatcatgtataaatgaattgtaatggcagaccaacacccacagggttcaggtttgtgtaatcgtgtaataaagctgcgagcatgttc

SEQ ID NO: 4007 - DNA, 1910 bp, Brachypodium distachyon
atggcgggaagatcaggggaaggagcgccgtcgtccgacgccgcgatggcgggcgtggccaccggcggcgtggaggacgcctacggcgaggaccgcgccaccgaggaccagcccgtcactccctgggccgtctgcatcgcgagtgggcattccctgctgagggatccgcggcacaacaaggggctctccttcacggagaaagagcgtgacgcgcactacctgcgtggcctgctgcctccggtggtcctgtcccaggagctccaggagaagcggctgctgcagaacgtgcgggagctccaggtcccgttgcagcgctacatgttcctcatggatcttcaggagagaaacgagaggctcttctacaagctcatgatcgacaacgtcgaggagctgctccccgtcgtgtacacgccgaccgtcggcgaggcgtgccagaagtacgggtccatcttcagacggtcgcagggtctgtacatcagtctcaaagacagggggagagtactggaggtgctgaggaactggcgggagaagagtattcaggttatcgttgtcacggacggggagcgcattttaggtcttggagatcttggctgccagggcatgggaattccggtgggtaagcttgcgctgtacacggcccttggtggtgtcaggccatctgcttgcttacctatcaccattgatgtgggaacaaacaatgaagagttactgaatgatgagttctacattgggttacggcaaaaaagagccactggccaggaatacgctgaacttctggatgagttcatggctgccgttaagcagaactatgggcagaaggttcttgtccagtttgaggacttcgctaatcataatgcatttacccttcttgagaagtacaggccaacccatcttgccttcaatgatgatattcagggaacggctgcggtggttcttgcaggcctcattgctggtctgaagtttgttggtggaactttagctgatcacacattcttgttcttcggtgctggagaggctggcacagggattgctgaactagtagctttggagatatcaatgcagtccaaggtttcacaagaagatgctcgcaaaaatatctggctagtcgattcaaagggattgatcgtgagttcacgtaaagattctatacagccctttaagaagctgtatgcacatgagcacgaaccagtcaaagatcttttaagtgccatcaaggatatcaaaccaactgcactaataggatcagctggtgtgggacagagttttacaaaagaggtgattgaggccatgtcatcgatcaacaagaggccaatcatccttgcgctatccaacccaacatcaagatctgaatgtaccgctgaacaggcatactcatggagtcagggccgtgcaatatttggcagtggaagcccatttgatccagtgaaatataatgagaagctttttgtacctgcccaggcaaacaatgcatacatcttcccaggtttcggtttaggtgttgtgatctccggagcgatacgggtgaaagacgatatggtgcttgctgccgctgaaggcctggccgagcaggtcagctcagagcatttcgacaaaggtctgatctacccacccttctccagcatcaggaagatatcagccaacattgcagctcgtgttgccgcgaaagcctacgacctcggactggctagtcatcttcctcgcccaagagacttggtgaagtacgccgagagctgcatgtacagccctatctaccgttcttacagatgaagccatgatggtgctgcatatgccagagtctgacttggaataatgcacgactgcgccagattgtgatttaggccgcttccgttgtacaagagcttgtttaaattgttattgtgagatttgccgtgtataagatgcttgtatgg

SEQ ID NO: 4008 - DNA, 2013 bp, Hordeum vulgare
ggcgccttggcacgcattgcatccgctaccagagtagcttggactcgtcggcgcagcagcagcagcagcagcagcatatcagaagcgagagcggcgccgcactgcaccatggcgggacgaccaggggaggaagcggacgccgcgatggccaccggcggcgtggaggactcctacggcgaggaccgcgccaccgaggaccagcccgtcacaccgtgggccgtctgcatcgccagcggccactccctgctgagggatccgcggcacaacaaggggctgtccttcacggagaaggagcgggacgcgcactacctgcgcggcctgctgcctccggtcgtcctgccccaggacctccaggagaagcggctgctgcagaacgtgcggcagctcgaggcccccctgcagcgctacatgttcctcatggacctccaggagaggaacgagaggctcttctacaagctcatgatcgacaacgtcgaggagctgctccccgtcgtctacacgcccaccgtcggcgaggcgtgccagaagtacggctccatcttcaggcgctcgcagggtctctacatcagcctcaaagacaagggcagagtactcgaggtactgaggaactggccggagaagagtattcaggtcatggttgtcaccgacggcgagcgcatcttaggcctcggagatcttggctgccagggtatgggaattcccgtggggaagcttgcgttgtacaccgcccttggtggtgtcaggccatctgcttgtttacccatcaccatcgatgtggggacgaacaacgaagagctactgaacgatgagttctacattggattgcggcaaaaaagagctacaggccaggaatacactgagcttctggatgagttcatggctgccgtgaagcagaactatgggcagaaggttcttgtccagtttgaagacttcgcaaatcacaatgcgtttacccttcttgagaagtacaaggcaacgcatcttgtcttcaatgatgatattcagggaacggctgcggtggttcttgcgggccttatggctggtctgaagtttgctggtggaactttagctgatcacacatttttattcttcggtgccggagaggctggtacaggcattgctgaactagttgctttggagatatcgatgcagtccaagatttcacaggaagaagctcacaaaaatatctggcttcttgattcaaagggattgatcgtgagttcgcgtaaagattctatccagcccttcaagaagctatttgcgcatgagcatgaaccagtcaaagatcttttaagcgccatcaaggatatcaaaccgaccgcgctgataggatcagctggtgtgggtcaaagtttcacaaaagaagtgattgaggctatgtcttcgattaacgagaggccaattatccttgcactatccaacccaacatcgaaatctgaatgtacagctgagcaggcatattcatggagtcagggccgtgcaatatttgggagtggaagcccatttgatccggtgaaatataacgggaagcttttcgtacctgcccaggcgaacaatgcatacatcttcccaggatttggcttaggtgttgtgatctccggggcgataagggtgaaagacgatatggtccttgctgctgctgaggccttagctgaacaggtcacggcggaacatttcgacaaaggtctgatctatccacccttctccagcatcaggaagatatcagccaacatcgcggcccgtgtcgctgcgaaagcctacgacctcggactggcaagccatctccctcgcccaaaagacttggtgaagtacgctgagagctgcatgtacagccccatctaccgttcatacagatgaagacttggcgcccccaatactccggccacgaataatgctcgttgtttagtcgtatttagtcagtgtttcccttgttatcgtatcgtgcaaatgaattgcaatggcagaccgacacccaggttttgagtaataaagttgagaacatgttcagttgtg

SEQ ID NO: 4009 - DNA, 2259 bp, Setaria italica
cacggcgccacccccatggcctcggtgtccgccgtgctgctgcagcgcgcctcctcgcgggctcgagaatatttacatctccagcgcgccgctggaggcacagttgcgctgcatttggagaggctgcactattggtggtggagcagcggcggcgggaggtttggcgcgagagcggcgcacggtatggcgggatcaggggagctgaagaacggcggcgtgaccggcggcgtggaggacgcctacggcgaggaccgcgccaccgaggaccagccggtcacgccgtgggccgtctgcatcgcaagtggtcactctatactgagggatccaaggcacaacaaggggctctccttcacggagaaagagcgggatgctcactacctaagaggattgttgcctcctgtagtgctatcacaagatctccaggagaagaggctgctgcagaatgttcggcagttcgaggtcccgttgcagcgttacatggccttaatggacctccaggagaggaatgagagactattttacaagctcctgatcgacaatgtggaggaactgcttcctgttgtgtatacaccaacagtgggggaggcttgccagaagtatgggtcaatcttcagaagaccccagggtttatacatcagcctcaaagagaaggggagaatattggaggtactaaggaattggccagaaaagagtattcaagttattgtcgttaccgatggtgagagaattttaggcctgggagatctcggctgccagggcatgggaattcctgtgggaaagcttgcactgtatactgctcttggaggtgtccggccatctgcttgcttgcctattaccattgatgtaggaacaaataatgaaaatctactaaaggatgagttctacattgggttaaagcaaagaagagcaactggccaggaatactctgaacttctggatgagttcatgacagcagttaggcagaactatggacagaaggttcttgtccagtttgaggactttgcgaaccacaatgcatttacgcttcttgagaagtacagggaaaaccatcttgtatttaatgacgatatccagggaactgctgcggtagtacttggagggcttattgctgctctgaagtctgtcggcggcactctagccgatcacacattcctgttctttggtgcaggcgaggctggcacaggcattgctgagctagttgctctggagatatccggacaggcgaaggtttcagtagaagaggcacgcaaaaagatctggcttgttgattcaaagggattgattgtgacctcacgtaatgagactcttcagccgtttaagaaacgatatgcacatgagcacgaacctgttaaagatctcctaggcgctgtcaaggccatcagaccaactgcactaataggatcagctggtgtgggacaaagtttcacaaaagaggtgattgaggctatgtcttcgattaatgagagacctatcatcctcgctctatcaaacccaacgtcacagtctgaatgtactgctgagcaagcttatacatggagtcggggccgcgcgatatttggaagtggaagcccatttgacccggtgaagtataatgacaagctattcgtgcctgcccaggcaaacaatgcatacattttcccagggtttggtctaggtgtggtgatctcaggggcggtccgggtgacagacgatatggtccttgctgctgctgaaggactagctgaccaggtaaccccggagcatatcgacaaaggcctcatctacccacccttttccatcatcaggaagatatcagccaacatcgccgcccgcgtggcggcaaaagcctacgatctcgggttggctagccagctccctcgcccaaagaacctggtgaagtacgccgagagctgcatgtacacccctgtctaccgatcttacagatgaagggcgacaatactgagttgttgacactggacgaattctgtacaactccacctgaggaatcgcatatgcctattgctgtggcatctactgctgagccgctatgcttccctgtgatcgtcgtgtaaaatgtgtggtaaagctcgctattgacgagtcgattctgcttgttcgtttgtaaatgtatgtagtcgtgtaatagagttcacggggctgtagaacgtattcctacgaagcatatgtgagtgtatgtgacatgatttttttgagctatgcgacatgaattggtaagcctgcagtctcacgtaaggaaccgttgcgtcaccgtcctctcat

SEQ ID NO: 4010 - DNA, 2332 bp, Brachypodium distachyon
ccgaaccccgcagagttttcttctagagccccccgacaaagaggcgacggcgtcaccatgtcttcggtgtcccgccgcgccgctgcacgcctccacctcctcgcgcaccctttatgcgcgggctccaacgccgcagcttggctcgcatttcatccggagaggcgccctcgcggtggtggtgcagcagcaggaggatagttggagcaaaaatcggcgccgtacggtaccatggcaggacgaccaggggaaggaggggacggccgcttggagggcgccgagaccatgatggagggcgtggccggcggcggcgtggaggacgcctacggcgaggaccgtgccaccgaggaccagcccatcactccgtgggccgtctgcgtcgcgagtggccattccctgctgagggatccgggcacaacaaggggctctccttcacggagaaagagcgggacgcgcactacctgcgtggcctgctgcctccggccgtcctgccccaggaactccaggagaagcggttgctgcagaacgtgcgggatctcaaggacccgttgcagcgctacatgttcctcatggatcttcaggagagaaacgagaggctcttctacaagctcatgatcgacaacgtcgaggagctgctccccgtcgtgtacacgccgaccgtcggggaggcgtgccagaagtacgggtccatcttcagacggtcgcagggtctgtacatcagtctcagagacaaggggagaatattggaggtactgaggaactggccggagaagagtattcaggttattgttgtcactgacggggagcgcattttaggcctcggagatcttggctgccagggcatgggaattccagtggggaagctggcactgtacacggcccttggtggtgtaaggccatctgcttgcttacctatcaccatcgatgtggggacaaacaacaaagagctactgaatgatgagttctacattgggttacggcaaaaaagatccactggccaggaatatgctgaacttctggatgagttcatggctgccgttaagcagaactatgggcagaaggttcttgtccagtttgaggacttcgcgaatcacaatgcatttacacttcttgagaagtacaggccaacccatcttgtcttcaatgatgatattcagggaacggctgcggtggttcttgcgggcctcattgctggtctgaagtttgttggtggaacttagctgatcaccatttcttattcttcggtgcaggagaggctggaacaggtattgctgaactggttgctttggagaactgtctaccgagcatgttactagacagttagtttgttaagttaaccggattgggctttgaagaatgtgttattatattgcccaaaaagttattccgtgtgttatatttcagtccaaggtttcaccggaagaggctcgcaaaaatatatggctcgttgatatagatggattgatcgtgagttcacggaaatattctatacagcccattcagaagctatatgcacatgaacatgaaccagtcaaagatcttttaagtgcaataaaggatataaaaccaactgcgctaataggatcagctggtgtgggacaaagttttacgaaggaggtgattgagaccatgtcttcgattaaccagaggccggtcatccttgcactgtccgacccaacgtcgcgttctgaatgtaccgctgagcaggcatattcatggagtcagggccgtgcaatatttggcagtggaagcccatttgatccagtgaaatataataagaagctttttgtgcctgcccaggcaaacaacgcatacatcttcccagggtttggtttaggtgtggtgatctccggggcaatacgggtgaaagacgatatggtcctttctgctgctgaaggcctggccgaacaggtcacctcagagcatttcgacaaaggtctgatatacccacccttctgcagcatcaggaagatatcagccaacatcgcagctcgtgttgctgcgaaagcctatgacctcggactggctagtcatctccctcgcccaagagacttggcgaagtacgccgagagctgcatgtacagccatatctaccgttcttacagatggagccatggtgggtgcatatgctccactctggcaagggataatgtaaggttggacctagattgtgatttactaggttgcttccgttgtacaggtgcttgtttattcatatcttcccagtaatcatgtaaagaattgttatagcacgcgtgtgtgctcatacgcatgttcatatttgtgcaatcgtgtaataaaataatgtggggtgaacatgttacctgatgaaacg

SEQ ID NO: 4011 - DNA, 1485 bp, Zea mays
gcgcaacaagcctacgagacgggcacagatatttatcatgtgaggcgcgaacttttgcaaggcccaccataaagtgacccggaaccgaccctccgctccaaccgccgccgagcggcgctgcgcctgagtctgagctccccgagatcttgcctccccgctataaaatctccatctccggacgcttgcgcagggggaggggagctttccacttcacggctgatgagtgatgaccctaccagaaatcgacccgatacggctcctgcgccagatcgtccatcaatagcccgaatcacactcatcacaagcctcaaacttttccaaaccaatttagatgcggcgtgagtgctaaagcgctctctggactctgtttcgcagtggccgcagctgcagcgtcctcttccctttttgccatccagcatcacctgtgccgccggcgcgtaattgcaccgcggtcactggttaataggaagaagggaaggaggaggggggagcggtgtgccggggtatcgtcgtgcccatgggcgtgcacgccaggtcgatgagctggtatatggggtcgccggcgccggggagcgccgccgagggcgaggggcagcgcgcgctgagaagcagctccggtggcagcgacggcagcttcgacaccaacatggtcatcatcctcgccgcgctgctgttcgcgctcctcttcgcgatgggcctcaactcgctcgcgcgctgcctcatccgctgggcacgccgcgcgccggccggggaggacggcggcgccggcgggctaaagaagcgcgcgctccggagcatccccgtcgaggtgtacggcgcgtgcggcgccgacggggcggcggctgtcgccgccgacgtctgcgccatctgcctcggcgagttcgcggacggcgagaaggtgcgcgtgctgccgcgctgcgcccacggcttccacgtccgctgcgtcgacacctggctcctgtcgcacgactcctgccccacgtgccggggctccgtgctcgacggcgcaaaggccgccgcctctgctcccgccgccgggggcaaccggcggcagggaagcgaggctgctgccatcgcaattgtcattggatgacgtggacgtgtgggggcccgcgtgcccactggtggtggagccacacggtatgcgagactagcttcgttccgtggtagtgagatattttgctgtgatgagaagccgacgagtcgcggcggcccatctctcagtcaagacacagcatggccttcaggatattatcccttcggtctgtacttgtgcatggtcgtcgcagctgatcctgtttgtgtatactaggagtggatgatgaggtatgccgctataggcttgcaataatacagttttgtttgtacatgttcgatttgacacaattttagagcactgagcagagcacacatggactagtattctaagatgtacggtggacgtctattttgcactgacaaatttagaattattctaccatttta

SEQ ID NO: 4012 - DNA, 1862 bp, Setaria italica
cctgctccgcgatcctccctccctggtcccccgcctataaaatctccctcccactgccgcttgcgccggggcggggagctttccacttcacggccggccctaccggaaaccgacccggctcgttcgcgaggcgagaccgatcgaaaggccggctcgctcacaagcatcaaacttttccagactgacgcggatagatacggagcgagtgctaaagcaaagcgagagcgctctgctgctgctggtggtagccgccgtcgtggtagctgcagcggcaacgtcccagtcctttttttgccaattgccatcgagcagcggcatcacctgcaccgccggcgcgtgattgcaccacgagccgtggtggtggaggcggctcaggcgggagttgaggaggagggaagagggtggtggtggactactggagaccgagcggcggcgtcgatgggcgtgcacgtccggtcgatgagctggtacctgggcccgccgggttcgccggcgccggccgggagcgcggccgcggaggcgcagcacgcgctgagcagcaacccggggggcagcgacaccagcttcgacaccaacatggtcatcatcctcgccgcgctgctgttcgcgctcctcttcgcgctcgggctcaactcgctggcgcggtgcctcatccgctgggcgcgccgcgcggcctcggtgggggagggcggcgctggcgccggcgcggggggcggcaggggcgggggagggctcaagaggcgcgcgctccggagcctccccgtcgaggtctacggcgcgtgcagcgccgacgggagcgcggccggcgccgccgacgtctgcgccatctgcctcggcgagttcgcggacggcgagaaggtgcgcgtgctgccgcgctgcgcccacggcttccacgtccgctgcgtcgacacctggctcctctcgcacgactcctgccccacgtgccgcggcaccgtgctcgacgccgccgcggccggcaacgccaaggccgccgcctccgcccccgccgccgccgccgggggtagccggcggcagggcagcgaggctgccgctatcgcggtggtcatcggatgacgtggacaggagtgtggaggcccgcgtgccgattgttggcgggggccacaggtatgcgagctttgttccgtgaccgtcagatattttgcgatcagagaccaacggctgggcccctcacatgtatgttttgtactcctagttgcctaggtcgcattcgagtcaagattgcatgccgttccattatccgttcggcatgtactcttctctgctccgctcttgtccagttgtgctggttggcttcctcctcgcggttgcccctctttgtacatagaggagtgtcatcgaatatgatacctacacgccgtcaacaaatttgagtttgctgccgtggcatttccctcacgcctcacatccactcccgttacttttgacagacaaatgtgtctataatggccattttgccggtgtactgactgacgaactgaacccacaccccataatctctgcacgagttcaatacttcaatcctcgttccgaagacccaaaccataccaatccataattgatctcggctccttcgtgcgagcctcgcgtccagcggcagggcaccagagaggcagagacatggcagcgcggctcctttgtgacggtgatatcctacggtcctgcctttgcgggataaatcactccggctcgcgaccgacgtcgtgtactgtacgtacacggcaagctcccgtgcgccagcgctgagtacgatgtgtgtagagtacacaacgccggcactgcagtggcgcaagcggcatctatgatgtgtttcagtaaggtgatcgaatgcgtgctcgcctgcg

SEQ ID NO: 4013 - DNA, 1346 bp, Zea mays
ccatttgggctctgtccaagtgtaactcagcccatcaatccaaacgggcactctctagaaacaacgcacgtgtcggctaccgcaaggaaagtcgggaaccttctagaacccgctggatgcttctctcacctaggtccaacttaatctcatccccaaatccacctttctagatgcgtcttcctcgctctgtcctctcctcacactttcctttccgcggcccctctgctcaccgcactccgttgcctgatggcgttgccggcggcggggacgccgcccttcctgacgaaaacttacgccatggtggaggactcggccacggacgatacgatctcgtggaacgacaccggcacggccttcgtggtgtggcgccccgccgagttcgcccgtgaccttcttcccaagcacttcaagcacagcaacttctcctcgttcgtccgccagctcaacacctacggattcaagaaggtagtcggggacagatgggagtttgccaacgacggcttccggagaggcgagaagcaccttctcgccggaatacagaggcggaaggggaccggcgccgtggcggcggtaccggtgccgggcataccggcggggataccgttaccgctctcgtccccgcccacgagctctggcggggagccggcggtctcctcgtcgccgccgcgtggctcgacggctggagttagcggcgcggtggccgagctggaggaggagaacgcgcggctgcgacgcgagaatgcgaggctggcgcgggagctggcccgcgcgcggcgcctctgcgacggcgtgcgccagctcatggctcggtacgacgacgaccaaggcagaggcggagatgaggatccggcggacggcgacgaggggcatggcggcagtggggaaggtcccagcggcccagaagtgaagccaatgctgttcggcgtcccaatcggggccaagcggctacgcggtgcgcgtggtgatggagacgatgtagatgacggcgaggacaacgacgaggaacaagatgaagacgacgagaggcaaacggtgcggaagcagggggttaaagcggccaggaggaacgaggcgtcggatctggacgtgctgacgctgtccgtgcgggcggccgcggcggcgaggacgggcggaggatcacgtgaccgcaaaagccccattaacgcccaccccgataggagcctcagtctagggctgaaatgactgacactcgtgtagagtactgtagtatcgattgtagtattgtattgagtggtgctgcacggttgaattgaatcatctagaaatcaaaatttagcaacggggcatctcctgactgtcaagtagaatgtttaaataataattac

SEQ ID NO: 4014 - DNA, 1295 bp, Panicum virgatum
cccgtggaaacaattgccctcttcccgcatccttgccctgctctccgctcctcatcgcctgcccaatggcgtcgccggcggcggggacgccgccgttcctgacgaagacgtacgcgatggtggaggaccccagcaccgacgacaccatctcgtggaacgacaccggcacggccttcgtggtgtggcgccccgccgagttcgcccgcgacctcctccccaagcacttcaagcacagcaacttctcctccttcgtgcgccagctcaacacctacggattcaagaaggtggtggcggacaggtgggagttcgccaacgacggcttccggcgaggggagaagcacctgctgggagggatacagaggcggaaagggaccggccccgggggcgcggggggcggggcggccataccgacggggataccgatcatctcgtccccgcccacgagctccggcggggagccggcggtctcctcgtcgccgccgcgcggctcggcggcgggggtgagcggcgcagtggccgagctggaggaggagaacgcgcggctgcggcgagagaacgcgaggctggcgcgggagctggcccgcgcgcggcgcctctgcgacggcgtgcggcagctcgtggcgcggtacgaccacggcggcggcggggaggatgatcccgcggatggcgacgacgggcacgggggcggccctggcggccacggagcgaagccgatgctgttcggcgtcgcgatcggtgccaagcgcccgcgcggcgcggaggacggggacgaggaggaggacgtggacggggccgccgaggaagacggcgaggaggacgaggaacatgacgacgacgagaagcacgcggcgcggaggcgggggagcaaggccgcgaggaggaaagagatttcggatctcgacgtgctggcgctgtccgtgcgggcggcggcggcggcgaggccgggcggagggtcgcgtgaccgcaagagctcggtctcgtgacagcccgcgctgctactaggactgaaatcagtgacactcgtgtagagtagtctcgcttgtattggcagatggtgaaggcgtaattgggtaaactgaaacatctctgcatttgctagaaatcgagattcaatggtggccttattttattgtagcctttacacggtcgcgcactcgtgccggttggcttgtttacttcaaaaatggagtttagccaacaggcaagctgaccaaataggtttgctgtagctctgtaaacgtgtaacagaagtaatttataatttcattttcatgttaagttgataatcatgtaat

SEQ ID NO: 4015 - DNA, 1179 bp, Setaria italica
caccgccgctccggccacctgcctgcccaatggcgtcgccggcggcggggacgccgccgttcctgacgaagacgtacgcgatggtggaggaccccagcaccgacgataccatctcgtggaacgacaccggcacggccttcgtggtgtggcgccccgccgagttcgcccgcgacctcctccccaagcacttcaagcacagcaacttctcctccttcgtgcgccagctcaacacctacggattcaagaaggtggtggcggacaggtgggagttcgccaacgacggcttccggcgaggggagaagcacctgctgggagggatacagaggcggaaggggaccggcaccacgggggttggcggcggggtggccataccggcggggataccgatcatctcgtccccgcccacgagctccggcggggaaccggcggtctcctcgtcgccgccgcgcggctcggcggcgggggtgagcggcgcggtggccgagctggaggaggagaacgcgcggctgcggcgcgagaacgcgaggctggcgcgggagctggcccgcgcgcggcgcctctgcgacggcgtgcgccagctcgtggcgcggtacgaccacggcgatgaggatccggcggagggcgacgatgggcacggcggcggcggcggtggtggaggccccagcggccgcggagcgaagccgatgctgttcggtgtcgcgatcggggccaaacggccgcgcggcgcggaggacggggacgaggtggaggacggcgaggacgggactgccgaggaagacggcgaggaggacgaagagcaatacgacgacgagaggcacgcggcgcgggggagtaaggcggcgaggaggaaagaggtatcggatctggacgtgctggcgctgtccgtgcgggcggcggcggcggcgaggccgggcggagggtcgcgtgacagcaagagctcggtctcgtgacagcccgcgccgcgaggactgaaattagtgtggcactcgtgtagagtagtctcgtttgtattgggagatggtgtaggcgtaattgcgtaaactgaaacatgtttgtactacatcaatggccttgctttattgtgctttgcaccgtcctgcagtcctgccgattctaactagggcttgtttagttcaaaaatgaacttgtttagccaaaagccaagctgacaaatgtttg

SEQ ID NO: 4016 - DNA, 1288 bp, Setaria italica
tgctttcctctctcctcgcctcgacctctctccccccgccgctggcactcgctcactctcttccgcacgcctccccgtcccgtggccgttgttcagacttcagaggccactccccacgggctccacgaccccacgcgctcctcgccgcgccgccgcggcttgccaaccctaaccgaactcgcgggacgcgagagcgggagcatccatggaagacgtccgcaaaaggggcacggccgacggcgccaacggggcctccgccggcgggaagcgcgcgcgagaatcggagtcatttcaaactggtgtaggaagcaaaacgaagccatgcaccaaatttttcagtacctctggttgtccctttggcgagggctgccattttctccattgcttccctggcggctaccaggcagtttcaaagataaccaacctgggtggcccagcagttacacctcctggaagaatgatgatggacgggccacctacacccaccatgaagactcgcttgtgcaacaagtacaaaactgcagatggatgcaaatggggggacaaatgccacttcgcacacggtgaaagggagcttggcaagcctatgttgatggacagctctacgcacttccccatgggaccaggacccactggtcactttgcacctccgcctatggtcaaccctggcatggccactccagcaagctttggtgcttctgccacagccaagatcagtgttgatgcatcccttgctggtcgcatcattgggaggggtggagttaacacaaagcagatatctcgagtcactggggccaagctggccatccgggaccatgaatcagacaccaagttgaaaaacatcgagcttgagggcacctttgatcagatcaagaatgctagcgctatggtcggggagctgattgtcaacatcagtggcagtgcccctccaccagcaaagaacccagctggaggacctcaccgtggaggctcaggaagcaacttcaagaccaagatgtgtgagaactttgcaaaagggtcgtgcacttttggtgacagatgccactttgcccatggtgaaaatgagctgcgcaagcctgctgctgcttgagatccatgtctttgtcagtactttgtagtgattagtcaatgtaactcaaaacttgatcttggatgatggatttgctgacttctttaggcctatgctactgaatctgttttctgtttttcttcttgaacgttctattgtgacctgttttgggagcctggtggttcttctacccatccctttcttcttgaaggttctatt

SEQ ID NO: 4017 - DNA, 2433 bp, Oryza sativa
atacctttctcggccttttggctaagatcaagtgtagtatctgttcttatcagtttaatatctgatatgtgggccatgtgcccacttcgatgttaaatttattttttgtgagggagggcccaccacagtggctagccactggggccctcgcgcgtcgcccagtcgttgcactgctgcccgggcctggtgcaccccaaccaaagcatcaattaaatttttaaagggccgtttgttacgcttggcccatcagacttttcgacaggccgattgttatctttcattagacttaaaccctagattttcgatttacgaggttaattgaccatacgtgggatattattttgttgcaaaataaaaaggtgtttaacgtggagtattttttaagttatttgacattttgttgcaaaattattatgcagtatagggcaataagtggaacgttgtcaagaaaaaaacccagaaattgattttcgattgcactgggaagttatcaggctcagttcacttctattgatgattaatactctgtcctaaaaaaaaataattctaacaataaatctgattactgctgtcctacaaagaattcaattctagcaatgaacctggatacataggatacggagggggtaatattctgttccggttttgttagcaatttttttaaactgtaaaaaggtgtgttttataaaaaaaatcttttatataaaaattattttaaaatatcaaataaatttatattgcaatattaaaataactaaaacttaactaatcacatattaatatatgtttttattatttgtgccctaacttcttattattcactcaaataatttcattggaaacgaatgggaccttaaatccgagaaaatgatttttatttcaatttgcaagattggggtgcagttcatttatattctttttccaagaacagtgagttggcgatgctttgatccagccacgaaggcacaaagcccaccacaccactccactccacatcgcgcggcccaacacatcacaccactctcttccaaactccacatctctcacctcctctcgcccacccaatcccttccgccttctacccgccgccgccgccgcgacgagccggaaaccctagccgagctccgaggcggcgtgcgcgagcgcgagcgcgggcgcgggtgtgggggagccgagagatggaagtcggcggccgcaagaggggcaagcccgacggtgcgaacggcgccggcgggaagcgcgcgcgagaatcggagtcatttcaaaccggtgtaggaagcaaatcgaagccatgcaccaaatttttcagtacctctggttgcccctttggtgagggttgccacttcctccaccacttccctggtggctaccaagctgttgcaaagatgaccaatcttggtggtccagctattgcgccgcctccaggaagaatgccaatgggaaatgctgttcctgatgggccaccaacacccactgttaagactcgcctgtgcaacaagtataacactgcagagggatgcaaatggggggataagtgccactttgcgcacggtgagagggagctcggcaagcctatgttgatggatagctcaatgcctcccccaatgggaccaaggcccactggtcactttgcacctccaccaatgcctagccctgccatgtccactccagcaagctttggcgcttcggccacagccaagatcagtgttgatgcatctcttgcaggtggcataatcgggaggggtggggttaacacaaagcagatatccagagtcacaggggccaagctggccatccgtgatcatgaatcagacaccaacttgaaaaacattgagcttgagggcacatttgatcagatcaagaacgctagtgcaatggtgagggagctgattgtcagcatcggtggcggtgcccctccacaaggcaagaaacctgtgggaggatcccaccgcgggggaggccccggaagcaacttcaagaccaagctgtgcgagaacttcaccaaagggtcgtgcacttttggcgacaggtgccattttgcccatggtgaaaatgagcttcggaaatcagctgctgcttgagatccattgtggtttgtagcgattagtcattgtaactcgaaactttgagggctgatgctgaattttctgaccgtttaggcttatgtgctgtcttgttttacctctggattctttattgcattttatttttgagctatttctcgtacgcctggttatgtgattatgttatcccttttctcctgcgatgttaaagcctactgtggttgatgattactatgcttttcataaaattaatgctactgtgactgtttctctggcaaagtgagcagtctcgttgattgttggaactacccaaacaaggatgatctgctgtctgcgcttcctgttgctaaactgctacctcgtacctcga

SEQ ID NO: 4018 - DNA, 2265 bp, Oryza sativa
atacctttctcggccttttggctaagatcaagtgtagtatctgttcttatcagtttaatatctgatatgtgggccatgtgcccacttcgatgttaaatttattttttgtgagggagggcccaccacagtggctagccactggggccctcgcgcgtcgcccagtcgttgcactgctgcccgggcctggtgcaccccaaccaaagcatcaattaaatttttaaagggccgtttgttacgcttggcccatcagacttttcgacaggccgattgttatctttcattagacttaaaccctagattttcgatttacgaggttaattgaccatacgtgggatattattttgttgcaaaataaaaaggtgtttaacgtggagtattttttaagttatttgacattttgttgcaaaattattatgcagtatagggcaataagtggaacgttgtcaagaaaaaaacccagaaattgattttcgattgcactgggaagttatcaggctcagttcacttctattgatgattaatactctgtcctaaaaaaaaataattctaacaataaatctgattactgctgtcctacaaagaattcaattctagcaatgaacctggatacataggatacggagggggtaatattctgttccggttttgttagcaatttttttaaactgtaaaaaggtgtgttttataaaaaaaatcttttatataaaaattattttaaaatatcaaataaatttatattgcaatattaaaataactaaaacttaactaatcacatattaatatatgtttttattatttgtgccctaacttcttattattcactcaaataatttcattggaaacgaatgggaccttaaatccgagaaaatgatttttatttcaatttgcaagattggggtgcagttcatttatattctttttccaagaacagtgagttggcgatgctttgatccagccacgaaggcacaaagcccaccacaccactccactccacatcgcgcggcccaacacatcacaccactctcttccaaactccacatctctcacctcctctcgcccacccaatcccttccgccttctacccgccgccgccgccgcgacgagccggaaaccctagccgagctccgaggcggcgtgcgcgagcgcgagcgcgggcgcgggtgtgggggagccgagagatggaagtcggcggccgcaagaggggcaagcccgacggtgcgaacggcgccggcgggaagcgcgcgcgagaatcggagtcatttcaaaccggtgtaggaagcaaatcgaagccatgcaccaaatttttcagtacctctggttgcccctttggtgagggttgccacttcctccaccacttccctggtggctaccaagctgttgcaaagatgaccaatcttggtggtccagctattgcgccgcctccaggaagaatgccaatgggaaatgctgttcctgatgggccaccaacacccactgttaagactcgcctgtgcaacaagtataacactgcagagggatgcaaatggggggataagtgccactttgcgcacggtgagagggagctcggcaagcctatgttgatggatagctcaatgcctcccccaatgggaccaaggcccactggtcactttgcacctccaccaatgcctagccctgccatgtccactccagcaagctttggcgcttcggccacagccaagatcagtgttgatgcatctcttgcaggtggcataatcgggaggggtggggttaacacaaagcagatatccagagtcacaggggccaagctggccatccgtgatcatgaatcagacaccaacttgaaaaacattgagcttgagggcacatttgatcagatcaagaacgctagtgcaatggtgagggagctgattgtcagcatcggtggcggtgcccctccacaaggcaagaaacctgtgggaggatcccaccgcgggggaggccccggaagcaacttcaagaccaagctgtgcgagaacttcaccaaagggtcgtgcacttttggcgacaggtgccattttgcccatggtgaaaatgagcttcggaaatcagctgctgcttgagatccattgtggtttgtagcgattagtcattgtaactcgaaactttgagggctgatgctgaattttctgaccgtttaggcttatgtgctgtcttgttttacctctggattctttattgcattttatttttgagctatttctcgtacgcctggttatgtgattatgttatcccttttctcctgcg

SEQ ID NO: 4019 - DNA, 1019 bp, Saccharum officinarum
cacgctcctggccgcggcggttcgcaacgcaaaccctaaccgagggcctccgccggcgggaagcgatcgcgagtacttctggttgtccctttggtgagggctgccattttctccattacttccctggtggctaccaggcagtttcaaaaatgaccaacctgggtggcgcaacaattgcacctcctggaagaatgacgatggatgggccacctacacccaccgtgaagactcgcttgtgcaacaagtacaacactgcagagggatgcaaatggggtggcaaatgccactttgcacatggtgaaagggaacttggcaagcctatgctgatggacagctatatgccaccccccatgggaccaagacccactggtcattttgcacctccacctatggccaaccttggcttggccactccagctagcttcggtgcttctgccacagccaagatcagtgttgatgcatcccttgcaggtggcataatcgggaggggtggagttcacacaaaacagatatctcgagtcaccggggcaaagctggccatccgggaccatgaatcagactccagcttgaaaaacattgagcttgagggcaccttcgatcagatcaggaatgctagtgctatggtcagtgagctgattgtcagcatcagtggcaatgccccttcacaggccaagaatccagctggcggaactcatcgtggtggtggtggtggcacaggaagcaacttcaagaccaagatgtgtgagaacttcacaaaaggatcgtgttcgtttggcaacaagtgtcactttgcccatggtgacaatgagctgcgcaagcctgctgctgcttgagatccatgtcctgtttcatacctcgtagtcattagtcaatgtaactctaaacttgggtctctgatgatggatttgctgacttctttaggcctgcgctactgatttgctgacttcagggctactactgaatttgcggacttgtttaggcctgcgctattggccaactaaatctgttttctgcccccc

SEQ ID NO: 4020 - DNA, 3464 bp, Zea mays
cgcggcctgggcgtgcgaccgagactgcgcgaagggagcgatggagaggctggagagctacctgaaggagcacttcgacgtgccgcccaagaacccctctgaggaggcgcagcggcgatggcggtccgccgttggcgcgctcgtcaagaaccgccgccgccgcttccgcatggtgccggacctccaccgccgcagcctggacgaggcccagcggcggtccacccaggaaaaaatccggcttgccctctatgtgcagaaggctgccatgaccttcattgatggtgccaagcacaaagactaccggatcacagaggatatcagaaacgctgggttctccataaacccagacgagctggcatcgatcacaagcaagcacgacgcgaaagccttaaagatgcacggcggggtggacggggtgtcgaagaagatccggtcggcgttggaccatggcatatctgccagcgacctagacacgaggcaaagcatctacggcgtcaaccggtacgcggagaagccttcgagaacgttctggatgtttgtgtgggacgcgttgcaggacatgactctgatcatcctgatggtgtgcgctctgctgtctgctgccgtcggtctggcgtctgaaggctggcccaggggcatgtacgatggcctggggatcatgctcagcatcctgctggttgtcatggtcactgctgtcagtgactacaggcagtcgctccagttcaaggagcttgacaatgagaagaagaagatattcatccatgtgaccagagacggatcccggcagaaggtctctatctatgacttggcggtcggtgacatcgtgcatctgtccatcggagaccaggtgcctgccgacgggctgtacgtgcatggatactcccttttgatcgacgagtccagcttgtcaggcgagagcgagccggtctatgtttctcaggacaagccattcatcttggcggggactaaggttcaggatgggtcagctaagatgatggtgaccgccgtcggcatgcgcaccgagtggggaaggttgatgagcacgctgagcgagggaggagaggacgagacgccgctgcaggtcaagctgaacggagttgcaaccatcattggcaagatcggcctgttgtttgccacattgacatttgttgtcctgatggttaggttcctcattgagaaaggtttgacggttggtctgtccaaatggtactctactgatgcgctgactatagtgaactacttcgcgactgctgtcactattatcgtcgtcgctgttcctgaagggctgcctcttgctgttactctgagccttgcatttgcgatgaagaagctaatgaatgataaggcacttgtccggcacctttcagcgtgtgagactatgggatctgccggaaccatctgcacggataaaacgggaactttgactactaaccatatggtggtcgacaagatatgggcatccgaggtctcaaaatcggttaccgatagcagtagtttggaagatctggcttctgccgtttctccagccacattgagcctgcttctgcaaggaatttttgagaacaccagcgcagaggtagtcaatgagaaggatggcaagcagactgtcttgggaactccgacagagagggcaatatttgagtttggcttgaaactggaaggtcttggtgctgaggataggacctgcaccaaggtcaaggtcgagccgttcaattcggttaagaagaagatggcggtgctggtctcgttgcacgatggcggctcgtaccgctggttcaccaaaggcgcgtcggagatcgttgtggagatgtgcgacatgatgatagatggcgatgggaacagcgtccccttgtcagaagctcagagaaagatcgtcttggatactatcaactcctttgcttcagatgctttgaggacactgtgcttggcgtataaggatgtggatggtctcgaggacgacgacgacgatgcagatagcccaacaagtggtttcactctaatctgcatttttggcatcaaggatcccttgcgcccaggagtcaaggacgctgtggaggcctgtaagtctgctggcatcgtcgtgagaatggtgaccggtgacaacatcaatacagccaaagctatagccaaagagtgtgggatactaactgatggtgacctagcaatagaagggccagaattccgcagcaagagcccagaagagatgagggacataatacctaagattcgggtcatggctcgttctttaccgttggacaagcatacccttgtgacgaacttgcgaggtatgtttcgcgaggtggttgctgtgacaggtgacggcacgaatgatgctccagcgttgcatgaagcagatatcggccttgctatgggcatagcaggaacagaggttgccaaggagagtgctgatgtgatagtgcttgatgacaatttcacaactataataaatgtcgcgaggtggggtcgtgcggtttacataaacatccaaaagttcgtgcagttccagctgactgtcaacattgttgctttggtcatcaacttcgtctcagcatgcattacagggagcgctccgctcacagcggtgcaactgttgtgggtgaatatgattatggatacattaggggctctagctctagcaacggagcctccaaacgatgacatgatgaagagaccacctgtcgggcgaggggaaagcttcatcaccaaggtcatgtggagaaatatcattgggcaaagtttgtaccagttggttgtgctcggagccctcatgtttggcggggaacagtttctgaacatcaagggcgcggattccaaatctgttgtcaatactctcatattcaactccttcgtgttctgccaggtgttcaacgaaataaacagcagagaaatggagaagatcaacgtgttccgcggcatggtcaccaactggatcttcatcgcgatcatagccgcgacggtcctgttccaagtggtgatcgtagagctgctcggcacctttgccagcaccgtcccactcgactggcggctttggctgcttagcgtcggcctcggatcggttagcttggtcgtcggtgccgtcctcaagtgcataccagttgccaaatcgaacggagctcctgcgagtcccaacggctacgccccgctccccagcggtcctgacgacatttagctgaagaagaggggatgcatggagaaaagaagttgcatccgatttttgcgtcttgtttggaataagtaatgaaccactggctaggctcagctttagcagattgttctatatatatatatatatatatattgtcctgcaattacacgatcttcctgtttgctgattgttctatatatgaatgaacgcaatgcaaggcaccattatttccacgagccatggccttaaggaaacgaagttcttggccaactctatggtctcattatataccaaattttgatacacatgagtattttat

SEQ ID NO: 4021 - DNA, 3419 bp, Setaria italica
atggagtggctggagaagagcctgcaggaggacttcgatctgccgcccaagcacccctccgaggaggcgctgcggcgatggcgctccgccgtctccttcgtcaagaaccgccgccgacgcttccgcatggtcgccgacctcgacacccgcagccagaacgaagcgcgccgacgatccgtccaggaaaatttccgtaatttccgggtcgctctctacgtgcataaggctgcgttcaatttcatcgatggtgccaaaaataaagagtaccggataacagaggatattataaatgctggattttccatcaacccagatgaattggcatcgatcacaagcaagcatgatgtgaaagctctgaagatgcatggtggggtagatgggatatccaaaaagatccgttcaacatttgagcgtggcatatctgctagtgacttggatacaagacaaaacatctatggtgtcaatcgctatgcagagaaaccttcaagaagtttctggatgtttgtctgggatgcattgcaggacatgactcttatcattcttatggtatgtgccttgctatctgctgtagttggtctggcatctgaaggttttcccaagggcatgtatgatggcttgggaataatactcagcattttgttggttgtgatggttactgctatcagtgactataggcagtcgcttcagttcaaggagctagacaatgaaaagaagaagatatttatccatgtaaccagagacggctctcgacaaaagatctctatatatgacttggtagttggtgatatcgtgcacctatcaattggagaccaagtacctgctgatgggctgtacattcatggatactccctattgattgatgaatccagtttgtccggtgagagcgacccagtttatatttctcaagagaagccgttcctcttggcaggaaccaaagttcaggatggatcagctaagatgatgataactgctgtcggtatgcgcactgaatggggaagattgatgagcacgttgagtgaaggaggggaggatgagacaccattgcaggttaaactaaacggagttgcaaccatcatcgggaagattggcctggtgtttgccacattaacatttgtagtcctgatggttagattccttattgagaaaggtttaactgttggtttgtccaaatggtattctactgatgcattgaccatagtgaactactttgcaacagcagtcactattattgttgttgctgttcctgaagggctgcctctagctgttactttgagtcttgcatttgcaatgaaaaagttaatgaatgataaagcacttgtaagacatctttcagcatgtgagacaatgggatctgctggtaccatctgcactgataaaacaggaaccttgactactaaccatatggtggttgacaggatctggatatctgaggtttcaaagtcagttaccagtgacaatagtttggaagatctgaattctgtcatttctccaaccacactgggcctactcttgcagggcatttttgagaacaccagtgcagaggtagtcaaagaaaaggatggtacgcaaactgttttaggaactccaacagaaagggctatattagaatttggcttgaaattggaaggtcacaacgctgaggataggacctgcaccaaggttaaggttgagcctttcaattcggttaagaagaagatggcagtgttggtctcattgcccaatggcacataccgttggttctccaaaggtgcgtcagaaatcattgtgcagatgtgcgacatgatggttgatgctgatggaaatagtgttcccttatcagaagctcagagaaaggatatcttggatactatcaactcttttgcttcagatgctttgaggacactgtgcctggcatataaggaggtggatgattttgatgatgattcagatagtccgacaggtggatttactctaatatccatttttggcatcaaggatcctgtgcgcccaggagtcaaggatgctgtgaaggcctgcatgtctgctggtatcattgtgagaatggtgactggtgataatatcaatacagctaaagctatagccaaagaatgtggaatattgactgatgatggcgtagcaatagaaggaccagatttccgtagcaagagccctgaagagatgagggacttgatacccaagattcgggttatggctcgttctttaccattggacaagcatacccttgtgacgaacttgcgaggtatgtttcatgaggtggttgctgtgactggcgatggtactaatgatgctccagcattacatgaagcagatatcggacttgctatgggcatagcaggcacagaggtagccaaggaaagtgctgatgtgatagtacttgatgataattttacaactataatcagtgttgcaaggtggggtcgtgcggtttacataaacatacaaaaattcgtgcagtttcagctgactgtcaatattgttgctttagtcatcaactttgtctcagcatgcattacagggagtgctcctctcacagcagtgcagttgttgtgggtcaatatgattatggatacattaggagctttagctctagctacagagcctccaaatgatgacatgatgaagaggcctcctgttcggcgcggtgagagtttcattaccaaggtcatgtggcgaaatatcattgggcaaagtttatatcagttggttgtacttggagctctcatgtttggtggggagcaacttctgaacatcaagggttccgattccaaatctgttatcaatacactcatcttcaactcctttgtgttctgccaggttttcaatgaaataaacagcagggaaatgcagaagattaatgttttccgtggtatgatcagcaattggatctttattggaatcatagctgtaacagtcgcatttcaagtggtgatcatagaattcctcggcacgtttgccagcacggttccacttagttggcagctttggttggtaagtgtcggccttggatccatcagtttgattgttggtgccatcttgaagtgcatagcagttaattcggatgcaagtccttcaagtccaaatggctacgtgccgcttcccagtggtccggataacatatagctgaagaagagtgatcgacaaggtattgcatttgctagcattaacgggttcatggaagccccaaatacgccacatggctaccttacatttcgagtcctgcttgagattattaataaaccactgcctaggttcagatttaacaaattgccatgccttgtcatgcaattgctccttttcagtcctgattgctgttgctgagatgtaaaaaagagatggtgataaacacaacgtactctatttggtatgggtcatggaaacaatgttgttgactaatcgaagcacatttactttttgttctc

SEQ ID NO: 4022 - DNA, 3492 bp, Setaria italica
ctctgctctcggcctcggcgagctcgctcccggcggtggtggtggtggtgggaggggagggatggactggttcgagaagagcctgcagaagaacttcgatctgccgcccaagaacgcctccgaggaggcgcggcggcgatggcgctccgccgtcggcgccctcgtcaagaacccccggcgccgcttccgcatggtcgccgacctcgacacccgaagccagaacgaactcatgcgacgatccgcccaggaaaaaatccgggttgccatctacgtgcagcaggctgcgctcaatttcattgatggtgccaaatataaagagtaccggataacagaggatattatcaatgctggattttccatcaacccagatgaattggcatcgatcacaagcaagcatgatgtgaaagctctgaagatgcatggtggggtagatgggatatccaaaaaaatccgttcaacatttgagcgtggcatatctgctagtgacttggatacaagacaaaacatctatggtgtcaatcgctatgcagagaaaccttcaagaagtttctggatgtttgtctgggatgcattgcaggacgtgactcttatcattcttatggtatgtgctttgatatctgctgtagttggtctggcatctgaaggttttcccaagggcatgtatgatggcttgggaataatactcagcattttgttggttgtgatggttactgctatcagtgactataggcagtcgcttcagttcaaggagctagacaatgaaaagaagaagatatttatccatgtaaccagagacggctctcgacaaaagatctctatatatgacttggtggttggtgatatcgtgcatctatcaattggagaccaagtacctgctgatgggttgtacactcatggatactccctattgattgatgaatccagcttgtcgggtgagagcgacccagtttatatttctcaagagaagccgttcctcttggcaggaaccaaagttcaggatggatcagctaagatgatggtaactgctgttggtatgcgcactgaatggggaagattgatgagcacgttgagtgaaggaggggaggatgagacaccattgcaggttaaactaaacggagttgcaaccatcatcgggaagattggcctggtgtttgccacattaacatttgtagtcctgatggttagattccttattgagaaaggtttaactgttggtttgtccaaatggtattctactgatgcattgaccatagtgaactactttgcaacagcagtcactattattgttgttgctgttcctgaagggctgcctctagctgttactttgagtcttgcatttgcaatgaaaaagctaatgaatgataaagcactcgtaagacatctttcagcatgtgagacaatgggatctgctggtaccatctgcacagataaaacaggaactttgactactaaccatatggtggttgacaggatctggatatctgaggtttcaaagtcagttaccagtgacaatagtttggaagatctgaattctgtcatttctccaaccacactgggcctactcttgcagggcatttttgagaacaccagtgcagaggtagtcaaagaaaaggatggtacgcaaactgttttaggaactccaacagaaagggctatattagaatttggcttgaaattggaaggtcacaacactgaggataggacctgcaccaaggttaaggttgagcctttcaattcggttaagaagaagatggcagtgttggtctcattgcccaatggcacataccgttggttctccaaaggtgcgtcagaaatcattgtgcagatgtgtgacatgatggttgatgctgatggaaatagtgttcccttatcagaagctcagagaaaggatatcttggatactatcaactcttttgcttcagatgccttgaggacactgtgcctggcatataaggaggtggatgatttcgatgatgattcagatagtccgacaggtggatttactctaatatccatttttggcatcaaggatcctgtgcgcccaggagtcaaggatgctgtgaaggcctgcatgtctgctggtatcattgtgagaatggtgactggtgataatatcaatacagctaaagctatagccaaagagtgtggaatattgactgatgatggtgtagcaatagaaggaccagatttccgtagcaagagccctgaagagatgagggacttgatacccaagattcgggttatggctcgttctttaccattggacaagcatacccttgtgacgaacttgcgaggtatgtttcatgaggtggttgctgtgactggcgatggtactaatgatgctccagcattacatgaagcagatatcggacttgctatgggcatagcaggcacagaggtagccaaggaaagtgctgatgtgatagtacttgatgacaattttgcaactataatcaatgttgcaaggtggggtcgtgcagtttacataaacatacaaaaattcgtgcagtttcagctgactgtcaatattgttgctttagtcatcaactttgtctcagcatgcattacagggagtgctcctctcacagcagtgcagttgttgtgggtcaatatgattatggatacattaggagctttagctctagcgacagagcctcccaatgatgacatgatgaagaggcctcctgttcggcgcggtgagagtttcattaccaaggtcatgtggcgaaatatcattgggcaaagtttatatcagttggttgtacttggagctctcatgtttggtggggagcaacttctgaacatcaaaggttctgattccaaatctgttatcaatacactcatcttcaactcctttgtgttctgccaggtgttcaatgaaataaacagcagggaaatgcagaagattaatgttttccgtggtatgttcagcaattggatctttattggaatcatagctgtaacagtcgcatttcaagtggttataatagaatttctcggcacgtttgccagcaccgttccacttaactggcagctttggttggtaagtgtcggccttggatccatcagtttgatcgttggtgccatcttgaagtgcataccagttaattcagatgcaagtccttcaagtccaaatggctacgtgccgcttcccagtggtccggataacatatagctgaagaagagcgatcgacaaggtactgcatttgctagcattaacgggtccatgagaactccaaatacgccacgcggctaccttacatttcgagtcctgcttgagatcattaataaaccactgcctaggttcagttttaacaaattgttctatgccttgtcatgcaattgctcgttctcagtcctgattgcagttgctgaaatgtaaaaagagatggtgatgaacacaacgcgccctatttggtatgggtcatggaaacaatgttgttgactaattgaagtacaattactttgttctactaagcaaagttcagtttt

SEQ ID NO: 4023 - DNA, 3579 bp, Sorghum bicolor
gtggccagtgggcgagcaagcaaggaaaaccccattccattccacacctttacctccgagcaccggccgccgggatggagtggctggagaagaacctgcaggagaagttcgacctgccgcccaagaaccgctccgaggaggccctgcgccgatggcgcgacgccgtctccgtcgtcaagaacccgcgccgccgcttccgcatggtcgccgacctcgcctcgcgccaacagaacgagctcaagcgacgatccgtccaggaaaagatccgggtcgccctctatgtgcagcaggctgcgctcaatttcatcgatggtgtcaaacataaagactaccggctaactgatgatattatcaaggctgggttttccatcaacccagatgagctggcgtcgatcacaagcaaacatgatatgaaagttttgaagatgcatggtggggtagatgggatatccacaaaagtacgttcatcatttgaccatggcatatctgctagcaacttggatactaggcaaaccatctatggtgaaaatcgctacacggaaaaacctccaagaagtttctggatgtttgtctgggatgcgttgcaggacatgactcttatcatccttatggtatgtgctctgctatctgctgtagttggtctggcatctgaaggctggcccaagggcatgtatgatggcctgggaataatactcagcattctgttggttgtgatggttactgctgtcagtgactacaggcagtcgcttcagttcaaggagctagacaatgagaagaagaagatatttatccatgtaaccagggacggctgtcggcagaagatctctatatatgacttggtagttggtgatattgtgcacctgtcaattggagaccaagtgcctgctgatggactgtacattcatggatattcccttttgattgatgaatccagcttgtcaggtgagagtgagccagtttatatttctcaagataagccattcatcttggcaggaactaaagtccaagatggatcagctaagatgctggtaactgctgttggcatgcgcactgaatggggaaggctgatgagcacgttgagtgaaggaggggaggatgagacaccattgcaggttaagctcaacggagttgcaaccatcatcgggaaaattggcctgctgtttgccacattaacatttgttgtcctgatggttagattccttattgagaaaggtttgacagttggtctgtccaagtggtactctacagatgcattgactatcgtaaactactttgcaacagcagtcactattattgttgttgctgtccctgaagggctgcctctagctgttactttgagtctggcatttgcaatgaaaaagctaatgaatgataaagcacttgtaagacatctttcagcatgtgagacaatgggatctgctggtactatatgcactgataaaactggaactttgactaccaaccatatggtggttgacaagatatggatatctgaggtttcaaagtcacttaccagtaacaacagtttggaagatctgaattctgccatttctccagccacattgagcctacttctgcagggcatttttgagaacactagttcagaggtagtcaaagacaaggatggtgggcaaactgttttgggaaccccaacagagagggcaatcttagaatttggattgaaactagaaggacatcatgatgctgaagataggagctgcaccaaggttaaggttgaacctttcaattcagtgaagaagaagatggcagtgttggtctcattacccaatggcaaataccgttggtacaccaaaggtgcatcagaaattattgtgcaaatgtgtgacatgatgattgatggcgatggaaacagtgttcccttgtcggaagctcagaggaagaacgtcttgggtactatcaactcttttgcttcagatgctttaaggacattgtgcctggcatataaggaaggggatgatttcagtgatgatacagatagtccaacaggcggttttactctaatatctatttttggaatcaaggatcctgtgcgcccaggagtcaaggaagctgttgaggcctgtatgtctgctggtatcatagtacgaatggtgactggtgacaatatcaatacagctaaagctatagccaaagagtgtggaatactgactgatggtggcatagcaatagaaggaccagaattccgaaacaaaagcccagaggagatgagggacctgatacctaagattcaggttatggctcgttctttaccacttgacaagcatacccttgttacaaacttgcgaggtatgttcaaggaggtggttgctgttacaggcgatggtacgaatgatgctccagcattgcatgaagcagatattgggcttgcaatgggtatagcaggaacagaggtagccaaggagagtgctgatgtgatagtgcttgatgataattttacaactataataaacgtcgcaaggtggggtcgtgcagtttacataaacattcagaagtttgtgcagtttcagttgactgtcaatattgttgctttggtcatcaactttgtctcagcatgtattacaggaagtgctcctctcacagcagtgcaattgttgtgggtcaatatgatcatggatacattaggagctttagctctagcaacagagcctccaaacgatgacatgatgaagaggccacctgttgggcgaggagagagtttcattaccaaagtcatgtggcgaaatatcattgggcaaagtttatatcagttggctgtacttggagctctcatgtttggcggggaacgtcttctgaacctcaagggtgcagattccaaatctgttatcaatacactcatattcaactcctttgtgttctgccaggtgttcaatgaaataaacagcagggaaatgcagaagatcaatgttttccgtggcatgttcagcaactggatcttcattggaatcatagctgtgacagcagctttccaagtggtgatcatcgaattcctcggcacctttgccagcaccgttccacttagctggcagctgtggctggtaagcgtcggtctcggatccatcagcttgatcgtcggtgtcatcctaaagtgcataccagttaaatcagatggaactcgcgcgagtccaaatgggtacgcaccgcttcccagcggtcctgataacatatagctggagaagagaagagaagagcgacgacggagaaggtactactgacgaactgtgttcgctagcattagcgaattcatgagaacctcaggagcactgcggctaccttatattttgggacctgttcggaataagtctgacttgtctgggttcagtgattttcgcatgaaggaacctcggaaccaaccactgtcgtctaggttcagttttaacagattattctgtgccttgtcatgcaactgctcttgtttgcagttggtggtactgtgtaaaaagacatggtggtgagtgagcacaaggcactctactttcatgggtcatggaaacgaaacctcgtactaatggaagtacattaattaactgttgcgttgggctggctttgtttgcaatgctg

SEQ ID NO: 4024 - DNA, 4107 bp, Sorghum bicolor
gtcagaatcagtggcaatctagtccatccagtagacgacgttcgtagctagtgcgccatcgtggcgcggcggcggcggcggtggccgccggcgtacgtgtgcactggccataggcgtcctcccgccggccgccgtaccgtacgtgacatgaggatggtccaaagcagccagccatcggagatggacggacacctgccgcggcagccattagaggagaggaggcttccggccgcccgctgattgggcccaagccgcgcagacgagtgggccctggttgggtagtcaacgtccggcagaccacgaccggcgaccgccagaggtggacgggtggaggtgcaggtggaggccgtcctctctctccttttctttaccattttttccccctcaactcgccatcgcaccatcctgtggaggggatgggaggagggtggtagcctggcctctgctctgctctgctctgctctgctctcctttcctcctgtggccagtgggcgagcaagcaaggaaaaccccattccattccacacctttacctccgagcaccggccgccgggatggagtggctggagaagaacctgcaggagaagttcgacctgccgcccaagaaccgctccgaggaggccctgcgccgatggcgcgacgccgtctccgtcgtcaagaacccgcgccgccgcttccgcatggtcgccgacctcgcctcgcgccaacagaacgagctcaagcgacgatccgtccaggaaaagatccgggtcgccctctatgtgcagcaggctgcgctcaatttcatcgatggtgtcaaacataaagactaccggctaactgatgatattatcaaggctgggttttccatcaacccagatgagctggcgtcgatcacaagcaaacatgatatgaaagttttgaagatgcatggtggggtagatgggatatccacaaaagtacgttcatcatttgaccatggcatatctgctagcaacttggatactaggcaaaccatctatggtgaaaatcgctacacggaaaaacctccaagaagtttctggatgtttgtctgggatgcgttgcaggacatgactcttatcatccttatggtatgtgctctgctatctgctgtagttggtctggcatctgaaggctggcccaagggcatgtatgatggcctgggaataatactcagcattctgttggttgtgatggttactgctgtcagtgactacaggcagtcgcttcagttcaaggagctagacaatgagaagaagaagatatttatccatgtaaccagggacggctgtcggcagaagatctctatatatgacttggtagttggtgatattgtgcacctgtcaattggagaccaagtgcctgctgatggactgtacattcatggatattcccttttgattgatgaatccagcttgtcaggtgagagtgagccagtttatatttctcaagataagccattcatcttggcaggaactaaagtccaagatggatcagctaagatgctggtaactgctgttggcatgcgcactgaatggggaaggctgatgagcacgttgagtgaaggaggggaggatgagacaccattgcaggttaagctcaacggagttgcaaccatcatcgggaaaattggcctgctgtttgccacattaacatttgttgtcctgatggttagattccttattgagaaaggtttgacagttggtctgtccaagtggtactctacagatgcattgactatcgtaaactactttgcaacagcagtcactattattgttgttgctgtccctgaagggctgcctctagctgttactttgagtctggcatttgcaatgaaaaagctaatgaatgataaagcacttgtaagacatctttcagcatgtgagacaatgggatctgctggtactatatgcactgataaaactggaactttgactaccaaccatatggtggttgacaagatatggatatctgaggtttcaaagtcacttaccagtaacaacagtttggaagatctgaattctgccatttctccagccacattgagcctacttctgcagggcatttttgagaacactagttcagaggtagtcaaagacaaggatggtgggcaaactgttttgggaaccccaacagagagggcaatcttagaatttggattgaaactagaaggacatcatgatgctgaagataggagctgcaccaaggttaaggttgaacctttcaattcagtgaagaagaagatggcagtgttggtctcattacccaatggcaaataccgttggtacaccaaaggtgcatcagaaattattgtgcaaatgtgtgacatgatgattgatggcgatggaaacagtgttcccttgtcggaagctcagaggaagaacgtcttgggtactatcaactcttttgcttcagatgctttaaggacattgtgcctggcatataaggaaggggatgatttcagtgatgatacagatagtccaacaggcggttttactctaatatctatttttggaatcaaggatcctgtgcgcccaggagtcaaggaagctgttgaggcctgtatgtctgctggtatcatagtacgaatggtgactggtgacaatatcaatacagctaaagctatagccaaagagtgtggaatactgactgatggtggcatagcaatagaaggaccagaattccgaaacaaaagcccagaggagatgagggacctgatacctaagattcaggttatggctcgttctttaccacttgacaagcatacccttgttacaaacttgcgaggtatgttcaaggaggtggttgctgttacaggcgatggtacgaatgatgctccagcattgcatgaagcagatattgggcttgcaatgggtatagcaggaacagaggtagccaaggagagtgctgatgtgatagtgcttgatgataattttacaactataataaacgtcgcaaggtggggtcgtgcagtttacataaacattcagaagtttgtgcagtttcagttgactgtcaatattgttgctttggtcatcaactttgtctcagcatgtattacaggaagtgctcctctcacagcagtgcaattgttgtgggtcaatatgatcatggatacattaggagctttagctctagcaacagagcctccaaacgatgacatgatgaagaggccacctgttgggcgaggagagagtttcattaccaaagtcatgtggcgaaatatcattgggcaaagtttatatcagttggctgtacttggagctctcatgtttggcggggaacgtcttctgaacctcaagggtgcagattccaaatctgttatcaatacactcatattcaactcctttgtgttctgccaggtgttcaatgaaataaacagcagggaaatgcagaagatcaatgttttccgtggcatgttcagcaactggatcttcattggaatcatagctgtgacagcagctttccaagtggtgatcatcgaattcctcggcacctttgccagcaccgttccacttagctggcagctgtggctggtaagcgtcggtctcggatccatcagcttgatcgtcggtgtcatcctaaagtgcataccagttaaatcagatggaactcgcgcgagtccaaatgggtacgcaccgcttcccagcggtcctgataacatatagctggagaagagaagagaagagcgacgacggagaaggtactactgacgaactgtgttcgctagcattagcgaattcatgagaacctcaggagcactgcggctaccttatattttgggacctgttcggaataagtctgacttgtctgggttcagtgattttcgcatgaaggaacctcggaaccaaccactgtcgtctaggttcagttttaacagattattctgtgccttgtcatgcaactgctcttgtttgcagttggtggtactgtgtaaaaagacatggtggtgagtgagcacaaggcactctactttcatgggtcatggaaacgaaacctcgtactaatggaagtacattaattaactgttgcgttgggctggctttgtttgcaatgctgcagctgcacttgttaccttccatctactgctgatctctgacggccaat

SEQ ID NO: 4025 - DNA, 3844 bp, Oryza sativa
gcccataccacacgaaaaagtgaacggaaagttgtagcaatctcctggtcaataccacatcgatctctcgtcaaaaacaaaagaaaatttcaacctacaaactagtgttcgaggccataggcatacacactggagaggaaaattttaagttaggaaaatggagatccgatcgcctgccgtttccatattctttatccccagaccatacaggcgcagagccagttgtctccttgttttaggccaagttgaaagcttttggactttgaagggaaaaaaaaactcctctccctctctccccttcctctccggccgggcagaaaagagtactagtagtggagtggtggactgcgcttcgtgtgcgtgagcgtgagcgtgctcaccggccggggatggagaagcttgacaggtacctgcaggagcacttcgatgtgccggccaagaacccgtcggaggaggcgcagcggcgatggcggcaagccgttggcaccatcgtcaagaaccgccgccgccgcttccgctgggtgcccgacctcgaccgccgctccttggacaaggccaaggtccgctccacccaggaaaagattcgggttgccctctatgtgcagcaggctgcactcatttttagtgatgtgccaaaaagaaagagttcaagctaacagaggatattattaaagctagattttccatcaatccagatgaactagcattgatcacaagcaagcatgattcgaaagctttaaagatgcatggtggggtagatgggatatctaaaaaagtccgttcatcgtttgatcatggcatatgtgctagtgacttagatacaagacagaacatatatggcgtcaaccgttatgcagaaaagccttcaagaagtttctggatgtttgtttgggatgcattccaggacatgacccttataattcttatggtatgtgcattgctatctgttgcagttggtttggcaacagaaggatggccaaagggcatgtatgatggcttgggtataatactcagcattttcttagttgttatggttactgctgttagtgattataagcagtcactccaatttaaggagctagacaatgaaaagaaaaagatatttatccatgtaaccagagatgggcgtcgacaaaagatctctatatatgacttggtagttggtgatatagttcatctgtcaattggagatcaagtacctgctgatggactatatatacatgggtactcccttttgattgatgagtccagcttatctggtgagagtgacccagtgtatgtttctcaagacaaaccattcatcttggcaggaactaaagtgcaagatggatctgctaagatgatagtaactgctgtcggtatgcgcactgaatggggaaaattgatgagcacattgagtgagggaggagaggatgagacaccactgcaggttaagctaaatggagttgcgaccgttataggaaagattggactggtatttgccatattaacatttttagttctgctggttagattcctcattgacaaaggcatgacggttggtctgctcaaatggtattctaccgatgcattgactatagtaaactactttgcaacagcggtaaccattatagttgttgctgtacctgaaggattacccttggctgttactttgagtcttgcatttgcaatgaaaaagttaatgaatgataaagcacttgttagacatctttcagcgtgcgaaacaatgggatctgctggtaccatctgcacggacaaaacaggaactttgactactaactatatggttgttgacaaaatatggatatctgaggtttcaaagtcagttaccagtaacaccatttcaggagaacttaattctgtggtttcttctagaacattgagtctgcttttgcagggaatttttgagaatactagcgctgaggtggtcaaggaaaaggatggcaagcaaactgtcttaggaactccaacagaaagagcaatattagaatttggcttgggcttggaaggagttcatgatgctgagtatagtgcctgcaccaaggttaaggttgagcctttcaattcagtcaagaagaagatggcagtgctgatttcattacccagtggcacgtccagatggttttgcaaaggtgcatcagaaattattttgcagatgtgcgacatgatggttgatggcgatggaaatgctattcccttatcggaagctcagagaaagaacatcttagatactatcaactcatttgcttcagatgctttaaggacgttgtgcctggcatataaggaagtggatgatgatattgatgacaatgcagatagtccaacaagtggttttactctaatagccattttcggtatcaaggatcctgtgcgccctggagttaaggatgctgttaagacctgtatgtctgctggtatcacagtaagaatggtaactggtgataatataaatacagctaaagctatagctaaagagtgtggaatattgactgaagatggtgtagcaatagaaggaccagaattccatagcaagagcccagaagagatgagggacctgataccgaatattcaggttatggcccgttctttaccattggataaacatacactcgtgacaaacttgcgaggtatgtttgatgaggtggtttctgtgacaggtgatggtacaaatgatgctcctgcattacacgaagcagatatcgggcttgctatgggcattgcaggaacagaggttgccaaggagagtgcagatgtcatagtacttgacgacaatttcactactataataaatgttgcaagatggggtcgtgcagtttatattaacatccaaaagtttgtgcagtttcaattgactgtcaatattgttgctttagttatcaattttgtctcagcatgcatcacagggagcgctcctctcactgctgtgcagctattgtgggtcaatatgatcatggatacactgggagctttagcactagcaacagagcctccaaatgatgaaatgatgaagaggccacctgtccgaaaaggggaaagtttcattaccaaggtcatgtggagaaatatcatgggccaaagtttgtatcagctatttgtacttggagctctcatgtttggtggagaaagccttctgaacatcaagggtgcagattccaaatccatcataaatacactgatcttcaactccttcgtgttttgtcaggtattcaatgaaataaacagcagagaaatgcagaagatcaatgttttccgtggtatcatcagcaattggatcttcattgcagtcatagctgcaaccgtagcatttcaagtggtgatcatagagtttcttggcactttcgccagtactgttccgctcaactggcaacattggctgctcagcgtcggccttggctccatcagcctgattgttggtgtcatcttgaagtgtataccagttggttcaggtgaaacctctgcaactccaaatggatacaggccacttgccaatggccctgatgacatatagctgaagaataatcactaataagggaaagtagaatccagggtgcaatacggcatccagctgcccagctcagttcagttgttttggaatacactaaccatccactgattttgttcaaattttgccaaactgcactatatcctgtcatgtaattgttactacatcacacgttactgatgtgcacctttaccactctgctttcaacttcagactttattgtatcagtgaattcatatgatagacggttgttagtgcaacaagttattgtggtttggattcacactgaaataatcttttgatgccatatatgccatttgaaactgatatatattagcaccc

SEQ ID NO: 4026 - DNA, 3427 bp, Brachypodium distachyon
gaaggaagaagatggagaggtatctgcaggagaacttcgagctgccgtccaagaacccgtcggaggaggcgcagcggcggtggcgctccgccgtcggcaccctcgtcaagaaccgccgccgccgcttccgccacgtgcccgacctcgaccagcgccaccaggaccacgccaagcgccgctccgtccaggaaaaaattcgggttgccctctacgtgcagcaggccgcaatcactttcattggcggtgccaagaagaacgagtaccagctaacagaggatataatcaaagctgggttttccatcaaccctgaagaactggcatcaataacaagcaagcatgacttgaaagctttaaagatgcatggtggggtagatgggatatccaaaaaaatccgttcaacattcgaccgtggcataagttgtagtgacttggatacaagacaaaacatatatggtgtcaatcgttacgctgaaaaaccttcaagaagtttctggagttttgtttgggacgcattgcaggacatgacccttatcattcttatggtatgtgctttgttatctgttgtagttggcctggcatctgaaggttggccaaagggcatgtacgatggcttggggataatactcagcatcctcttggtcgtgatggttactgctgccagtgactataagcaatctctccagtttaaggagctagacaatgaaaagaaaaatatatttatccatgtaacgagagacggcagtcgacaaaaggtctcaatatacgacttggtagttggtgatatcgtgcatttatcaattggagaccaagtacctgctgatggaatttttatacatggatactcccttttgattgatgaatccagcttatcaggtgagagcgagccagtttatacttctcaagacaagccattcattttggcaggaactaaagtgcaagatggctctgctaagatgatagtaacttctgtcggtatgcgcactgaatggggaaggctgatgagcactttgagtgagggaggagaagatgagacaccattgcaggtaaagctaaatggagttgcgaccattatagggaagattggtttggtatttgccacactaacatttgtagtcctgatggctagattccttgtcgataaaggtttaacagttggtttgtccaaatggtattctactgatgccttgactatagtaaactattttgcaacagcggtcactattattgttgttgctgttcctgaagggttgccattggctgttactttgagccttgcgttcgcaatgaagaagttaatgaatgacaaagcccttgttagacacctcgcagcatgtgaaacaatgggatctgctggtaccatctgcacagacaaaacaggaactttgactactaaccatatggtggttgacaaaatttggatagctgagatttcaaagtcagttaccagtaacaatagtttggaagatctgaattctgcgatttcttcaagcgcatggagcctacttttgcaggggatttttgagaacactagtgcagaagtggtcgaaggaaaggatggtaaacaaaccgttttaggtactccaacagaaatagcgatatttgaatatggtttgaagttgcaaggctatcgcgatgctgaggataggacctgcaccaaggttaaggttgagcctttcaattcagtcaagaagaagatggcagtattgatttccttacctggtggtacgaaccgctggttctgcaaaggcgcgtcagaaattgttgttgagatgtgcgacatggtgattgatgaggatggaaatgctattcccttatcagacgctcggaaaaagaacatcatagatactatcaactcatttgcttcagatgctttaaggacattgtgcctcgcgtttaaagatgtggatgattttgatgaggatgcagatagtcctccaagtggttttactctgatagtcatatttggcatcaaggatcctgtgcgccctggtgtgaaggaagctgttcagagctgtatatctgctggcatcattgtgagaatggtgactggtgataatatcaatacagctaaagcaatagccaaggagtgtggaatattgactgatgatggtatagcaatagaaggaccagatttccgtaccaagagcccagaggagatgatggacttgatacccaaaattcaggtcatggcccgttcattaccattagacaaacatctgcttgtgacaaatttgagaggtatgtttcaagaggtggttgctgtgacaggtgatggtacaaacgatgctcctgcattacacgaagcagatattgggcttgccatgggcattgcaggcacggaggttgccaaggagagtgccgatgtcatagtacttgatgacaatttcacaactataataaatgttgcaaggtggggtcgtgcggtttacataaacatccagaagtttgtgcagtttcaattgactgtcaatattgttgctttagtgatcaactttgtctcagcgtgcatcacagggagtgctcctctcaccgctgtgcagctgctgtgggtcaatatgattatggatacattaggagctttagctctggcaacagagccaccaaatgacgaaatgatgaagaggccgcctgttgggcgaggagaaagtttcattaccaatgtcatgtggagaaatatcattggacaaagtatatatcagttgattgtacttggagttctcatgttcggcggggaaacctttctgaacatcaagggtgcagattccaaaaccgttatcaacacactcatattcaactccttcgtattttgccaggtattcaacgaagtaaacagcagggaaatggagaagataaatgttttccgtggtctcctcagcaactgggtcttcatcggggtcatatctgcaactgtagtattccaagtggtgatcattgaatttcttggcacttttgccagcacagttccgctcagctgggagcactggttggtaagtgtcggcctagggtcgatcagcttgatcatcggtgctatcttgaagtgcataccagtgaaatcaggtgaaatctccgctagcccgaacggttacagacaacttgccaatggtcctgatgacatatagctggagagtaatcgaataagtgccatgtttgctaccagtagaattcaggacggatcactgttgcattgcatcccactttttgggtctattttggtaccagtagaattcaggatggatcactgtcgcattgcatcccattttttggccctattttggtgtaaattaaccagccactgccgttgtcacaatttccgccagtttgttccactatttgtcagcgttgcatttgttaggagaatccactcaaaacattctgggattaccttgccggagaacttttaatccagtacaggactttttgcatttat

SEQ ID NO: 4027 - DNA, 3511 bp, Brachypodium distachyon
ggaggaaggaaggaagaagatggagaggtatctgcaggagaacttcgagctgccgtccaagaacccgtcggaggaggcgcagcggcggtggcgctccgccgtcggcaccctcgtcaagaaccgccgccgccgcttccgccacgtgcccgacctcgaccagcgccaccaggaccacgccaagcgccgctccgtccaggaaaaaattcgggttgccctctacgtgcagcaggccgcaatcactttcattggcggtgccaagaagaacgagtaccagctaacagaggatataatcaaagctgggttttccatcaaccctgaagaactggcatcaataacaagcaagcatgacttgaaagctttaaagatgcatggtggggtagatgggatatccaaaaaaatccgttcaacattcgaccgtggcataagttgtagtgacttggatacaagacaaaacatatatggtgtcaatcgttacgctgaaaaaccttcaagaagtttctggagttttgtttgggacgcattgcaggacatgacccttatcattcttatggtatgtgctttgttatctgttgtagttggcctggcatctgaaggttggccaaagggcatgtacgatggcttggggataatactcagcatcctcttggtcgtgatggttactgctgccagtgactataagcaatctctccagtttaaggagctagacaatgaaaagaaaaatatatttatccatgtaacgagagacggcagtcgacaaaaggtctcaatatacgacttggtagttggtgatatcgtgcatttatcaattggagaccaagtacctgctgatggaatttttatacatggatactcccttttgattgatgaatccagcttatcaggtgagagcgagccagtttatacttctcaagacaagccattcattttggcaggaactaaagtgcaagatggctctgctaagatgatagtaacttctgtcggtatgcgcactgaatggggaaggctgatgagcactttgagtgagggaggagaagatgagacaccattgcaggtaaagctaaatggagttgcgaccattatagggaagattggtttggtatttgccacactaacatttgtagtcctgatggctagattccttgtcgataaaggtttaacagttggtttgtccaaatggtattctactgatgccttgactatagtaaactattttgcaacagcggtcactattattgttgttgctgttcctgaagggttgccattggctgttactttgagccttgcgttcgcaatgaagaagttaatgaatgacaaagcccttgttagacacctcgcagcatgtgaaacaatgggatctgctggtaccatctgcacagacaaaacaggaactttgactactaaccatatggtggttgacaaaatttggatagctgagatttcaaagtcagttaccagtaacaatagtttggaagatctgaattctgcgatttcttcaagcgcatggagcctacttttgcaggggatttttgagaacactagtgcagaagtggtcgaaggaaaggatggtaaacaaaccgttttaggtactccaacagaaatagcgatatttgaatatggtttgaagttgcaaggctatcgcgatgctgaggataggacctgcaccaaggttaaggttgagcctttcaattcagtcaagaagaagatggcagtattgatttccttacctggtggtacgaaccgctggttctgcaaaggcgcgtcagaaattgttgttgagatgtgcgacatggtgattgatgaggatggaaatgctattcccttatcagacgctcggaaaaagaacatcatagatactatcaactcatttgcttcagatgctttaaggacattgtgcctcgcgtttaaagatgtggatgattttgatgaggatgcagatagtcctccaagtggttttactctgatagtcatatttggcatcaaggatcctgtgcgccctggtgtgaaggaagctgttcagagctgtatatctgctggcatcattgtgagaatggtgactggtgataatatcaatacagctaaagcaatagccaaggagtgtggaatattgactgatgatggtatagcaatagaaggaccagatttccgtaccaagagcccagaggagatgatggacttgatacccaaaattcaggtcatggcccgttcattaccattagacaaacatctgcttgtgacaaatttgagaggtatgtttcaagaggtggttgctgtgacaggtgatggtacaaacgatgctcctgcattacacgaagcagatattgggcttgccatgggcattgcaggcacggaggttgccaaggagagtgccgatgtcatagtacttgatgacaatttcacaactataataaatgttgcaaggtggggtcgtgcggtttacataaacatccagaagtttgtgcagtttcaattgactgtcaatattgttgctttagtgatcaactttgtctcagcgtgcatcacagggagtgctcctctcaccgctgtgcagctgctgtgggtcaatatgattatggatacattaggagctttagctctggcaacagagccaccaaatgacgaaatgatgaagaggccgcctgttgggcgaggagaaagtttcattaccaatgtcatgtggagaaatatcattggacaaagtatatatcagttgattgtacttggagttctcatgttcggcggggaaacctttctgaacatcaagggtgcagattccaaaaccgttatcaacacactcatattcaactccttcgtattttgccaggtattcaacgaagtaaacagcagggaaatggagaagataaatgttttccgtggtctcctcagcaactgggtcttcatcggggtcatatctgcaactgtagtattccaagtggtgatcattgaatttcttggcacttttgccagcacagttccgctcagctgggagcactggttggtaagtgtcggcctagggtcgatcagcttgatcatcggtgctatcttgaagtgcataccagtgaaatcaggtgaaatctccgctagcccgaacggttacagacaacttgccaatggtcctgatgacatatagctggagagtaatcgaataagtgccatgtttgctaccagtagaattcaggacggatcactgttgcattgcatcccactttttgggtctattttggtaccagtagaattcaggatggatcactgtcgcattgcatcccattttttggccctattttggtgtaaattaaccagccactgccgttgtcacaatttccgccagtttgttccactatttgtcagcgttgcatttgttaggagaatccactcaaaacattctgggattaccttgccggagaacttttaatccagtacaggactttttgcatttatttaaaaccaccatatggctatcaaaattattaaattgttggtttccaatcaggttaatgatgcgtggcatgtaaag

SEQ ID NO: 4028 - DNA, 3801 bp, Oryza sativa
ggaaagaaagattcaattagaaaatggcgatccgatcgcctgccattttccatattctttatcccaaacatacagggcatatgcagttgtcttcttttattagaccaagaagttgtaagctttggagaaaaaaataactcctttccctctctccccttcctctccggccgggcagagcagagtagtagtggaaagtggagtggtagactgcgctgcgtgtgcgtgctcaccggccgcggccggagatggagaagctggacaggtacctgcaggagaacttcgatgtgccggccaagaacccgtccgaggaggcgcagcggcgatggcggcaagccgtcggcaccatcgtcaagaatcgccgccgccgcttccgctgggtgcccgacctcgagcgccgctccttggacaaggccaaggtccgctccacccaggaaaagattcgggttgccctctatgtgcaacaggctgcactcatttttagtgatggtgccaaaaagaaagaatacaaactaacaggggatattattaaagctggatatgccatcaatccagatgagctagcattgatcacaagcaagcatgattcaaaagctttaaagatgcatggtggggtagatgggatatctataaaagttcgttcatcatttgatcatggcatatatgctagtgagttagatacaagacaaaacatatatggcgtcaaccgttatgcagaaaagccttcaagaagtttctggatgtttgtttgggatgcattgcaggacatgacccttataattcttatggtatgtgcattgctatctgttgcagttggtttggcaacagaaggttggccaaagggcatgtatgatggcttgggtataatactcagcattttcttagttgttatggttactgctgttagtgattataagcagtcacttcagtttaaggagctagacaatgaaaagaaaaagatatttatccatgtaaccagagatgggcgtcgacaaaagatctctatatatgacttggtagttggtgatatagttcatctgtcaattggagatcaagtacctgctgatggactgtatatacatgggtactcccttttgattgatgagtccagcttatctggtgagagtgacccagtgtatgtttctcaagacaaaccattcatcttggcaggaactaaagtgcaagatggatctgctaagatgatagtaactgctgtcggtatgcgcactgaatggggaaaattgatgagcacattgagtgagggaggagaggatgagacaccactgcaggttaagctaaatggagttgcgaccattataggaaagattggactggtatttgccatattaacatttttagttctgctggttagatttctcattgacaaaggcatgacggttggtttgctcaaatggtattctactgatgcattgactatagtaaactactttgcaacagcagtaaccattatagttgttgctgtacctgaaggattgcccttggctgttactttgagtcttgcatttgcaatgaaaaagttaatgaatgataaagcacttgttagacatctttcagcgtgtgaaacaatgggatctgctggtaccatctgcacggacaaaacaggaactttgactactaaccatatggttgttgacaaaatatggatatctgaggtttcaaagtcagttaccagtaacaccatttcaggagaacttaattctgtggtttcttctagcacattgagtctgcttttgcagggaatttttgagaatactagcgctgaggtggtcaaggaaaaggatggcaagcaaactgtcttaggaactccaacagaaagagcaatattagaatttggcttgggcttgaaaggagatcatgatgctgagtatagggcctgcaccaaggttaaggttgagcctttcaattcagtcaagaagaagatggcagtgctgatttcattacccaatggcacgtccagatggttttgcaaaggtgcatcagaaattattttgcagatgtgcgacatgatggttgatggcgatggaaatgctattcccttatcggaagctcagagaaagaacatcttagatactatcaactcatttgcttcagacgctttaaggacgctgtgcctggcatataaggaagtggatgatgatattgatgacaatgcagatagtccaacaagtggttttactctaatagccattttcggtatcaaggatcctgtgcgccctggagttaaggatgctgttaagacctgtatgtctgctggtatcacagtaagaatggtaactggtgataatataaatacagctaaagctatagctaaagagtgtggaatattgactgaagatggtgtagcaatagaaggaccagaattccatagcaagagcacagaagagatgagggacctgatactaaatattcaggtcatggcccgttctttaccattggataagcatacactcgtgacaaacttgcgaggtatgtttgatgaggtggtttctgtgacaggtgatggtacaaatgatgctcctgcattacacgaagcagatattgggcttgctatgggcattgcaggaacagaggttgccaaggagagtgcagatgtcatagtacttgacgataatttcacaactataataaatgttgcaagatggggtcgtgcagtttatattaacatccaaaagtttgtgcagtttcagttgactgtcaatattgttgctttagtcatcaattttgtctcagcatgcatcatagggagcgctcctctcactgctgtgcagctgttgtgggttaatatgatcatggatacattgggagctttagcactagcaacagagcctccaaatgatgaaatgatgaagaggccacctgtccgaaaaggggaaagtttcattaccaagttcatgtggagaaatatcatggggcaaagtttatatcagctatttgtacttggagctctcatgtttggtggggaaaggcttctgaacatcaagggtgcagattccaaatccatcataaatacactgatattcaactccttcgtgttttgtcaggtattcaatgaaataaacagcagagaaatgcagaagatcaatgttttccgtggcatcatcagcaattggatcttcattgcagtcatagcagcaaccgtagcatttcaagtggtgatcatagagtttcttggcactttcgccagtactgttccactcaactggcaacattggctgctcagcgtcggccttggctccatcagtctgattgttggtgtcatcttgaagtgtataccagttggttcaggtgaaacctctgcaactccaaatggatacaggccacttgccaatggccctgatgacatatagctgaagagtaatcactaataagggaaagtagaatccagggtgcaatacagcatccagctgcccagctcagttcagttgttttggaatacactaaccaaccactgattttgttcaaattttgccaaactcctgtcatgtaattgttactacatcacacgttactgatgtgcacccttaccactctgctttcaacttcagacttcattgtatcagtgaattcatattatcattatgacggttggtggtttggattcactctgaaataatcttttgatgccatatatgccatttgaaacagatatatattagcacccttaaggtcctgaacaggagttaaattcataaaacagagtaaataaagaactagaagtatcattcatgaacagaacagaacaatctcctaagatctgtctacaaatcagtaactacattgaca

SEQ ID NO: 4029 - DNA, 3375 bp, Oryza sativa
atggagaagctggacaggtacctgcaggagaacttcgatgtgccggccaagaacccgtccgaggaggcgcagcggcgatggcggcaagccgtcggcaccatcgtcaagaatcgccgccgccgcttccgctgggtgcccgacctcgagcgccgctccttggacaaggccaaggtccgctccacccaggaaaagattcgggttgccctctatgtgcaacaggctgcactcatttttagtgatggtgccaaaaagaaagaatacaaactaacaggggatattattaaagctggatatgccatcaatccagatgagctagcattgatcacaagcaagcatgattcaaaagctttaaagatgcatggtggggtagatgggatatctataaaagttcgttcatcatttgatcatggcatatatgctagtgagttagatacaagacaaaacatatatggcgtcaaccgttatgcagaaaagccttcaagaagtttctggatgtttgtttgggatgcattgcaggacatgacccttataattcttatggtatgtgcattgctatctgttgcagttggtttggcaacagaaggttggccaaagggcatgtatgatggcttgggtataatactcagcattttcttagttgttatggttactgctgttagtgattataagcagtcacttcagtttaaggagctagacaatgaaaagaaaaagatatttatccatgtaaccagagatgggcgtcgacaaaagatctctatatatgacttggtagttggtgatatagttcatctgtcaattggagatcaagtacctgctgatggactgtatatacatgggtactcccttttgattgatgagtccagcttatctggtgagagtgacccagtgtatgtttctcaagacaaaccattcatcttggcaggaactaaagtgcaagatggatctgctaagatgatagtaactgctgtcggtatgcgcactgaatggggaaaattgatgagcacattgagtgagggaggagaggatgagacaccactgcaggttaagctaaatggagttgcgaccattataggaaagattggactggtatttgccatattaacatttttagttctgctggttagatttctcattgacaaaggcatgacggttggtttgctcaaatggtattctactgatgcattgactatagtaaactactttgcaacagcagtaaccattatagttgttgctgtacctgaaggattgcccttggctgttactttgagtcttgcatttgcaatgaaaaagttaatgaatgataaagcacttgttagacatctttcagcgtgtgaaacaatgggatctgctggtaccatctgcacggacaaaacaggaactttgactactaaccatatggttgttgacaaaatatggatatctgaggtttcaaagtcagttaccagtaacaccatttcaggagaacttaattctgtggtttcttctagcacattgagtctgcttttgcagggaatttttgagaatactagcgctgaggtggtcaaggaaaaggatggcaagcaaactgtcttaggaactccaacagaaagagcaatattagaatttggcttgggcttgaaaggagatcatgatgctgagtatagggcctgcaccaaggttaaggttgagcctttcaattcagtcaagaagaagatggcagtgctgatttcattacccaatggcacgtccagatggttttgcaaaggtgcatcagaaattattttgcagatgtgcgacatgatggttgatggcgatggaaatgctattcccttatcggaagctcagagaaagaacatcttagatactatcaactcatttgcttcagacgctttaaggacgctgtgcctggcatataaggaagtggatgatgatattgatgacaatgcagatagtccaacaagtggttttactctaatagccattttcggtatcaaggatcctgtgcgccctggagttaaggatgctgttaagacctgtatgtctgctggtatcacagtaagaatggtaactggtgataatataaatacagctaaagctatagctaaagagtgtggaatattgactgaagatggtgtagcaatagaaggaccagaattccatagcaagagcacagaagagatgagggacctgatactaaatattcaggtcatggcccgttctttaccattggataagcatacactcgtgacaaacttgcgaggtatgtttgatgaggtggtttctgtgacaggtgatggtacaaatgatgctcctgcattacacgaagcagatattgggcttgctatgggcattgcaggaacagaggttgccaaggagagtgcagatgtcatagtacttgacgataatttcacaactataataaatgttgcaagatggggtcgtgcagtttatattaacatccaaaagtttgtgcagtttcagttgactgtcaatattgttgctttagtcatcaattttgtctcagcatgcatcatagggagcgctcctctcactgctgtgcagctgttgtgggttaatatgatcatggatacattgggagctttagcactagcaacagagcctccaaatgatgaaatgatgaagaggccacctgtccgaaaaggggaaagtttcattaccaagttcatgtggagaaatatcatggggcaaagtttatatcagctatttgtacttggagctctcatgtttggtggggaaaggcttctgaacatcaagggtgcagattccaaatccatcataaatacactgatattcaactccttcgtgttttgtcaggtattcaatgaaataaacagcagagaaatgcagaagatcaatgttttccgtggcatcatcagcaattggatcttcattgcagtcatagcagcaaccgtagcatttcaagtggtgatcatagagtttcttggcactttcgccagtactgttccactcaactggcaacattggctgctcagcgtcggccttggctccatcagtctgattgttggtgtcatcttgaagtgtataccagttggttcaggtgaaacctctgcaactccaaatggatacaggccacttgccaatggccctgatgacatatagctgaagagtaatcactaataagggaaagtagaatccagggtgcaatacagcatccagctgctcagctcagttcagttgttttggaatacactaaccaaccactgattttgttcaaattttgccaaactcctgtcatgtaattgttactacatcacacgttactgatgtgcacccttaccactctgctttcaacttcagacttcattgtatcagtgaattcatattatcattatgacggttggtggtttggattca

SEQ ID NO: 4030 - DNA, 3394 bp, Oryza sativa
agtggagtggtggactgcgcttcgtgtgcgtgagcgtgagcgtgctcaccggccggggatggagaagcttgacaggtacctgcaggagcacttcgatgtgccggccaagaacccgtcggaggaggcgcagcggcgatggcggcaagccgttggcaccatcgtcaagaaccgccgccgccgcttccgctgggtgcccgacctcgaccgccgctccttggacaaggccaaggtccgctccacccaggaaaagattcgggttgccctctatgtgcagcaggctgcactcatttttagtgatgatgaactagcattgatcacaagcaagcatgattcgaaagctttaaagatgcatggtggggtagatgggatatctaaaaaagtccgttcatcgtttgatcatggcatatgtgctagtgacttagatacaagacagaacatatatggcgtcaaccgttatgcagaaaagccttcaagaagtttctggatgtttgtttgggatgcattccaggacatgacccttataattcttatggtatgtgcattgctatctgttgcagttggtttggcaacagaaggatggccaaagggcatgtatgatggcttgggtataatactcagcattttcttagttgttatggttactgctgttagtgattataagcagtcactccaatttaaggagctagacaatgaaaagaaaaagatatttatccatgtaaccagagatgggcgtcgacaaaagatctctatatatgacttggtagttggtgatatagttcatctgtcaattggagatcaagtacctgctgatggactatatatacatgggtactcccttttgattgatgagtccagcttatctggtgagagtgacccagtgtatgtttctcaagacaaaccattcatcttggcaggaactaaagtgcaagatggatctgctaagatgatagtaactgctgtcggtatgcgcactgaatggggaaaattgatgagcacattgagtgagggaggagaggatgagacaccactgcaggttaagctaaatggagttgcgaccgttataggaaagattggactggtatttgccatattaacatttttagttctgctggttagattcctcattgacaaaggcatgacggttggtctgctcaaatggtattctaccgatgcattgactatagtaaactactttgcaacagcggtaaccattatagttgttgctgtacctgaaggattacccttggctgttactttgagtcttgcatttgcaatgaaaaagttaatgaatgataaagcacttgttagacatctttcagcgtgcgaaacaatgggatctgctggtaccatctgcacggacaaaacaggaactttgactactaactatatggttgttgacaaaatatggatatctgaggtttcaaagtcagttaccagtaacaccatttcaggagaacttaattctgtggtttcttctagaacattgagtctgcttttgcagggaatttttgagaatactagcgctgaggtggtcaaggaaaaggatggcaagcaaactgtcttaggaactccaacagaaagagcaatattagaatttggcttgggcttggaaggagttcatgatgctgagtatagtgcctgcaccaaggttaaggttgagcctttcaattcagtcaagaagaagatggcagtgctgatttcattacccagtggcacgtccagatggttttgcaaaggtgcatcagaaattattttgcagatgtgcgacatgatggttgatggcgatggaaatgctattcccttatcggaagctcagagaaagaacatcttagatactatcaactcatttgcttcagatgctttaaggacgttgtgcctggcatataaggaagtggatgatgatattgatgacaatgcagatagtccaacaagtggttttactctaatagccattttcggtatcaaggatcctgtgcgccctggagttaaggatgctgttaagacctgtatgtctgctggtatcacagtaagaatggtaactggtgataatataaatacagctaaagctatagctaaagagtgtggaatattgactgaagatggtgtagcaatagaaggaccagaattccatagcaagagcccagaagagatgagggacctgataccgaatattcaggttatggcccgttctttaccattggataaacatacactcgtgacaaacttgcgaggtatgtttgatgaggtggtttctgtgacaggtgatggtacaaatgatgctcctgcattacacgaagcagatatcgggcttgctatgggcattgcaggaacagaggttgccaaggagagtgcagatgtcatagtacttgacgacaatttcactactataataaatgttgcaagatggggtcgtgcagtttatattaacatccaaaagtttgtgcagtttcaattgactgtcaatattgttgctttagttatcaattttgtctcagcatgcatcacagggagcgctcctctcactgctgtgcagctattgtgggtcaatatgatcatggatacactgggagctttagcactagcaacagagcctccaaatgatgaaatgatgaagaggccacctgtccgaaaaggggaaagtttcattaccaaggtcatgtggagaaatatcatgggccaaagtttgtatcagctatttgtacttggagctctcatgtttggtggagaaagccttctgaacatcaagggtgcagattccaaatccatcataaatacactgatcttcaactccttcgtgttttgtcaggtattcaatgaaataaacagcagagaaatgcagaagatcaatgttttccgtggtatcatcagcaattggatcttcattgcagtcatagctgcaaccgtagcatttcaagtggtgatcatagagtttcttggcactttcgccagtactgttccgctcaactggcaacattggctgctcagcgtcggccttggctccatcagcctgattgttggtgtcatcttgaagtgtataccagttggttcaggtgaaacctctgcaactccaaatggatacaggccacttgccaatggccctgatgacatatagctgaagaataatcactaataagggaaagtagaatccagggtgcaatacggcatccagctgcccagctcagttcagttgttttggaatacactaaccatccactgattttgttcaaattttgccaaactgcactatatcctgtcatgtaattgttactacatcacacgttactgatgtgcacctttaccactctgctttcaacttcagactttattgtatcagtgaattcatatgatagacggttgttagtgcaacaagttattgtggtttggattcacactg

SEQ ID NO: 4031 - DNA, 3638 bp, Avena sativa
gtaactccctcgaacccatcgctagctaggggagggagagggagacactagtggcgctcacgaagaccccagcccctgccctcctcttcctccgctccggccgagctgggcagcggtggtggtggcgctagagcgaggccgtgagtgagaggaacgacagggccgggggagatatggacaagtacctgcaggaaaacttcgagctcccggccaagaacccctcggaggaggcgcagcggcgctggcgctccgccgtcggcacgctcgtcaagaaccgccgccgccgattccgccacgtgcccgacctcgaccagcgccagcaagacaacgtcaagcgccgctcagtccaggaaaaatccgggttgccctctatgtgcagcaggctgcgatcactttcattggtggtgccaaaaagaaagagtaccagctaacagaggatataatcaaagctcggttttccatcaatcccgaagaactggcatcaataacaagcaagcatgacttgagagctttaaagatgcatggtggtgtagatgggatatccaaaaaagtccgttcaacattcgaccatggcgtatgtgctgctgacttggatacaaggcaaagcatatatggtgtcaatcgctacgctgaaaaaccttcaagaagtttctggagttttgtttgggatgcattgcaggacacgacccttatcattctgatggtatgtgctttgttatctgttgtggttggcctggcatctgaaggttggcctaagggcatgtatgatggcgtggggataatactcagcattctcttagttgtcatggtcactgctgccagtgactataagcaatcactccagttcaaggagctagataatgagaagaaaaacatatttatccatgtaacgagagatggcggtcgacaaaagatctcgatatatgacttggtagttggtgatattgtgcatttatcaattggagaccaagtacctgccgacggactgtttattcatggatactcccttttgattgatgaatccagcttatcaggtgagagcgagccagtgtatacttctcaagataaaccattcatcttggcaggaacgaaagtgcaagatggttctgctaagatgatagtaactgctgttggtatgcgcactgaatggggaaggctgatgagcactttgagtgagggaggagaggacgagacaccattgcaggttaagctaaatggagttgcgaccattataggaaagattggcctggtatttgccacactaacatttgtagtcctgatgactagattccttattgaaaaaggtacgacagttggtctgtccaaatggtattctactgatgccttgactatagtgaactactttgcaacagcagtcactattattgttgttgctgttcccgaagggttgccattagctgttactttgagccttgcatttgcaatgaagaagttaatgaatgacaaagcgcttgttagacaccttgcagcatgtgaaacaatgggatctgctggaaccatttgcacagacaaaacgggaactttgactactaaccatatggtggttgacaaaatttggatagctgagctttcaaagtcagttgcaggcaatggttcggaagatctgaattcttcgatttcttcaagcgcatggaacctacttttgcagggcatttttgagaacactagtgcagaggtggtcaaaggaaatgatgataaacaaactgttttgggcaccccaacagagatagcgatatttgaatatggcttgagcttgcaaggatatcatgaggctgaggataggagctgcaccaaggttaaggttgagcctttcaattctgtcaagaagaagatggcagtattggtttctttacctggtggctcataccgttggttctgcaaaggtgcttcagaaattattgttgagatgtgtgacaaggtgattgatcaagatggagatgtcattcccttatcagacgctcggagaaaggacatcatggatactatctattcatttgcttcagatgctttaaggacactgtgcctggcgtttaaggatgtggatgattttgatgagggtgcagatagtcctcctagtggttttactctaataatcatatttggcatcaaggaccctgtgcgccctggagtgaaggaagctgttcagagctgtataactgctggtatcactgtgagaatggtgactggtgataatatcaatacagctaaagctatagccaaagagtgtggcatattaactgatgatggtatagcaattgaaggaccagatttccgtaacaagagcccagacgaattgagggacttgatacctaagattcaggtcatggctcgttccttaccattggacaaacatatgcttgtgacaaacttgagaggcatgtttcaagaggtggttgctgtgacaggtgatggtacaaatgatgctcctgcattacacgaagcagatattgggcttgctatgggtattgcaggcacagaggtcgcgaaggagagtgccgatgtcatagtactcgatgacaatttcacaactataataaatgtcgcaaggtggggtcgtgcggtttacataaacatccagaagtttgtgcagtttcagttgactgtgaacattgttgctttagtgatcaactttgtctcagcgtgcatcacagggagtgctcctctcaccgctgtgcagctgctgtgggtgaacatgatcatggataccttgggagctttagctctggcaactgagcctccaaatgatgaaatgatgaagaggccgcctgttggacggggtgaaagtttcattaccaaggtcatgtggaggaacatcattgggcaaagtatataccagttggttgtgcttggggttctcatgttcggcggggaaaaacttctgggcatcgagggtccagattccaagacagttattaacacgctcatatttaactccttcgtgttttgccaggtattcaacgaagtaaacagcagggaaatggagaagataaacattttccgtggtatcatcggcaattgggtcttcatcggggtcataaccgcgactgtggtattccaagtggtgatcatcgagtttctcggcacttttgccagcactgttccactcagttggcagttctggttggtaagcgtgggtctaggatccgtcagcttgattattggagctatcttgaagtgcataccggttaaatccagcggaatatccacgactcctgatggttacaggcaacttgccaacggtcctgacgacatatagctggagaagagtaattgaataattgtgatgttctgcaatctatagcaacaccagccattgtttaggttcagttttgccatttttgttgatgtcattcgtggtgcaagtgttacacgatctgaatgcactgtgtttgcttttttggtgttgcatttgtttgggagcccactccaatattctactagtttaaggacccaattgctggatttatttgaatccactgtaatactttttgtctgatctatcataataatatgctagctataaatgataaaacgattcaaccaggttcatgaggatgtgcattgtaatttttggtttgtaactaagttcaatttttgtaaacaaagttttgaactca

SEQ ID NO: 4032 - DNA, 3147 bp, Pennisetum glaucum
ccgggtaacagaggatattagcaatgctggattctccatcaacccagatgaattggcatcgatcacaagcaagcatgatgtgaaagctctgaagaagcatggtggggtggatgggatatccaggaagatccgttcgacatttgagcatggcgtacctgctagtgacttggatacaaggcaaaacatctatggtgtcaatcgttatgcagagaaaccttcaagaagtttctggatgtttgtctgggatgcattgcaggacatgacccttatcattctcatggtatgcgctttgatatctgctgtagttggtctggcatctgaaggttttcccaagggcatgtatgatggcctgggaataatactcagcatcttgttggttgtgatggttactgctatcagtgactataggcagtcgcttcagttcaaggagctagacaatgaaaagaagaagatattcatccatgtaaccagagacggctctcggcaaaagatctctatatatgacttagtagttggtgatatcgtgcatctatcaattggagaccaggtacctgcggatgggttgtacattcatggatactccctattgattgatgaatccagcttgtccggtgagagtgacccagtttatatttctcaagataagccattcctcttggcaggaaccaaagttcaggatggatcagctaagatgatggtaactgctgtcggtatgcgcactgaatggggaagattgatgagcacgttgagtgaaggaggggaggatgagacaccattacaggttaagctaaatggagttgcaaccatcattgggaagattggactggtttttgccacattaacatttgtagtcctgatggttagattccttattgagaaaggtttaactgttggtttgtccaaatggtattctactgatgcaatgaccatagtgaactactttgcaacagcagtcactattattgttgttgctgttcctgaagggctgcctctagctgttactttgagtcttgcatttgcaatgaaaaagctaatgaatgataaagcactcgtaaggcatctttcagcatgtgagactatgggatctgctggtaccatctgcacggataaaacaggaactttgactacaaaccatatggtggttgacaggatatggatatctgaggtttcaaagtcagttaccagtgacaatagtttgaaagatctgaattctgtcatttctccatccacattgagcctactgttgcagggcatttttgagaacaccagtgcagaggtagtcaaagaaaaggatggtagacaaaatgttttaggaactccaacagaaagggctatattagaatttggcttgaaattggaaggtcacaatgctgaggataggacctgcaccaaggttaaggttgagcctttcaattcggttaagaagaagatggcagtgttggtctcattgcccaatggcacataccgttggttctccaaaggcgcctcagaaatcgttgtgcagatgtgtgacatgatggttgatgctgatggaaatagtgttcccttatcagaagctcagagaaaggatatcttggatactatcaactcttttgcttcagatgctctgaggacactgtgcctggcatataaggaggcggatgatttcaacgatgattcagatagtccgacaggtggatttactctgatatccatttttggcatcaaggatcctgtgcgcccaggagtcaaggatgctgtgaaggcctgcatgtctgctggtatcattgtgagaatggtgactggtgataatatcaatacagctaaagctatagccaaagagtgtggaatattgactgatgatggcatggcaatagaaggaccagatttccgtagcaagagccctgaagaaatgagggccttgatacccaagattcgggttatggctcgttctttaccattggacaagcatacccttgtgacgaacttgcgaggtatgtttcatgaggtggttgctgtgactggcgatggtaccaatgatgctccagcgttacatgaagcagatatcggacttgctatgggcatagcaggcacagaggtagccaaggaaagtgctgatgtgatagtacttgatgacaattttgcaactataatcaatgttgcaaggtggggtcgtgcggtttacataaacatacagaaattcgtgcagtttcagctgactgtcaatattgttgctttagtcatcaactttgtctcagcgtgcattacagggagtgctcctctcacagcagtgcagttgttgtgggttaatatgattatggatacattaggagctttagctctagctacagagcctccaaatgatgacatgatgaagaggcctcctgttcggcgcggtgagagtttcattaccaaggtcatgtggcgaaatatcatcgggcagagtttgtatcagttggttgtactgggagctctcatgtttggtggggagcaacttctgaacatcaagggttccgattccaaatctgttatcaacacactcatcttcaactcctttgtgttctgccaggtgttcaatgaaataaacagcagggaaatgcagaagattaatgttttccgtggtatgatcagcaattgggtctttcttgggatcatagcggtaacagtcgcatttcaagtggtaatcattgaatttctcggcacgtttgccagcaccgttccacttaactggcagctttggttggtaagtgtcggccttggattcatcagcctgattgttggtgccatcttgaagtgcataccagttaaatcagatgcaagtccctcgagtccaaatggctatgtgccactacccagtggtccggataacatataactgaagaagagcgatcgacaaggtagtgcgttttctagcattaaccggtttcatgagaaccctaagcacgcgacacggctaccttccactcctgtttgagatcattaataaagcactgcctaggttcagttttaacaaattgctcaatgccttgtcatgcaattgctcgtttcccagtcctaattccggttgctgaaatgtaaaaaagagatggtgatgaacacaacgtactctatttggtatgggtcatggaaacaatgctgttgactaatgggagcacatttactttgttc

SEQ ID NO: 4033 - DNA, 4151 bp, Setaria italica
cgccatgccgcgactcctgcggcgggtcaacggcaatcggcgacgcaggttccgagcgcctccgccggctcgcagtcgcagctcccaccggccgacagcttcgcctcgagatcgttcccggtctctctcgtcgtcgtccccttccttcgccttccgcacgtctccaagcgggccacatgcccaaatactctaccttatccgttcgtctcctttcgacctttccgacatggcgctgacgaggctgatgtccccgcggccgccgtgctcgctcccgcttccttctccgtcgtataagaacatctctggctgctgctgccaccgcggccgccgactcctcgtccgcagagcaatgccggtagcctcccagcaccttagcaccgccacgcccctgcccccgccctcgccgcagcggcagcagatgatggcgcggctcgagcatgggtctttgatggtcggcgggcgggagctgctcgcccgcgccccgcccaacgtcaccctccgccccgctgacgccgaggccgccccgggcgccgcgttcctcggcgccagggcggcggcgccgtccagccgccacgtgttccccgtcggcaccctggcaagtgggtggaggtggttgtccctgttcaggttcaagatctggtggatggtcccggccacgggcgccggcgccgcgaccgtgccggcggagacgcagatgatgctcttagagtccagggatgaggagggttccgccgccgcggaggggggcgcggtgtacgcactgatgctgccggctcttgacggcgatttcagggtcagccttcaggggagccccgagaacgagctccagttctgcttggagagcggtgatcctgaggtccagacgatggaagcagttgatgcagtattcatcaactcaggggataatccattcaagctaatgaaggaatccatcaagctgctatcaaagatcaaaggaaacttcaagcatattggggacaaggagatccctgcaaatttggactggtttgggtggtgcacctgggatgcattttacaaggctgttaacccagcagggatcgaggagggccttaagagtctgcgagaaggtggtgtgccaccgaggtttctgattatagatgatggttggcaagaaacagttgatgaattcgaggaagtggatgaaaccctccgtgagcagaccatgtttgcgcagaggctgactgatctgaaggagaatcacaagttcaggggagagacctgcaagaatcttggggaccttgtcaagaggatcaaagaaaaacatggagtcaagtacgtttacatgtggcatgctttacttgggtattggggaggtgtccaagtaacatctgatgtgatgaagaagtacaatccaaagcttgtttacccagtccaatcaccgggtaatgttgccaatctgagggatattgccatggacagcttggagaaatttggagtgggcatcattgatcctgacaagatttttgagttctacagtgatcagcacagctacctttctagtgtgggtgtggatggtgtgaaggttgatgtgcagaacgtgttggaaactcttgggcatggctttggtggccgtgttgcagtaacacaaaagtatcagcaagctcttgaggagtccattgcccagaacttcaaaagaaacaacctaatctgctgcatgagtcacaattcagactgcatctttagtgccttgaagagtgcagttgctagagcctctgaagatttcatgcctcgggaaccaacactgcaaactctgcacattgcttctgtgtcattcaatagcatcttgttgggagaaatcttcatacctgactgggatatgttccatagcaagcatgaatcagcagaatttcatggagcagctagagcactgagtggaggtggtgtgtatgtgagtgacaaacccggggtgcatgacttcagtgttctcaaaaagcttgttctaccagatggctcgattctaagagcaaggtatgctggtcgtcctgcacgtgattgtctgttcaatgacccagtgatggatggcaaaagtctgctgaaaatatggaacctgaataatttttctggtgtcatcggagtgttcaattgtcagggagccgggcaatgggtttggccagtgaaagatattgattatgtgcccaccagtatcaacatcactggtcatctctcaccttcagatttagaatctctcgaggagatagccggtgataattggagtggagagactgcagtatatgctttcaattcatgttctctttcaaggcttcagaagcaccaaaatttggaggtttcactgtctaccatggcatgtgagatctacactatttcaccgataaaggttttcggtgaagccgttcagtttgcgcctctcggactgatcaacatgttcaactccggtggtgcactcgatgacatctcgagcaccgctgattcctcagctaccacaattcacgtcaggtgccgaggtccagggcggtttggggcgtattcagccaccaggccggagaattgcagggttgatggacagcaagtggagttctgtcatacagaggatgacctgctagcctttgaccttcctcgcagttcatcccgcgacggcgacctgtggtgcattgagattctctacagaacttcctgaatctgtttacccttccgacatgcaatttttgtgccgtgctcttcggtaaccgccgccgcacgtgcacattgagatgatgttttcagagaaaccaatgttctgttggttctgattgtgctccattttgttcgccgtgttgtatatatatttttattcacaaaagggattgttgtgttgtatttttgtactgtaatttggtattgtgcctcgtgcatcttgtgctaccactatcgtaatctactacttgacacggtatataacataaaagagagcagtttaacatggtcccgttctaactctttcgcaacgtgaacttgtgaatcttgtgagagattatttgctcatgctgatgatcagttgcctgaagaacaccgctctatggttttaagggcggtgttcctctattcccgtcgttctaagacgtatgaaagcccacgaccgatcgatcgttcgatcaaaacgacctgatcttccagttcttgagcttgagtggcagctgcgcgagcatggtctgctcggcggccacgctcctcgtgctggtcaccagcttgaaccactggctctgcgggtcgcagctgttgtcggcgctcaggcaccggcacgggttggtcaccacgctccggccgtcggcgcccacgtccaggcagagcgcgccgtcgccgtcgaccgcggccgacgacgacgtcgcgacgtgcagcttggagtccgacacgagacgccaccgcgccatcgcgtcgccgcagctcgcgccgaggctggcgggcttgccggcgccctcggcgcggaggcacagcgacgagccgtctcgcggcgccaccgccagccgctgctcctgcgcgctgtacgcccaggcctccgtctcgctgcagggtcccagctccagcggcggcgaccggcggcgcagcacgcacgtcccggtgaccgggtggaagagcaccgtgtacggcggcacctggtccaggccggggcccctgagcgggcgctgcagggcctggaccctgctcagcgcggaggcgttgcggggcccgctccaggcccggtcgagcacgccgtagacctcgtcgaggtcccggacgccctcccggaggtagtagctcccctgcagcgcccagagcgcccagtccatgtcgaggtcggcggcggcggcggcggcgcagccgtagtagcggttgtcgttggtgttgccgccgcggttgtcgacgccgaactcgctgaggatgacgggccaccccttgtcgagcaggtagagcgcgcggcgggcgacgccggcggtgatgcgcgcgcaggcctggttggcgttgcccgagccccactcctggctgttggagaagctgtaccagtgcacctcgaacgccgccttcccggagaagctcaggttcaccggccgcgagttgatgaaggccaggtcgttgtcgaagctgaggcccgagaggatgaccagcacgcgcgggttcgccccgtgcaccgcctccgcgccgagctgcatgtacctgcg

SEQ ID NO: 4034 - DNA, 1727 bp, Setaria italica
tccactcatcatcgctttatcgcttcttctggtgaaagcatcatcctctgtgtgccgccatcccgatccatctatggcgaccccgaccgtcgtcttgctgccggtctggggcgccggccacctcatgccaatgctagaagccggcaagcggctgctcgctagcagcggcgggcgcgcgctctcggtcaccgtgctcgtcatgcggccgccgacggagcagcaggcgtccgaggtcgagggccacatacgccgcgcggaggaggcggccgccggcctcgacgtccgcttccaccgcctccctgccgtcgagcccccgacggaccacgagggccccgtggagttcatctcccggaccgtggagctgcacgagccccacgtaagggcggccatctccggcttgctgccggcgagccccgtggcggcgctggtcctcgacctcttctgcacgccgttcatcgacgtcgcccgcgagctcgccgtgccggcgtacatctacttcacctgcaacgccgcggcgctctccttcttcctgcgcctgccggcgctctgcgaggaggtggcgggcgagttcgaggacatggacggcgcggcggacatacccgggctgccgccggtgccaccgctctcgctcccgacgccggtcatggagaggacgaagccggaatgcgcgtggtacgcgtaccacggcaggcggttcgcggatgccgacggcatcgtcgtgaacacggccgccgaactcgagcagggcgtcctctccgccatcgccgacggccggtgcgcgcgcgggggccggcctcctccgacgctctaccccatcggcccggtgatctcgttccctccgcccaccgcgccgccgccgcacgactgcgtgcggtggctggagacgcagccgccggcgtccgtggcgttcctctgcttcgggagcggcgggttcttcacggcggcgcaggcgcacgaggtcgccggcggcctggagcgcagcgggcaccggttcctctgggtgctgcgtggcccgccggcgcccggctcacggcagcccacggacgccgacctcgccgagctgctcccggagggcttcgtcgagaggacgaggggcagaggcctggtgtggccgacggcggtgccgcagaaggagatcctggcgcacgccgccgtgggcgggttcgtgacgcactgcgggtggaactcgatgctggagagcctctggttcggcgcgcctatggcggcgtggccgctgtacgccgagcagcacctgaacgcgttcgcgctggtggcggccatgggcgccgccgtggccgtggaggtggacagggcgaggggcaacttcgtggaggcggcggaggtggagcgcgcggtgagggagctgatgggtggcggcgaggaggcggggaggagggtgagggagaaggccgccgagatgaaggcggcgtgccggaacgccgtcggggacggcgggtcgtcgaccgctacgctgaagagactcgcgaacgatatatgtcagcaactgcgccgtgatccggcgaagtgatgactgatgactcctccgtagttgactaccgaccgtaaatgagcccagctctcatggttgtataagcttgtctagaactcgcttttctggcgggataagtttgctgtctgaagaatttgctatctgaatagactgggtgtttgacaatcttaattattacgtgtcgattatctatcctgactaataaaatgacttgaat

SEQ ID NO: 4035 - DNA, 1644 bp, Setaria italica
gccgccatcccgatccatctatggcgaccccgaccgtcgtcttgctgccggtctggggcgccggccacctcatgccaatgctagaagccggcaagcggctgctcgctagcagcggcgggcgcgcgctctcggtcaccgtgctcgtcatgcggccgccggtcgagggccacatacgccgcgcggaggaggcggccgccggcctcgacgtccgcttccaccgcctccctgccgtcgagcccccgacggaccacgagggccccgtggagttcatctcccggaccgtggagctgcacgagccccacgtaagggcggccatctccggcttgctgccggcgagccccgtggcggcgctggtcctcgacctcttctgcacgccgttcatcgacgtcgcccgcgagctcgccgtgccggcgtacatctacttcacctgcaacgccgcggcgctctccttcttcctgcgcctgccggcgctctgcgaggaggtggcgggcgagttcgaggacatggacggcgcggcggacatacccgggctgccgccggtgccaccgctctcgctcccgacgccggtcatggagaggacgaagccggaatgcgcgtggtacgcgtaccacggcaggcggttcgcggatgccgacggcatcgtcgtgaacacggccgccgaactcgagcagggcgtcctctccgccatcgccgacggccggtgcgcgcgcgggggccggcctcctccgacgctctaccccatcggcccggtgatctcgttccctccgcccaccgcgccgccgccgcacgactgcgtgcggtggctggagacgcagccgccggcgtccgtggcgttcctctgcttcgggagcggcgggttcttcacggcggcgcaggcgcacgaggtcgccggcggcctggagcgcagcgggcaccggttcctctgggtgctgcgtggcccgccggcgcccggctcacggcagcccacggacgccgacctcgccgagctgctcccggagggcttcgtcgagaggacgaggggcagaggcctggtgtggccgacggcggaggagatcctggcgcacgccgccgtgggcgggttcgtgacgcactgcgggtggaactcgatgctggagagcctctggttcggcgcgcctatggcggcgtggccgctgtacgccgagcagcacctgaacgcgttcgcgctggtggcggccatgggcgccgccgtggccgtggaggtggacagggcgaggggcaacttcgtggaggcggcggaggtggagcgcgcggtgagggagctgatgggtggcggcgaggaggcggggaggagggtgagggagaaggccgccgagatgaaggcggcgtgccggaacgccgtcggggacggcgggtcgtcgaccgctacgctgaagagactcgcgaacgatatatgtcagcaactgcgccgtgatccggcgaagtgatgactgatgactcctccgtagttgactaccgaccgtaaatgagcccagctctcatgtttgtataagcttttctagaactcgcttttctggcgggataagtttgctgtctgaagaatttgctatctgaatagactgggtgtttgacaatcttaattattacgtgtcgattatctatcctgactaataaaatgacttgaat

SEQ ID NO: 4036 - DNA, 1342 bp, Panicum virgatum
ccacgcgtccgccgtcttaaaccctgcataagcctcgtcctccccacccccaccgtcgagcctccgtctcctcctgcccgcccgcttcttgctccttcctagttctcacgagggcaccgggagaccgccggcaggacggagcgaggcggcgcgggcgcgagcaggaagaagaagcgcacagctgctggctcggtcggtcgcttcccggtgagaggaaagctcgtcgcgccacctcgacgcccatcgccacgcctcgcgctcgctctcctcccggagccgggagacgcccgcagggattgccgtcgatcctgcaagaaaacacggcaaggaaataccagtagtgagccagagtgcgaagaagatgatgatggctgaagtggccaatcacagcaagaggaaccacaccgacagctacttcagcgggaaggccgtcgtcaccaccaccagctcggaggagtttggaagcatgacctccaagaagccgaggaacacgagcccaaggacgtctccagtgtcaccgaaggagaagaaggacaagatcggcgagagggtcgcagcgctccagcagctagtgtcaccgtttgggaagacggatacggcgtctgttctgcaggaggcgtcagggtacatcaagttcctgcaccagcagctcgaggtcctgagctccccctacatgcgtgctcctccggccgccggcgccgcgcctgaggatcccgagcactacagcctccggaaccgcgggctgtgcctggtgccggtggacctgacgctgcagctgacccagagcaacggggccgacctgtgggcgccggcgaacacgaccaggcgccggtgaggagcgagtccgcccgcctcaccgggagcagagcagccgccccggtctctggtccgcccggtggaaaccaaggaagtcctgcgtctgcacctgcatgtgcagggtacagaatttccaagcgcctgaccccattcgatctcctaacaagaaactaaagcgagcgtcaatctccgcttgtattatactagtgacctgtctgtatgcctgcctgcctgtctgatctcccctgggcaccgtatatgtatgatcagatgtggctgggaaccgcgtctctatgtactagtatgtatctatgtgttcagtgacatgtcaattagcaggctggtgccgtcagcaactgaaacggcaagttttaaggccagtcactttgatgggggggtgctttaggttttgctgttgtgcacttgtgctgaagctgaaatgcagcttcaggcggggcagagcctaaaagccgcgggttgtttgtgaatgtggcaatttttgaacatgcagatttttttgcgctgg

SEQ ID NO: 4037 - DNA, 1828 bp, Zea mays
atctatctatctgcgggttgcagcacacacacacccagacccaggtcggaaacgcagactcgcaatagctagcaactattctcctcttcttctgtatataaacggcgagcgagggccctccgtcttccctgatcccaaatgtgcccggcccggtccctctccactgcactgcgctgcgcccatccatccttaaaccctcctgcgcgcgtaggcctcgtcttgtccttccccagcacaacctctcctcctccttcgccaggtgcctcttcgttctcctctccgggctatcaggacgaaataactggccgcgctgcacgccggccgcctcgagaagaagcgctcgccccgcgcgcgcggctccgggctaccaggacgaaataactggccgcgctgcacgccggccgccgcgagaagaagcgctcgccccgcgcgctctgccgctggttcggccgtgccatcccgacgaggttcccccagctgtgcccgctcgatctccttccgcgcgcacgcgcacgcagtggtccgtcgccgctgattgatcctgcaggaaaaacagggcaaggagctactttgagcccgagactgaactgaagaagatgatgatggccgaggtggccaaccacagcaagaggaaccacacggacagctacttcagtggcaaggccgtcgccgtccccgccgccgcggccaccagctcggaggagttcggcagcatgtcgtcgaagaagccgaggaatgccagccccagactcgcgcccgtatcaccaaaggagaagaaggacaagatcggcgagagggtcgcagcgctccagcagctcgtgtcaccgttcggaaagaccgacacggcttctgtcctgcaggaggcgtcggggtacatcaagttcctgcaccagcagctggaggtcctgagctccccttacatgcgcgctcctccggccgctggcgctgcgcctgaggacccccagcgctacagcctccggagccgcgggctgtgcctggtgccggtggacctgacgctgcagctgacccagagcaacggggccgacctgtgggcgccggcgcacacggccaggcgaaggtgaggactgaggaggagccggtctgtctgtccggagggaaccgcgcaagtgctgccgcgtctgcgtgcgcgccgtggagttgagtttccaggcgcctgactgacccgattcgacctcctagcaagaaactaaagcaagcgtgcgtgtccgtatcagccgccttgtattatactcctagtagtactctcgtgacctgcctggtcaggtctctctctcctagcttgttgtccgccgtttatgtgttgagcggcatgtggattagaagcctgtgtggctggctgtcagcaagcagagcggcagtttgatgcctgttccttgagatggatagtgttatcgagttcagaagaataccatgcgcgtgtgcctgatgtatgctctctctctctcgctcactgtctctctcagctgtgatggaactgaaaccgcacgttcaggcaaggcaaaacctaagtgttacaggctcgttcgccctcacatccgcaggacgaagcaacgcaggcccacactttttgaccggcagcggcaggcccctcgggccaacagagactgttccggggtccaaagaatctaactcatcatgattcatgaaccaaaatgaacaggtacaccggacgaaccttgcggatggaaaaaaacaactcccacgcgtctctctctctctctagtacagtagtaccttcttctcttctgtttcttcgatgaacttcgcacgttctcgaatgaataatagaggagcagggtgaagcaaa

SEQ ID NO: 4038 - DNA, 1531 bp, Setaria italica
caaatgtccccggcccggcccccctgcttccatccttaaaccctgcataagcctcgtctttcccacacccaccatcgcgctcggctccagccgccttctcctcctgcagttctgcctgcttcttctctccccgagttctgacgacgccgggagacaaaggaggagacgccggcgcgcgagcaggaagaacaaagcgcacagcgagctccgctgctggtgctggctccgtcgtttcccggtgtcaagcagctcccgccatctcgatcgccgcctcttgtgttcgttctccttccgggaggtgcagctagcgattgccatcgatcctgcaggaaaacacggcaagcaaataccagtagtgtgccagtgcgaagaagatgatgatggctgaagtggccaatcacagcaagaggaaccacaccgacagctacttcagcgggaaggccgtcgtcaccaccagctcggaggagtttggaagcatgatctcgaagaagccgaggaacacgagcccgaggacgtctcccgtgtcaccaaaggagaagaaggacaggatcggcgagagggtcgccgcgctccagcagctagtgtcaccgtttggaaagacggatacggcttctgttctgcaggaggcgtcagggtacatcaagttcctgcaccagcaactcgaggtcctgagctccccttacatgcgtgctcctccggccgccggcgctgcgcctgaggatcccgagcactacagcctccggaaccgcgggctgtgcctggttccggtggacctgactctgcagctgacccagagcaacggggccgacctgtgggcgccggcgaacacgaccaggcgcaggtgaggaccaagcccgcccgcctctggtctccccggacggccggaccccggaggaatggaaccgaggaagaagtactactgcatctgcgtctgcatgtgcgggggcgtagaatttccaagcgcctgaccccaattcgatctcctaacaagaaactaagcgagcgtcgatctccgcttgtattatactagtgacctgtctgtatgcctgtctgatctctccttggcaccgtattatgtatgatcagatgttggcaaggaactgcgtctctgtggtactgtatctgtatgtatgtgtttagtgacatgttatagcctgttgccatcagcaactgaagcagcagtttaatgctagtttccttgaggtgcccggtgctatcgagttcagtctaccatcagtatgcgtactatgtcagaaactgaaactgcaggttcaggaagggccgagcctaactgtcatgcggtcgtctgtgaatgtggcaatttctgaacatgaaaatccttcgtgctgaaaagtggcgtgacgcttcatgggcgtgttgttcggcactctcgaagcagactaggcaagtgaaagacatcctaaatacaaggggttcaagcccgtccagtgtatgctcagggcagaaaaaaatcttacagttccggtatctggcacatgccgcagcgtgggtcaacaagggaaccaaaatt

SEQ ID NO: 4039 - DNA, 1334 bp, Setaria italica
atgttgctcattgttctcaactgccatccttaaaccctgcataagcctcgtctttcccacacccaccatcgcgctcggctccagccgccttctcctcctgcagttctgcctgcttcttctctccccgagttctgacgacgccgggagacaaaggaggagacgccggcgcgcgagcaggaagaacaaagcgcacagcgagctccgctgctggtgctggctccgtcgtttcccggtgtcaagcagctcccgccatctcgatcgccgcctcttgtgttcgttctccttccgggaggtgcagctagcgattgccatcgatcctgcaggaaaacacggcaagcaaataccagtagtgtgccagtgcgaagaagatgatgatggctgaagtggccaatcacagcaagaggaaccacaccgacagctacttcagcgggaaggccgtcgtcaccaccagctcggaggagtttggaagcatgacctcgaagaagccgaggaacacgagcccgaggacgtctcccgtgtcaccaaaggagaagaaggacaggatcggcgagagggtcgccgcgctccagcagctagtgtcaccgtttggaaagacggatacggcttctgttctgcaggaggcgtcagggtacatcaagttcctgcaccagcaactcgaggtcctgagctccccctacatgcgtgctcctccggccgccggcgctgcgcctgaggatcccgagcactacagcctccggaaccgcgggctgtgcctggttccggtggacctgactctgcagctgacccagagcaacggggccgacctgtgggcgccggcgaacacgaccaggcgcaggtgaggaccaagcccgcccgcctctggtctccccggacggccggaccccggaggaatggaaccgaggaagaagtactactgcatctgcatctgcatgtgcgggggcgtagaatttccaagcgcctgaccccaattcgatctcctaacaagaaactaagcgagcgtcgatctccgcttgtattatactagtgacctgtctgtatgcctgtctgatctctccttggcaccgtattatgtatgatcagatgttggcaaggaactgcgtctctgtggtactgtatctgtatgtatgtgtttagtgacatgttatagcctgttgccatcagcaactgaagcagcagtttaatgctagtttccttgaggtgcccggtgctatcgagttcagtctaccatcagtatgcgtactatgtcagaaactgaaactgcaggttcaggaagggcagagcctaactgtcatgcggtcgtctgtgaatgtggcaatttctgaacatgaaaatcc

SEQ ID NO: 4040 - DNA, 1448 bp, Saccharum officinarum
ccgggccggcccctctgcacccgtccttaaaccctgcgtaagcctcgacaggctcttctccttgggcaggtggttgcctcccggcagcctcttcgttctccctctttgtgtgtggcgcggctccggccggcggaagagggaaggcggttgcacgccgggtgggtagctaggggaagacgccggtggcacagacagctcgtgccatctccaccgcaatcgattcccccctgtgctcgctctccttccgcacgcaccggtcgccgtcgatcctgcaggaaaacagggcgggcaaggaagctagtgagccgagggtgaagaagatgatgatggctgaggtggccaaccacagcaaaaggaaccacgccgacagctacttcagtggcaaagccgtcgccgcagccgcagccgccaccggcccagaggagctcggaagcatgtcctcgaagaagccgaggaataccagcccaagaatcgcgcccgtatcaccaaaggagaagaaggacaagatcggtgagagagtcgcggcgctccagcagctagtgtcaccgtttggaaagaccgatacggcttctgttctgcaggaggcctcggggtacatcaagttcctgcaccagcaactcgaggtcctgagctccccttacatgcgtgcttcttccgctggtgggactgggcctgaagatcccgaacaatacagcctccggaaccgcgggctgggcctggtgcccgtggacctgacgctggagctgacccagagcaatggggcagacctgtgggcgccggcgacacgaaccagcgcaggtgaggagaggcctgtcggcttggccctcgcctggccagaagaaccggcctgggcctgtcttgcccgaggaaaccgcgcaaccaatacaacttgattgcatgtgcggtgggaaataaaattctaaacgcctgccccaatttatctcctaacagaaactaacaaagctggtcgtataacccggttgattatactgataagggcctgtctgtctctctttctggcgccgattggggaaccacagtgacacaatggaaaggcccggaacgcgctttgggggttaaactagaaactatggtcaggcatgaataccacctgggcttacacaaaaagggcattaatcccttcttcttgaaaaacacgccaagccgacgcccaccccccgggcccccgtacgggcgcgttccggggggcgccccgggcccgggggggccttaaaaacacttctctccgcggaatatattttgggtaaaaattggggacccttccccggacaggccaggcctatagcccagggccaagccaccggccaaagaaaaaacgtacacctaccgtcttagaatgtcgggtaatctgaagaccccgccccccatgcctaacttgtaatactttccccgttttccccgttctctaggtctacccttataaggcg

SEQ ID NO: 4041 - DNA, 963 bp, Pennisetum glaucum
gctcgtcgctctcgttctcttccggccgggaggtgcagctaccgattgccatcggtcctgcaggaaaactcggcaagcgaataccagtagtgtgccagtgcgtagaagatgatgatggctgaagtgaccaatcacagcaagaggagccacaccgacagctacttcagcgggaaggccgtcaccaccaccaccaccagctcggaggagtttggaagcatgacctcgaagaagccgaggaacacaaacgcgaggacgtctcccgtgtcaccaaaggagaagaaggacaagatcggggagagggtcgccgcgctccagcagctagtgtcaccgttcgggaagacggatacggcttctgttctgcaggaggcgtcagggtacatcaagttcctgcaccagcagctcgaggtcctgagctccccctacatgcgtgttcctccgccccccggcgctgcgcctgaggatcccgagcactacagcctccggaaccgcggtctgtgcctggtgccggtggaccagacgctgcagctgacccagagcaacggggccgacctgtgggcgccggcgaacacgaccaggcgcaggtgaggagcgagccgccgagaccgcgctctcctcaccgggagccgccggtccgtggtctctggtctacccggaggaatggaaccgaggaagaagtgtaccgctgcttctgcatcggcatgtgcgggggcgtagaatttccaaccgcctgaccacaattcgatctcctaacaggaaactaaagcggtcgtcgatctccgcttgtattatactagtgacttgtctgcatgcctgtctgatctctccttgccattggcaccgtattatgtatgatcagatgtcggctaggaactgcgtctctatgtggtactgtatgtatgtgtttagtcacatgttaattagcaagcagcctgttgctgtcagcaactgaagcagcagtttaag

SEQ ID NO: 4042 - DNA, 2246 bp, Zea mays
cttcaattcttccccaacgcaggctcttcccccgcacagcagcatctttcttctcctcttcgcggcgcgtcctccgggttaaggaaaaaaaagcggggaaaagggagaagaatcgcacgtcccgccgccgcccgctctgctagtgctagctgctgctggtttggtcgtttcccggccgccgcgccggtgacgcagatcgacagctcctgcccatctcagagtccatcgccgctgatcctgcctgtgcctgcagcgaaacacgcgcggggcaaggacggagctggtaagccgatcgagccggcgagggtggacaagatgatgatggccgaggtggtggccaaccacagcaaaaggagccacaccgacggctacttcagtgccaaagccgccgtcgccgccgccgccgccgcgagcccgccagaggagttgggaagcatgcccatgtcctcgaagaagccgaggccgaggaatagcaacagcccgagaaccgcgcccgtatcgcccaaggagaagaaggacaggatcggcgagagagtcgcggcgctccagcagctagtgtcgccgttcgggaagacagacacggcttccgttctgcaggaggcctcggggtacatcaggttcctgcaccagcagctccaggtcctcagctccccttacatgcgtgctcctccggctgccggcgccgcgcctgaggatcccgagcactacagcctccggagccgcgggctgtgcctggtgccggtggaccagacactgcagctgacccagagcaacggggccgacctgtgggcgccggcgaacacgaccaggcgcaggtgaggaggagcctgctgccggcctgtgcctggtggtggtctgcccggaggaaaccgcgcaagtactactgctgtgtctgcatggtgcgcgtgtagtacagtttccaagcgcctgacccaattcgatctcctaacaagaagctaagcattaagcaagcgtgtccgtatcagccgccttgtattataccagtgacctgtcggcgccgtatatgtgtgatctgcttgctagctgatccacacagatggaagcggccctgaactgcgtctccatgtggtactagtactatgtaactatgtgtttactgacttgtgaactagcagtctgtggcctgtcagcaagtaaatgggggcagtttaatgcatgttccttgagatgccctctcaccatatccttctctttctctcagctgctgaaactgaaactgcacattcaggcaaggcagagcctaatgactgccgatgcgctcgtctccgaagttgtgaacttatgaccgtgcaaatctttcatgctgccacacgtcttgagtgtaaagctggcctgtggttgagattgtggcaagaaaaaaagaactcctgaacatgtacagaagcaaaattgggcacagaataaatagtgtctccctgtccttcaagttttaactattcgtttctgaattctgataaaaacggggctctgactctgagagcgcagagagtccaaactgaagtcagaatggtcattcatgaatttctttgcgaattcatgaatggccgttgtcactgttcgaggagaattcattcgagagaatgtggtctaagcaccatgattttgtactaataggctatactcattcgagagaacagagaagtaaagaggagaaagttagaggaagttgaatgacagaaattactttgtactgacgggcctcactcgcgcaccgttgagtcgagagccgaagcccaccatggttgggcttgggccttaccatgaccactgcactgcacgtctgcattgtacgaaactcgttcgatttctcgatcagtggagacggtagtacagtacagtgtactaccaagctttccacactggtgtttagatgcgaagtttaaccaaatcaaaacaaaagccgtttaatttctgtacgatgcaactgtgctgcattcatggacgacgaccgagcggacctaaaagtggggtcggacacgttacaaatctattgatggctatagagatctaggtaacacatctcatctctttgtctatttatacagcagtcgtctcttgattattattaatataattcctttttatctttcttataaagttttttatatttttagactatgctagtaataaacttacgttaagaaataaaatagacaccaaaatttacgtggaaaaatctcttccaatatggaggaccaaacaaccacgaggaccaaacaagttac

SEQ ID NO: 4043 - DNA, 1125 bp, Triticum aestivum
gcccctcccttcccactccttccttaaaccccccataagccttgttcctttcccttctctctagctactcttgcagtcccgctcctcttctccaggcctctccggctccaaacacagacggcgaggagcgccggagctagctgccgtcgcggcgcgccagtgccagtggagtcgagtatcgaagctggagaagtggagatagagcttccgccccctctcggcgttgttgatcaaactgcctctgcagcaggaaaaaaggggcgaacgtacgcatagccagcagcagtagcgggagaggaagatgatgatgactcaagtggccaatcacagcaagaggaaccacaccgacagctacttcagcgggaagcagcagcagcaggccgtcgccaccaccgccaccagcagcggctcggaggagttcgcgggcatggggtccaagaagccgaggaacgccagccccaggggcggcggccccatttctcccagggagaagaaagacaaggtcggcgagagagtggcggcgctgcagcagctcgtgtcgccatttgggaagacggacacagcttctgttcttcaggaggcctcgggctacatcaagttcttgcaccagcagctcgaggttcttagctccccgtacatgcgccctcctccggcgcccggcgccgagcctgaggatcccgaccactacagcctgcggaaccgcggcctgtgcctggtgccggtggagcagacgctgcagctgacccagagcaacggggccgacctctgggcgccggcgaacaccaccaggcgctgctgaagcgaagcccgaggctggcctcgacggcggcgatggccgcactgcgtggcaggggtagaattccggtacaagcgcgcgcatggctgacccaattcggtcaatctctaacacaatcgtttcgtttcgtttggtttcgtttctgtgaacatcctcagcagaccctgtgctggcgccggtagtatgtaatgtgtaatcgtcgtgtatagcgagacgacgcaccgccgaccgatcggtcgatcggtccccgtggtcgttgcgtgggtgactgtggttaacatggtagcgtcctgttgctgtcaccggctaatcatcaaaatcagcagttc

SEQ ID NO: 4044 - DNA, 1114 bp, Pseudoroegneria spicata
  misc_feature (4)..(8): n is a, c, g, or t
  misc_feature (583)..(583): n is a, c, g, or t
  misc_feature (649)..(649): n is a, c, g, or t
  misc_feature (724)..(724): n is a, c, g, or t
  misc_feature (781)..(781): n is a, c, g, or t
  misc_feature (798)..(798): n is a, c, g, or t
  misc_feature (1055)..(1055): n is a, c, g, or t
ggcnnnnnctctcttcccactccatccttaaaccccccataagccttttttcctttcccttctctctgctcttgcagccccgctcctcttctccaggcctccccggctccaaacacgaacggcgaggaggcaccggagctagctgtcgtcgcggcgcgccactgccagtggagtcgagtctcgaagctggagaagtggagatagagcttcggccccctctcggcgttgttgatcaaggtgcctctgcagcaggaaaaaaggggcgaacgtacgcatagccagcagcaagtagcgggagaggaagatgatgatgactcaagtggccaatcacagcaagaggaaccacaccgacggctacttcagcgggaagcagcagcaggccgtcgccaccaccaccagcagcggatcggaggagttcgggggcatggggtccaagaagccgaggaacgcgagccccaggggcggcggccccatttctcccaaggagaagaaggacaaggtcggcgagagagtggcggcgctgcagcagctcgtgtcgccatttgggaagacggacacggcttctgttcttcaggaggcgtcnggctacatcaagttcttgcaccagcagctcgaggttcttagctccccgtacatgcgccctcctccngcaccgggcgccgagcctgaggaccccgaccactacagcctgcggaaccgcggcctgtgcctggtgccggtggancagacgctgcagctgacccagagcaacggggcggacctctgggctccggcgaacacnaccaggcgctgctgaancgaagcccgaggctggcctcgacggcggcaatggccgcactgcgtggcaggggtagaattccggtgcaagcgcgcgcatggctgacccaattcggtcaatctcctaacacaatcgtttcgtttcgtttctgtgaacctcaacagaccctgtgctggcgccggtagtatgtatgtgtaatcgtcgtgtatagcgagacgacgcaccgccgatcgattgatcgatccccgtggtcgttgcgtgagtgactatgtggttnaacatggtagcgacctgttgctgtcgccgactaatcatcaaaatcagcagtttcattca

SEQ ID NO: 4045 - DNA, 1030 bp, Leymus cinereus x Leymus triticoides
  misc_feature (19)..(19): n is a, c, g, or t
  misc_feature (191)..(191): n is a, c, g, or t
  misc_feature (210)..(210): n is a, c, g, or t
  misc_feature (267)..(267): n is a, c, g, or t
  misc_feature (305)..(305): n is a, c, g, or t
  misc_feature (321)..(321): n is a, c, g, or t
  misc_feature (460)..(460): n is a, c, g, or t
  misc_feature (654)..(654): n is a, c, g, or t
  misc_feature (761)..(761): n is a, c, g, or t
  misc_feature (855)..(855): n is a, c, g, or t
  misc_feature (914)..(915): n is a, c, g, or t
  misc_feature (1006)..(1006): n is a, c, g, or t
ctcctccaggcctctcagnctccgggagacgagaaacacgaacgcgccgtacgcggcatcggagctggctgtcgtagtggcgcgcctctgcaagtggagtcgagtctcgaagctggagaagtggagatagatagcttctcggtctctcttggtcaaagtgcctctgcactctgaagcaggaaaaaaggggngaacgcatagccagcagcngtagcgggagaggaagatgatgatgactcaagtggccaatcacagcaagaggaaccncaccgacagctacttcagcgggaagcagcaggccgtcnccaccaccaccaccancagcggctcggaggagttcgggggcatggggtccaaaaagccgaggaacgcgagccccaggggcggcggccccatttcccccaaggagaagaaagacaaggtcggcgagagagtggcggcgctgcagcagctcgtgtcnccatttgggaagacggacacggcttctgttcttcaggaggcgtcgggctacatcaagttcctgcaccagcagctcgaggttcttagctccccgtacatgcgccctcctccggcgcccggcgccgagcctgaggaccccgaccactacagcctgcggaaccgcggcctgtgcctggtgccagtggagcagacccngcagctgacccagagcaacggggcggacctctgggcgccggcgaacaccaccagacgctgctgaaccgaagcccgaggtctcggcggcgatggccgcactgcgtggnagggatagaattccagtgcaagcgcgcgcatggctgacccaattcggtctcctagctaacacaatcgtttcgtttcgtttcgtttatgtgaacntcaacagaccctgtgttgcgccggtagtatgtatgtgtaatcgtcgtatatagcgagannacgcaccgccgatcgatcgatcaccgtggtcgttgcgtgagtgactatgtggtttaacatggcagcgacctgttgctgtcaccgactaatnatcaaaagcagcagtttcatgcca

SEQ ID NO: 4046 - DNA, 1125 bp, Triticum aestivum
gcggcccctctctccccactccttccttaaaccccccataagccttgttcctttcccttctctctagctactcttgcagcctcgctcctcttctccagcaggcctctccggctccaaacacgaacggtgaggaggcgccggagcaagctgccgtcgcggcgcgccactgccggtggagtcgagtctcgaagccggagtagtggagatagagcttctgccccctctcggcggcgttgatcctctgcagcaggaaaaaaggggcgaacgtacgcgtagccagcagcagtagcgggggaggaagatgatgatgactcaagtggccaaccacagcaagaggaaccacaccgacagctacttcagcgggaagcagcagcagcagcagcagcaggccggcgccaccaccaccagcggcggctcggaggagttcgcgggcatggggtccaagaagccgaggaacgccagcccccggggcagcggcggccccatttctcccaaggagaagaaggacaaggtcggcgagagagtggcggcgctgcagcagctcgtgtcgccatttgggaagacggacacagcttctgttcttcaggaggcctcgggctacatcaagttcctgcaccagcagctcgaggttcttagctccccgtacatgcgccctcctccggcgcccggcgccgagcctgaggaccccgaccactacagcctgcggaaccgcggcctgtgcctggtgccggtagagcagacgctgcagctgacccagagcaacggggccgacctctgggcgccggcgaacaccaccagacgcacctgaagtgaagcccgaggcaggcctcgacggcggcgatggccgcactgcgtggcaggggtagaattccggtgcaagcgcgcgcatgcgcatggctgacccaattcggtcaatctcctaacacaatcgtttcgtttcgtttatgtgaacctcctcaacaggccctgtgctggcgccggtagtatgtaatgtgtaatcgtcgtgtatagcgagacgacgcaccgccgatcgatggatcgatcggtccccgtggtcgttgcgtgggtgactctgtggtttaacattggtagcgacctgttgctgtcgccgactaatcatcaaaa

SEQ ID NO: 4047 - DNA, 1013 bp, Secale cereale
tcttcccactccttccttaaaccccccataagccttgttcctttcctttctctctagctactcttgcagtctcgctcctcttctccaggcctccccggctccagacacaaacggcgaggaggcacggcgcgccagtgccagtggagtcgagtctcgaagctggagaagtggagatagagcttccgccccctctcggcgttgttgttgatcaaactgcctctgcaggaaaaagggggcgaacgcggaacgcatagccagctgcagtagcgggagaggaagatgatgatgactcaagtggccaatcacagcaagaggaaccacaccgacagctacttcagcggcaagcagcagcagcagcaggccggcgccgccaccgccaccagcagcggctcgggggagttcgggggcatggggtccaagaagccgaggaacgccagccccaggggcggcggccccatttctcccagggagaagaaggacaaggtcggcgagagagtggcggcgctgcagcagctcgtgtcgccatttgggaagacggacacggcttctgttcttcaggaggcgtccggctacatcaagttcctgcaccagcagctcgaggttcttagctccccgtacatgcgcccttctccggcgcccggcgccgagcctgaggaccccgagcactacagcctgcggagccgcggcctgtgcctggtgccggtggagcagacgctgcagctgacccagagcaacggggccgacctctgggcgccggcgaacaccaccaccaggcgcccttgaagcaaagcccgacgctggcctcgacggtggcaatggccgccccgcacttcgtggcaggggtagaattccggtgcaagcgcgcgcattggcatggctgacccaattcggtcaatctcctaacacaatcgtttcgtttcgtttggtctccgtgaacctcctcagcagaccctgtgctggcgccggtagtatgtattatgtgtaatcgtcgtgtatagcgagacgacgcaccg

SEQ ID NO: 4048 - DNA, 1971 bp, Zea mays
atctttagtggctgtccacttcagggcgaccccccggtgtcgttgcaaaatcaaacaagggatacaatatcacatgtgcaacgtacggtagtgatatagaatagcacgatgacaaggagcctccggcgagcgaggatgccatgcctacttcgacccttcctggccctccgcccccccgtacgtagcgacacctttctgtttctgccccgcgccgaggttgcctttcttgtcgtgtgccggacgaggagggctaccaagagtccgttcccagacggccagacccagcacgtacgacttccaaccaccagccacgtcgtcagactcagctgtttgcttcagcaatcagtcgtcgtcagccacggacacacgacacgagcagaggaagctgagctcttgcttgttcctgcagtcgtctgcagccgctgccgacgagcggcgcgcccgcccgctacgtgacatcgggtcccgtcggggccatggggatctacgagcggcagcgccacctggtgcccaccggcgtgtggggggaaccgttccggctcgacgccgacgccgtggccatgcccctgcccctggccgcgttcccctcggtcaccgtggccacgccggcgccgctcgacgtcgtcgagccggaagcagaggagatcaagctcggcaaacgactgttgcaggcgcagcaggacgacgtgccgcggatgcaagaagcgccgccgtcgtcggatagcttcagccacgacgatgacgacgctaggccgagagacaaggttcagagacggctcgcgcagaacagagaggcagctcggaagagccggctacggaagaaggcgtacatacggaacctcgagacgagccgcgtgaagctggcgcagctggagcaggagctcataatggccaggcgccagcagcacggcgcgtacggcgtgggaggaggagtcgcaccgccggcggcgcccgtggacccgcgcgtcgctgcgttcgagctggagtacgcgcactgggtggaggagcagagcaggcaggcgacggagctgcgggcggcgctgcagtcgcacgcgccggacgtccagctgcgggtcctcgtcgacgccgcgctggcgcactacggcgcgctgttccaggccaaggcgagggcagcccggtccgacgccttcttcgtgctgtccggcgtgtggcggtcccccgcggagcgcttcttcctctggatcgccggcttccgcccctccgacctgctcaaggtgctggagccgcagctgagcccgctcatggaccaccaggcgtccgaggtgcgcaagctgcagaacacggcgcggcagctggaggacgcgctgtcgcagggcatgagcaagctgcagcagacgctggtcgacaccctcatgaccgtcgacgtctccccggacggcgccgggggcggatacgcggggcagcagatggcctgcgccgtgggcaagctcgccgacctcgtcgacttcgtggacaaggcggaccacctccggcagcagacgttgcggaacatgcacaagatcctgacgccgcggcaggcagcgcgcggcctgctcgcgctcgcggactacggtcagcgcctgcgcgcgctcagctcgctctgggcggcgcgccccagggagcccgcatagtcgtaacgagacacccgcgacggcgacagcgacgggggagaggaagcggcattgcaggcacgtgcgcgcgtggttgcctttggctgccgcccagcggagcaagaagccatgacgcggcagacgccggcctgcgatcagtgcctcggttcctcccactcccagctctgcatctggtattctgatcatgtgaaagatgtacaacgaacaatctatggaaccagagttagacgggcatgtatcctatgcaatcatacatctcctgcaatcgagtaatttgtattattgattgtaaaccatgtgctgataatatttaacaaataatccttttgttttgtgcctt

SEQ ID NO: 4049 - DNA, 1762 bp, Zea mays
aacttcgccggcaaggtagaagtcgtccacaagttccaaacttccaattgaacttgtcttctgttgtgcttgtgctctgtctgtctagacctggcgatgatttccagcaatgcccctcgtattctgactaggtgaaccctctgtgaccgacatgaagggcccaccgttataggaaaacgctgcaacacgccatgtacggcatgggcatgaccgttgtggcgtggcggtgtgccgttgtctacctcgtctcgtctcttttctcaaccggactcctgttttatttcggatcgcgacgccacaatcccaccggccacagcacagaccaggccgccgccgccgccgccgctctgccttgttcgcagctctgttggccgctcgctttcgcaacattattatacccacctaatcgaccgacgcaatcgaaaccgcctcccatctcatccgtctctctcgaatcccaccgtgcgctcactgcgatggacggctcatccaagcggatcggcggtggcggcgacgacatgcccagccccgaccacgaccagaacgccagccccaacgtcccgccgtccgccgctggtgacggcggcgcatcagccactgcggcggcagcgcccgccgccgggaggcggccgttcaccagcctcagccaggaggaggccgacctcgcccttgcccgcgtcctccaggagcaggagcgggcgtacatgatgctgaccggcggcgagtacgcgatctcggacgccgagagctacgactacgacgaggaagacggcgatgggagcgactacgaggaggaaggcgaggcgctcgacgaggacgagcaggttggggacgcggaagcggagggggctgagggggacctggacctggacccttctcagtacgaggacgacggggagggcgacgtctccgacaggctcatggcgctcgtcgggatcggtgattggcgagcaatggagcaggatgatgctggggacgaggaggacgacgaagatgctgaggttcatacacagggtgcatgggaagatgttgacccagacgaatactcttacgaggagctaattgcgctgggtgaagttgtcggtacggaaagcaaaggccttgctgctgacactattgcctcattaccttgggtgacttaccaggcacaagacaagcaagatggcaacatggaacagtgtgttatttgtcgtgtggagtttgacgagggcgagtcattagttgcactcccttgcaaacatccataccattctgagtgcataaaccagtggctgcagctaaacaaggtatgcccgatgtgcagtgctgaagttcccacttctgtgaacaagcaggcatgacttactcaaacggaagaagatagcggtggcttggtatttatctgccattgatggaatgaaagaagcgccaactgttaaattgttcagggaagcaagggaattggctgggttctgattccctgttttcttcagttcgacaggcttagtcccccccggcctgtacgcatgctaatttgtatggccataccgctggttatttatgcattccatcagacgccgatgattcattgcttgtagatgtaaatcaacaatcataccaccatagtcaatagcagttgttttaatgccaatagcaacgttcatgtttaaaatggtagcatttttgttccttgttttctagaccggacattttatgttcctgaagatggtgattgtgttacaaacgagttgagttgacatgagctgtgtactgatgcgttaag

SEQ ID NO: 4050 - DNA, 2297 bp, Saccharum officinarum
ctccgcccacctctcctccccctcggcctctccctcccaggcccgcccgacccagcccgcaggaaccctagcctccccgccccgccccgcccgatctcccgatcgccggattcgtgcctcggccggatggactccgatgtggagatgaacgccgccagcgacgaggaggtgatggacgacgaggactactacgactactgcgacagcgacatgggcgacgacggcgacggcgggagcgaggaggaggagctggtggccggggactacgacgagggcatcgaggccgaggggaccgacgaggtggtgtctaggcgcgagcagacatttgtggttttaaacgaagaagttatatctgagcgtcaagaggaagatgtaagcaaggtatctgccgtgttgttgatcacaagggaagaggcgtgtgccctcctgcaccactacaaatggaacatcagcaagttgagtgacgaatggtttgcagatgaagaaaaagtccgccatactgttggcttacttttgaatggaaatcatgagccccgctctaggaagctaacttgtggaatatgttttgaagggtattcttctgatatgatgagctccgctggttgtgctcatttttattgccatgaatgttgggaaggctacattagtgctgcaataggtggtggtccaggatgtttgtcattgagatgtcctgatccatcatgtagtgctatggttcttcaagggacgattaatgaattagctaaagatgaggataaagaaaaatatgcacgatttctcttacgtgcatatgttgaaggtagcaagaagactaaatggtgtccagctcctgactgtacatgtgctgtggagtttcttggtgatgaaaactatgatgtgtcatgcaattgcaagttcagcttttgctggaattgcactgaggaagctcatcgaccagtgaactgtgagactgtttctaagtggatattaaagaacagtgcagaatctgaaaacatgaactggatactggctaattctaagccctgtccaaagtgcaaacggccaatagagaaaaaccagggatgcatgcatatgacatgcacccctccttgcaaatttgaattttgctggttatgtctaggcgcatggtcagatcatggagagagaacaggtggcttttatgcttgcaatcgttatgaatcagcaaagaaagagggagtttatgatgagactgaagcaaggagggaaagagctaagaactctcttgagagatatatgcattactatgagcgctgggcatccaatcagacatcgaggcagaaggcccaatctgatctgctaaaagcggaaaaggatcagcttgcaaatttaactgatattttcgggataccagagacccagcttaagttcataattgaagcttggtcacagattatagaatgcaggcgagtgctgaaatggacatatgcttatggctactatctggatgataaggtcaagagtgaattttttgagtatctgcaaggtgaggctgagtctggcttggaacgtctgcatcagtgcgctgagaaagacttgcaaaaatttttgccttctgtgaaatctgacagcactgaaacgacggcacctacaccggatgaatttagtgaattccgcgtgaagcttgctgggctcacaagcgttactcggaattactttgagaaccttgttcaagctttggaagctgggttggaggatgtccgtgccactgcccaggctgctggtacatccagcgctgccaccagctccaagaaaggaggaactaaatccaagaagaagcagcacacaaaaccatcatctgaccacactgatgatggttggccctgcgagcgctgcacatttcttaaccctccctcagtggatgcgtgcagtgtctgcgaaaagagtaggtactaaatgatggaacagcccaaagggaggcaccccaagaaaagctcaatgtttatgagaagaggggcgctttagatccagcatcggatgctgagaagcggagcttccagcagttgcaatggtgtacagagagttattttaagggtctcaaatggctggaaatggagtggaggctcaaatggttacatgtgtgtgtggggtcatttggttttctagttcgttcatgttgttccttgtaaatattagttgtgaagtggtaacctgtgtttatgtggtgggttttgcttctgaccaactgtgaaattgaactttcagaaaactgatggaaggtagctctgtttattccctcgtaattgcgggcagggcctttgtctactattcaaggactt

SEQ ID NO: 4051 - DNA, 2349 bp, Setaria italica
ccccgatcgccgggcgcgatggactccgacgtcgagatgaacgccgccagcgacgaggaggtgatggacgacgaggactactacgactactgctacagcgacgtgggcgacgacgaggacgacggcggcggcggtgatagcgacggggagctggtgggcgcggactacgacgagggcctcgaggccgaggggagcgacgtcgtggtgtccaggcgcgagcagacattcgcagttttaagagaagaagatatatctgaacgtcaagaggaagacataagcaaggtatcttccgtgttatcaattgcaagggaagaggcatgtgttctccttcatcactataaatggaacatcagcaagttgagtgatgagtggtttgcagatgaagaaaaagtccgccataccgttggcttacttttgaatggaaatgaccgtcctcgctcgaggaagttaacttgtggaatatgttttgaagggtattcttctgatatgatgagctctgctggttgtgctcatttctattgccatgaatgttgggaaggctatattagcgctgcaataagtggtggtccaggatgtttgtcgttgcggtgtcctgatccatcatgtggtgctatggttcttcaaaggatgattaataaattagccaaagaggaagataaagagaaatatgcacgatttctcttacgtacatacgttgaaggtagcaagaagactaaatggtgtccagctcctgattgtacttgtgcagtggagtttcttggtgatgagaactacgatgtctcatgcaattgcaagttcaacttttgttggaattgcaccgaggaagctcatcgaccagtgaactgtgagactgtttctaagtggatactgaagaacagtgcggaatctgagaacatgaactggatactggctaattctaagccctgtccaaaatgcaaacggcctatagagaaaaaccagggatgtatgcatatgacttgcacccctccttgcaaattcgagttctgctggttatgtctgggtgcatggtcagatcatggagagagaactggtggcttttatgcctgcaatcgttatgaatcggcgaagaaagagggagtttatgatgagactgaggcaaggagggaaagagctaaaaactctcttgagagatatatgcattactatgagcgctgggcatccaatcagacatcaaggcagaaggcccaagcggatctgcataaagcggaaaaggaacaacttgcaaagttaactgacatttttgggataccagagacccaattgaagtttatagttgaagcttggtcacagattatagaatgcaggcgggtcctgaaatggacatatgcttatggctattatctagatgataaggtcaagagtgaatttttcgagtacctgcaaggtgaagctgagtctggtttggaacgtctacatcagtgtgctgagaaagacttgctagcatttttgccttctttgaaacctgatagcaacgaaactacagcaccttcagtggcggaatttggtgatttccgcgtgaagcttgctgggctcacaagtgttactcggaattactttgagaaccttgttcaagctttggaagctgggttggaggatgtccacgctactggccaggcagctgctacatccagcactgcaaccagttccaagaaaggaggaactaaatccaagaagaagcatgctaaaccatcatcggaccacactgatgatggctggccctgtgagcgctgcacatatcttaatcctccttcagtggatgtgtgcagtatctgcgaaaaaagtaggtaccagacttgagaatagctcaagggggaggcaccccaagaaaagctcaaagctcatgagaagaggggcgcgctttccatcctgcgctggatgctgaaaagatgagcttccagcagctgcactggtgtatagagtcaacgaagggtctcagttgcaaatggaatggaagctgaaaaatgcgcgtgtgggttcatttggtttgctagtctgtgtctgttgttccttgtaaatattagttgtgaggtggtgatctgtgttttatgtgttgggttttccctgactgtctgactgaccagtgaaaaaaaactgggaggtagctctatttattcccccaaaatattactgcactcttgttacttacctggatggctggtgtatattaccacgtccaaacatcatgttcactgtgtgttgcaaaaactgtcgcctcgatggtatgctcacttccactttaacagacatttcaacaatgtatgaaacggttgcttgcagcacctatactggagttagttgttggtattctatgaacatgtttgttcgttg

SEQ ID NO: 4052 - DNA, 2353 bp, Panicum virgatum
atagaaaacccattaaaaaacgcagcccaccattacggtgccgactcgggcacgcaactccgccgatctcctcccacccccaaatccctcctcccccgccccgcctcgccggaaccctagcccccgcccgcccccaccccctccctccgccggatcccccgatcgcccggcgcgatggactccgacgtcgagatgaacgccgccagctaccaggaggtgatggacgacgaggactactacgactacgactactgctacagcgacgcgggcgacgacgggagcggcggcggcggcgacagcgaaggggagctggcggccggtgacttcgacgagggcctcgaggccgaggggaccgacgaggtggtctccaggcgggagcagaccttcgcggttttaagcgaagaagatatctctgaacgtcaagaagaagatataagcaaagtatctgctgtgttatcaattaaccgggaagaggcatgtgttctccttcatcattataaatggaacatcagcaagttgagtgatgaatggtttgccgatgaagaaaaagtccgccatactgttggcttacttttgaatggaaatgaccgtcctcgcttgaggaagctaacttgtggaatatgttttgaagggtattcttctgatatgatgagctctgctggttgtgctcatttttattgccatgaatgttgggaaggctatattagtgctgcaattagtggtggtccaggatgcttatcgttgcggtgtcctgatccatcatgtggttctatggttcttcaagggatggttaataaattagccaaagatgaggataaagaaaaatatgcacgatttctcttacgtgcatatgttgaaggtagcaagaagactaaatggtgtccagctcctgactgtacatgtgcagtggagtttcttggtgacgagaactatgatgtcttatgcaattgcaagttcaatttttgctggaattgcaccgaggaagctcatcgaccagtgaattgtgagactgtatctaagtggatattgaagaacagcgcagaatctgaaaatatgaactggatactggctaattctaagccttgtccaaaatgcaaacggccaatagagaaaaaccagggatgcatgcatatgacttgcacccctccttgcaaattcgagttctgctggttatgtctggatgcatggtcagatcatggagagagaactggtggcttttatgcctgcaatcgttacgaatcagcaaagaaagagggagtttatgatgagactgaagcaaggagggaaagagctaaaaactctcttgagcgatatatgcattactatgagcgctgggcatccaatcagacatcgaggcagaaggcccaagcggatctgcacaaagcggaaaaggaacaacttgcaaagttaactgacatttttgggataccagagacccagctgaagttcataattgaagcttggtcacagattatagaatgcaggagagtgctgaaatggacatatgcttatggctactatctagatgataaggtcaagagtgaatttttcgagtaccttcaaggtgaagctgagtctggtttggaacgtctgcatcaatgtgccgagaaagatttgcaagcatttttgccttctttgaaacctgatagcaacgaaactatgacaccatcagttgcggaatttggtgatttccgcgtgaagcttgctgggctcacaagtgttactcggaattattttgagaaccttgttcgagcattggaagctgggttggaggatgtccgtgctgctggccaggcgggtgctacatccagcacggccaccagttccaagaaaggtgtaactaaatccaagaagaagcaacactctaaaccatcatctgaccacactgatgacagctggccctgcgagcgctgcacatatcttaaccttccttcagtggatgcgtgcagtgtctgcgaaaaaagtaggtactagatgagggaacagctcaagggagtcccctcaagaaaatctcaaagctcatgagacaggggtgctctccctcctgcatcggatgccatgaggttgagcttccagcagttgcgatggttggggttcatttggtttgctagtctgtgtgtgttgttccttgtaaatattagttgtgaagtggtaactgtgtctatgtggtgggttttgcagctgaccgacctgtgaaactaaacttggaggtagctctatttattcccacaaaatattccagggtccttgtatttgcatctaaggacttgactatggttatacttacctagactgctaagtgtatattaccacgccttgcatcatgttaatctgggtgctcttaaagatggct

SEQ ID NO: 4053 - DNA, 2355 bp, Pennisetum glaucum
ccccgccccatcctcgccggaaccctagctacccccacccccatcccctccgccggatccaccgcccgatcgccgggcgcgatggactccgacgtcgagatgaacgccgccagcgacgaggaggtgatggacgacgaggactactacgactactgctacagcgacgtgggcgacgacgaggacgaggcaggaggcggcggcgatagcgacggggacctggtggaagcgggatacgacgagggcctcgaggccgaggggaccgacgaggtggtctccaggcgcgagcagacatttgcggttttaagtgaaaaagatatatctgaacgtcaagaggaagaaataagcaaggtatcttctgtgttatcaattgcaagggaagatgcatctgttcttcttcaccactataaatggaacatcagcaagttgagtgatgagtggtttgcagatgaagaaaaagtccgccataccgttggcttacttttgaatggaaatgaccgtcctcgctcgcggaaggtaacttgcggaatatgttttgaagggtattcttctgatatgatgagctctgctggttgtgctcatttctattgccatgaatgctgggaaggctatattagcgctgcaataagtgatggtccaggatgtttgtctttgcggtgtcctgatccatcatgtggtgctatggttcttcaacggatggttaataaaatagccaaagaggaagataaagagaaatatgcacgatttctcttacgtgcatacgttgaaggtagcaagaagactaaatggtgtccagctcccgattgtacttgtgcagtggagtttcttggtgatgagaactacgatgtctcgtgcaattgcaagttcagcttttgttggaattgtactgaggaagctcatcgaccagtgaactgtgagactgtttctaagtggatactgaagaacagtgcagaatctgaaaacatgaactggatactggctaattctaagccctgtccaaaatgcaaacggccaatagagaaaaaccagggatgtatgcatatgacttgcacccctccttgcaaattcgagttctgctggttatgtctgggtgcttggtcagatcatggagagagaactggtggtttttatgcctgcaatcgttatgaatcggcgaagaaagagggagtttatgatgagactgaatcaaggagggaaagagctaaaaactctcttgagagatatatgcattactatgagcgctgggcatccaatcagacatcaaggcagaaggcccaagcggatctgcataaagcggaaaaggaacaacttgcaaagttaagtgacattttggggataccagagacccagctgaagtttataattgaagcttggtcacagattatagaatgcaggcgggtcctgaaatggacatatgcttatggctattatctagatgataaggtcaagagtgaatttttcgagtacctgcaaggtgaagctgagtctggtttggaacgtctacatcagtgtgctgagaaagacttgctagcatttttgccttctttgaaacctgacgaaactacaacaccttcagtggcggaatttggtgatttccgcgtgaagcttgccgggctcacaagcgttacccggaattactttgagaaccttgttcaagctttggaagctgggttggaggatgtccacgctactggccaggcagctgctacatccagcactgcaaccacttccaagaaaggaggaactaaagccaagaagaagcatgcaaaaccatcatctgaccctactgatgacggctggccctgtgagcgctgcacatatcttaatcctccttcggtggacgcatgcaatgtctgcgaaaaaagtaggtactaaactttgagaatagctcaaagggaggcaccccaagaaaatctcaaagatcgtgagaagatgggcgctttccatcttgtgaaggatgcttaaaagatgagcttcccgcagctgcactggtgtatagcgtcaaggaagggtcttagttgcaaatggagtggaggctgaaaaatcgttatatgcgtgtgtggggccatatttggtttgctagtccgcgtttgttgttccttgtaaatattagttgtgaggtggtgatccatgttttatgtgttgggttttgcccgactgaccagttaaactaaactgggaagtagctctatttattccccaaaaatattactgtgctgctgtaatcgcatctcctaccaacatcatgttctctacttgcagcacctatactggagttgctggtattctgtgaacatttttgttcgttagacttgggacattgggtggaaaattgttttacttgattgttcgatggac

SEQ ID NO: 4054 - DNA, 2534 bp, Zea mays
aactctaccgacctccgctcaccgccccctttcctcctatccctcccagagccccgacccggccggccggccggccggaaccctagccttatcgcccctccctttcccgcctcgcctccgcgcgatctcccgatcgccggattcgtgccgcggctggatggactccgacgtggagatgaacaccgccagcgatgaggaggtgatggacaacgatgactactacgactactgctacagcgacgtgggcgacgacggtgggagcaacagcgggagcgaggagctggtggccggggactacgacgagggcctcgaggccgaggggaccgacgaggtggtctctaggcgcgagcagacatttgtggttttaaacgaacaagttatatctgaacgtcaagccgaagatgtgagcaaggtatctgccgtcacactgattacaagggaggaggcgtgtgccctcctccatcactataaatggaacatcagcaagctgagtgacgaatggtttgcagatgaagaaaaagtccgccatactgttggcttacttttgaatggaaatcatgacccccgctctaggaaggcaagatttatatttcatactcttatgtttctttttcatcaaagcaacgcgtgtaatccgctagtctgtggaatatgttttgaggggtgttcttctgatatgatgagctctgctggttgtgctcatttttattgccatgaatgttgggaaggtcgctccctcctcctcctttgttattgctgatgcatgattaggttccattgtcattatttgctacattagcgctgcaattggtgatggtccaggatgtttgtcattgcgatgccctgatccatcttgtagtgctatggttcttcaagggatgattaatgaattagctaaagatgaggatagaaaaaaatatgcacgatttctcttacgcgcatatgttgaaggtagcaagaagactaaatggtgtccagctcctgactgcacatgtgctgtggagttccttggtgatgaaaactatgatgtttcatgcaattgcatgttcagcttttgttggaattgcactgaggaagctcatcgaccagtgaactgtgagactgtttctaagtggatattaaaaaacagtgcagaatctgaaaacatgaactggatactggctaattctaagccctgtccaaagtgcaaacggccaatagagaaaaaccagggatgcatgcatatgacatgcacccctccttgtaaattcgaattttgctggttatgtctgggtgcatggtcagatcatggagagagaacaggtggcttttatgcttgcaatcgttatgaatcagcaaagaaagagggagtttacgacgagactgatgcaaggagggaaagagctaaaaactctcttgagagatatatgcattactatgagcgctgggcatccaatcagacatcgaggcagaaggcccaagcagatctgctaaaagcggaaaaggaccagattgcaaatttaactgacattttcgggataccagagacccagcttaagttcataatcgaagcttggtcacagattatagaatgcaggcgagtgttgaaatggacatatgcttatggctactatctggatgataagatcaagagtgaattttttgagtatctgcaaggtgaggctgagtctggtttggaacgcctgcatcagtgcgctgagaaagacttgcaaaattttttgccgtctgtgaaatctgacagcactgaaacaacgacacctacagtggctgaatttggtgaattccgcgtgaagcttgctggacttacaagcgtgactcggaattactttgagaaccttgttcaagctttggaagctgggttggaggatgtccgtgccacaggccaggctgctggtacatccagcactgccaccagctccaagaaaggaggaactaaatccaagaagaagcagcacactgcaccatcatctgaccacactgatgatgggtggccctgcgagcgctgcacatttcttaaccctcctacagtggatgcatgcagcgtctgcgaaaagagtaggtactagatgatggaatagctcaaagggagccagggaggcatcccaagaaaacctcaaagctcgtgagaagcatgcatgcatcggatgctgagaagaagagcttccagctgccgcaatgttgtacagagagttattttagggcctcggttggaaacggtgtggaggctcaagtggtcacatgtttgtgggggtcatttggttttctagttcttttctgttgttccttgtaaatatatttgttgtgatgtggtgacctgtgtttatgtgatgagtttttgtttctgacaaactgtgaaattaaactttaacaaaactgatgagtggtagctctgtttattccctcctaattgcgggcagggtctttgtctattcttccacattatttatctacggttacttgccaagtaaccatctgctagtgctggtcaatgttacttcaaagccgatcatcgcgtgatctgttttcccatatag

SEQ ID NO: 4055 - DNA, 2069 bp, Setaria italica
atggactccgacgtagagatgaacgcagctagcgccacgaggacttctacgactactgctacagcgaacacattcgcggttttaagagaagaagatatatctgaacgtcaagaggaagacataagcaaggtatcttccgtgttatcaattgcaagggaagaggcatgtgttctccttcatcactataaatggaacatcagcaagttgagtgatgagtggtttgcagatgaagaaaaagtccgccataccgttggcttacttttgaatggaaatgaccgtcctcgctcgaggaagttaacttgtggaatatgttttgaagggtattcttctgatatgatgagctctgctggttgtgctcatttctattgccatgaatgttgggaaggctatattagcgctgcaataagtggtggtccaggatgtttgtcgttgcggtgtcctgatccatcatgtggtgctatggttcttcaaaggatgattaataaattagccaaagaggaagataaagagaaatatgcacgatttctcttacgtacatacgttgaaggtagcaagaagactaaatggtgtccagctcctgattgtacttgtgcagtggagtttcttggtgatgagaactacgatgtctcatgcaattgcaagttcaacttttgttggaattgcaccgaggaagctcatcgaccagtgaactgtgagactgtttctaagtggatactgaagaacagtgcagaatctgagaacatgaactggatactggctaattctaagccctgtccaaaatgcaaacggccaatagagaaaaaccagggatgtatgcatatgacttgcacccctccttgcaaattcgagttctgctggttatgtctgggtgcatggtcagatcatggagagagaactggtggcttttatgcctgcaatcgttatgaatcggcgaagaaagagggagtttatgatgagactgaggcaaggagggaaagagctaaaaactctcttgagagatatatgcattactatgagcgctgggcatccaatcagacatcaaggcagaaggcccaagcggatctgcataaagcggaaaaggaacaacttgcaaagttaactgacatttttgggataccagagacccaactgaagtttatagttgaagcttggtcacagattatagaatgcaggcgggtcctgaaatggacatatgcttatggctattatctagatgataaggtcaagagtgaattttttcgagtacctgcaaggtgaagctgagtctggttttggaacgtctacatcagtgtgctgagaaagacttgctagcatttttgccttctttgaaacctgatagcaacgaaactacagcaccttcagtggcggaatttggttgatttccgcgtgaaagcttgctgggctcacaaggtgttactcggaattactttgagaaccttgttcaagctttggaagctgggttggaggatgtccacgcgactggccaggcagctgctacatctagcactgcaaccagttccaagaaaggaggaactaaatccaagaagaagcatgctaaaccatcatcggaccacactgatgatggctggccctgtgagcgctgcacatatcttaatcctccttcagtggatgtgtgcagtatctgcgaaaaaagtaggtaccagacttgagaatagctcaagggggaggcaccccaagaaaagctcaaagctcatgagaagaggggcgcgctttccatcctgcgctggatgctgaaaagatgagcttccagctgctgcactggtgtatagagtcaacgaagggtctcagttgcaaatggaatggaagctgaaaaatgcgcgtgtgggttcatttggtttgctagcctgtgtctgttgttccttgtaaatattagttgtgaggtggtgatctgtgttttatgtgttgggttttccctgactgtctgactgacctgtgaaacaaaactgggaggacctgtgaaaaaaaactgggaggtagctctatttagggggtgttttcttccactgacttatttttagcacgtgtcacatcgaatgtttagatactaa

SEQ ID NO: 4056 - DNA, 3230 bp, Oryza sativa
caaaattactgaatcccctcctcttattgcttcacagttcccaaaagtgtaccacactggtatataaaaaacaccccatcctgtgtgcctgccgactcgcccacgcaactccgactctttccttccccaattctcccgtccaccggccgcggacctcgccggaaccctagccccgccgcccccctcccctccccgatcgcccgattcggtggtcggggtgatggactccgacgccgagatgcccatgtccagcgacgaagagatgttggatgacgaggactattacgactacagtgatgacatgggtgaggacgatgatgggagcggcggcgggggcgggggagatagcgatggggaggaggaggaggagggggatgaggagctggtgggcggcgactacgagggccgcgaggcggaggggagcgacgaggtggtgtcccgccgcgagcagagatacattgtattaactgaaaaggatataaatgagcgtcaagaggaagatataggcaaggtatctgctgtactatcgattcgaagggaggaggcgtgtgttcttcttcatcactacaaatggaacatcagcaagttaagcgatgaatggtttgcggatgaagaaaaagttcgtgatattgttggattacttttaaatggaattgatcttcctaactctagaaagctaacttgtggaatatgttttgaagggtattcttctgatgtgatgagttctgctgattgtgatcatttttattgccatgaatgctgggaaggttatattagtgctgcaataagtgatggtccaggatgtttgtcattgcgatgccctgatccatcttgtggtgctatggttcttcagaacatgattaataagttagctaaagatgatgataaagtgagatatgcacgatttatcttacgtgcatatgttgaagatagcaagaagactaaatggtgtccagctcctgactgtacatgtgcagtggaatttgtcagcgatgggaactatgatgtctcatgcaattgcaaattcagtttttgttggaactgcacggaggaagctcatcgaccagtgaactgtgagactgtttctaggtggatattaaagaatagcgcagaatctgaaaatatgaactggatactggctaattctaagccgtgcccaaaatgcaaacgaccaatagagaaaaaccagggatgcatgcatatgacttgcactccaccttgcaaatttgagttctgctggttatgtctgggttcatgggctgaacatggggagagaactggtggattttacgcttgtaatcgctatgaatcagcaaagaaggagggagtttatgatgagactgaagcaaggagggaaagagccaaaaattcacttgagagatacatgcattactatgagcgctgggcatctaatcagacgtcgaggcagaaggcacaagcagatctgcaaaaggcagaaaaggaacaacttgcaaaattaacagatgtttttggaataccggagacccaactgaagttcataattgaagcttggtcacagattattgaatgcaggcgggtactcaaatggacatatgcttatggctattatctggacgacaaggtcaagagcgaatttttcgagtacctgcaaggtgaagctgagtctggtctggagcgtcttcaccaatgtgctgagaaagacctgcaatcatttttgactgtgagatctgataatactgaacctgcaccatcaattgctgaattcggtgacttccgggtgaagcttgcggggctgacaagtgtgactcggaattattttgagaaccttgttcaagcactggaggctggcttggaggatgtacactctactgcccagggtaccacatcaagcaatgccaccaacatcccctccaagaaagcagtcactaaaggcaaaacaaagaagcagcttcctagaacatcttcggacaactcagatgaaggctggccttgtgagcgctgcacgtttattaacccttcatcggtggatgcatgcagcgtctgcgataagcatagatactagatgaaaaactggctgaaagccagtgccccccataaatctcgaagctgttgagaaggtgggtgcttactcaaagctcatgagaagattgttgattgtagttctgttcctaaattatgtggcgttgaagaagagcttccaatggcagcaatggcgtacatgtgtgagtgaaggtccctggttgtatctagattgcagcaacaatgcaggaccgactatggagcgaaggtggatggggtacaaacatgtggtagtcttttttttttttactttctagcctatattatgtacatattagttatggtctgtagttgtgttaatgtggtgggcaatgttctgtttttgtttaaatgacatgagatgatgtggtgggtaaagttccaccccctgtactgaccaacctgtgaagctggagaatggtagatgtagctcttatctattgagcggtcatgtaaattaccaaagctcgtcataatctatggttgataaatcatgtgggaaactggtgtttactcagcagtacctgatttcttatagattcgtcgttcgagctgcatattttgatggatggaatttttgatgttgtgtgcatattatagcaaacaaaaatacccatttaccgaaagagtagcaaaaccggtacgatccccatttcagttccatttctcatttcacaatccaagcgcagcatcgcatcgtgttgccactccaatacatttctctaagttggtcttgtatctctctctagttatccctgtctggtgaaggtgaaagatgtgcagtttataagccttgatgaaacaaagttgatgagattgttgggcatcatcgatcatcagggagtaagagtatccttgcagagcctcctgctgagggtgctgaagttggccctggagaagtgcctggaggcgttcctccagtcggcgccggacttcatcatgagctcgaactcctggtagctgatgcggccgtccttgtcggtgtcgacgtcgcggaggatctccaggatggcctgctcgtttgggcccacctcctcccgcagctcgtccagctcgatgaacccgctgccgtccttgtcgaagtagttgaacgccgccgccaggtactcgtcgttgctcatcttcttcaggtgcaccgacaccgtcacgaactcgtcgcagtccagcgtcccgttcccgtccgtgtccgc

SEQ ID NO: 4057 - DNA, 2488 bp, Oryza sativa
cacactggtatataaaaaacaccccatcctgtgtgcctgccgactcgcccacgcaactccgactctttccttccccaattctcccgtccaccggccgcggacctcgccggaaccctagccccgccgcccccctcccctccccgatcgcccgattcggtggtcggggtgatggactccgacgccgagatgcccatgtccagcgacgaagagatgttggatgacgaggactattacgactacagtgatgacatgggtgaggacgatgatgggagcggcggcgggggcgggggagatagcgatggggaggaggaggaggagggggatgaggagctggtgggcggcgactacgagggccgcgaggcggaggggagcgacgaggtggtgtcccgccgcgagcagagatacattgtattaactgaaaaggatataaatgagcgtcaagaggaagatataggcaaggtatctgctgtactatcgattcgaagggaggaggcgtgtgttcttcttcatcactacaaatggaacatcagcaagttaagcgatgaatggtttgcggatgaagaaaaagttcgtgatattgttggattacttttaaatggaattgatcttcctaactctagaaagctaacttgtggaatatgttttgaagggtattcttctgatgtgatgagttctgctgattgtgatcatttttattgccatgaatgctgggaaggttatattagtgctgcaataagtgatggtccaggatgtttgtcattgcgatgccctgatccatcttgtggtgctatggttcttcagaacatgattaataagttagctaaagatgatgataaagtgagatatgcacgatttatcttacgtgcatatgttgaagatagcaagaagactaaatggtgtccagctcctgactgtacatgtgcagtggaatttgtcagcgatgggaactatgatgtctcatgcaattgcaaattcagtttttgttggaactgcacggaggaagctcatcgaccagtgaactgtgagactgtttctaggtggatattaaagaatagcgcagaatctgaaaatatgaactggatactggctaattctaagccgtgcccaaaatgcaaacgaccaatagagaaaaaccagggatgcatgcatatgacttgcactccaccttgcaaatttgagttctgctggttatgtctgggttcatgggctgaacatggggagagaactggtggattttacgcttgtaatcgctatgaatcagcaaagaaggagggagtttatgatgagactgaagcaaggagggaaagagccaaaaattcacttgagagatacatgcattactatgagcgctgggcatctaatcagacgtcgaggcagaaggcacaagcagatctgcaaaaggcagaaaaggaacaacttgcaaaattaacagatgtttttggaataccggagacccaactgaagttcataattgaagcttggtcacagattattgaatgcaggcgggtactcaaatggacatatgcttatggctattatctggacgacaaggtcaagagcgaatttttcgagtacctgcaaggtgaagctgagtctggtctggagcgtcttcaccaatgtgctgagaaagacctgcaatcatttttgactgtgagatctgataatactgaacctgcaccatcaattgctgaattcggtgacttccgggtgaagcttgcggggctgacaagtgtgactcggaattattttgagaaccttgttcaagcactggaggctggcttggaggatgtacactctactgcccagggtaccacatcaagcaatgccaccaacatcccctccaagaaagcagtcactaaaggcaaaacaaagaagcagcttcctagaacatcttcggacaactcagatgaaggctggccttgtgagcgctgcacgtttattaacccttcatcggtggatgcatgcagcgtctgcgataagcatagatactagatgaaaaactggctgaaagccagtgccccccataaatctcgaagctgttgagaaggtgggtgcttactcaaagctcatgagaagattgttgattgtagttctgttcctaaattatgtggcgttgaagaagagcttccaatggcagcaatggcgtacatgtgtgagtgaaggtccctggttgtatctagattgcagcaacaatgcaggaccgactatggagcgaaggtggatggggtacaaacatgtggtagtcttttttttttttactttctagcctatattatgtacatattagttatggtctgtagttgtgttaatgtggtgggcaatgttctgtttttgtttaaatgacatgagatgatgtggtgggtaaagttccaccccctgtactgaccaacctgtgaagctggagaatggtagatgtagctcttatctattgagcggtcatgtaaattaccaaagctcgtcataatctatggttgataaatcatgtggg

SEQ ID NO: 4058 - DNA, 2391 bp, Triticum aestivum
ggcggactcgcccacgcaactccatcggtctcgcctcgcacatcttcctcaccgcctcctgccccgccccgcccacctcgccggaaccctacctcctaccccttcgcgcccctgcccgatccgccgatcgtcagacttggcaagcgcaatggactccgactccgagatgcccgtcgccagcgacgaggagatggtggacgacgaggactactactactacagcgacgagggtgagggcgatgacggggacgccagcggcggcggcgcctccggcgacgaggatgtatcggccggagactacgagggccgggaggccgaggggagcgacgaggccgtctccacgcgcgagcagagatacattgttttatccgaaaaggatatatctgaacgccaagaggaagatataagcgaggtatctgcattactgttgattccaagggaagaagcatctgtccttcttcaccactataaatgggacatcagcaaggtgaatgatgaatggttttctgatgaagacaaagtccgtggtattgttggcttacttatgaatggaactgattttcataactcgaggaagctaacttgtggaatatgttttgaagggtactcttcagatatgatgagttctgcgggctgcgctcatttttattgccatgaatgttgggaaggttatatcagcgctgctgtaagtcagggtccgggatgtttgtcattgcgatgccctgatccatcgtgcagtgctattgttcttcaaggcatgataaataagttaggcaaacacgaagataaagagaagtacgcacgatttgccttgcgtgcatatgtggaaagtcgcaagaagacgaaatggtgtccagctcctgactgtacatgtgcagtggaatttgttagtgatgtaaactatgatgtctcatgtaactgcacattccgattttgctggaattgcacagaagaagctcacagaccagtgaactgtgagactgtttctaagtggattctgaagaacagcgctgaatctgaaaatatgaactggatactggctaattctaagccctgtccaaaatgccaacgaccgatagagaagaaccagggatgcatgcatatgacttgcacacctccttgcaaatttgagttttgctggttatgtctgggttcatgggtagaacatggtgagaggactggtggcttttatgcttgcaatcgctatgaatcggcaaagaaagagggagtttatgatgaggctgaagcaaggagggaaagggctaaacactcactcgagagatatatgcactactatgaacgctgggcatctaatcagacatcgaggcagaaggcaatagcagatctgcaaaaggcggaaaaggaacaacttgcaaagttaactgatatttatggaataccggagacacaactgaagttcattattgaagcttggtcacagattatagaatgcaggcgagtgcttcaatggacgtatgcgtatggctattatctcgaggacaaggtcaagagtggattttttgagtatctgcaaggtgaagctgagtctggtttggaacgtctccatcagtgtgctgagaaagacctgctagcgtttttgccattctcaaaacatgatactactgaagatcatccttcaccagctgaatttggtgaattccgtgtgaagcttgctggtctgacaagtataactcggaattactttgagaaccttgttcgagcattggaagatgggttggaggatgtccagtgtgccggagaggctgcaacctcaagcaaggccaccaactcgaagaaagcaggagctaaaggcaaagcggcgaagaagcagccgtccagatcatcttcggaccattctgatgatacttggccatgcgagcgctgcacatttctgaatccctcttcagcggatgcgtgtactgcctgtgataagcagcggtactagtagattaataaacggctcaaaaggcagtgacccaagaagctcaaagcgcatgaaaacatgtgtgtgcttatgctttagaaggtgaagcagagctctcaacggatgcaacggtgtacataagaaaggtcgaaggtccgtcctatgttttatgtagatcccaacggatatcattggttacaaggtcaatgtgcttttgcctgtgtgttgtaaatattggttacgaataggtgtagtgtggtgggtttcttctgcggttccatccaccttgctcccttcgtttctcctaacctaaaacatattaggttaagacttaccaagaattgttttattaatatatgatttctttttgtgtggaatgtgtgatccatgtgatctgaaattgttgtttccaaaacatttactggtgctacctctgttcctaaatgtaagtgttcgtagagattcca

SEQ ID NO: 4059 - DNA, 756 bp, Zea mays
aatgacaaaagatgagactctactagtcttcactcttgtggtttcctcggtttctattttcttattcgggatcttgcttttcatggttctcatctctgcaactcgcgattttcgcgagagaaccaaatccaagttggtgaagatcatgatttgggctggcatagtagttattacctttgcaattgcggttcgaatctatccgatctttatctttttgctcaaagaacgaataaaaccccttgttgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttaggttctttattatctccttcgaggggtttttaggatcattcaggctatatttagtctattttggcttttactgtctacttttctcagggagatggttaaggacctcagaagatagaggagagcgccaggcgcagatttccggaatacttctacggggaatgctcattcaatgagcattctccgtattatgccttgaagaggactcgaacctccacgctctttagcacgagattt

SEQ ID NO: 4060 - DNA, 3520 bp, Setaria italica
gttcttatgttatggtatgaatataccataccaattcgttatgtatggatgatggatgagattccatagatagagagccagttccaatagacttatggaacgttcccgttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatggcaaatattcggagatgactatgaaaacacctctctggatcctcgaattgaaagagagattgagagggatcaagaatcctaattctcgctatttggaatggatccaattctattgagtctgacccatagtgatcatttctctttagcaaagaatgaccttggttatcaaaggattgaacaaccgggatccatttacttatgatacctagttgacattgctaacaaggatctaatgaattatgagtttaatagatgctctttagcagaaagacgtatattccttgctcattatcagacaatcacttattcccaaacctcgtgtggggctaatcgttttcatttaccatcttatggaaaacccttttcgttccgcttagccctatcgggtattttagtgatgggttctataggaactggacgatcctatttggtcaaatacctaacgaaaaattcctattttcctttcattaaggtacgagggcttcttattccacaagaacgaaagcaccttttcattctttcatatactaggggtttttacttggaaaagacaatgttccatactaaaggattcgggtccataaccacgagttccagtgcactagatcttgtagcacttagcaacgaggccctatccattagtattccacataagaaatccattatagaaactaatacaattagattagctcttcatagacaaacttggggtttgcgagccaagataagaccggctcgggatcatgggacccttttctatcagataggagggggtcttgtacaaaatagacttctaagtaataaccccatagatcctatatctatctatataaacaggcaatcgtgtcaggaagcggctttttctttggccaaacggtacttcgaacttggaacgagcatgaagagattaacgagacttctttctcttttgagtttttctggcggaccggtcgcgcaagatctttggtcttcccccggaaccgatgaaaaatttgaaaaagggaacggaatggtcaaaccggaactgctagaggaacgaattttcaatagcataacttgggctcctagaatatggggcccttgggacaatctatttgattgcagggataggtacgctgaatatgactggggattttcctatgggtattggagcgggtccaagcagattaaagaggatgagttgtcagagactgctatttattcgaattatttctggtcttttcattctaatactctatccgagagttctcagtatttagcaaagctgttcctatctaacggaaggctcctggatcaaatgacaaagacattgtttgtggagaaagaggtggcttttcccggatgaaacatttgatttgtgtaacaggagaaagatttcccactccttagccgtaaagatatgtggccatgaaaaagggaggggattcagtggaacaggattggccgggcggtagagttgtggaaacacttgttgattcctattttggaccctagctccatggaacaatatgctactgcggaaacatggaagaattgcaatcttagatcaaaacactatgtatgggatgatatgaactgcctaaataagaattcttgagcgtcgaacaacctgagtactaactacatcaaacaatttgcattaatgaaactgtgtaaatccaccggataatcaaaaatacgcatgtctgatgaaatggttgttgctatctgcttccataacgaatccttggtttaactgaataagtaaagaaaatgggccctttctcttcttctcagatcgatggatcttctcgattggaagatctcccatatggataatacacattccagttgaccgagcctaatgctaattgttttgttccgaagcaaagatatccgcggaggccggttcgttcgtcctattctgatattcaggaccaagaggtcctggattctctttcggataggccccgaaaggagaagagaagctgaaatgccaacggacctctgtctattctctaattcacccgatccgatagtacccgtttttggaacgtccagtgccaaagtcactgaatgggtaagtcaccaatccaatccctttgacaaatcgggtgtcatattagatatcatattctatatatatagaaatatcatagaatagacatatagaatttttggttgggaaattcgaatgaatcattgagtgaaaaaggagcaaagaatgacaaaagatgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagttattacctttgcaattgcggttcgaatctatccgatctttatctttttgctcaaagaacgaataaaaccccttgttgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttaggttctttattatctccttcgaggggtttttaggatcgttcaggctatatttagtctattttggcttttactgtctacttttctcagggagatggttaaggacctcagaagatagaggagagcgccaggcgcagatttccggaatacttctacggggaatgctcattcaatgagcattctccatattatgccttgaagaggactcgaacctccacgctctttagcacgagattttgagtctcgcgtgtctaccatttcaccatcaaggcatcttgaaagtgaatcgtattccatgaatatgatatctatcgaatgtgatatatggaatatatgacaaaggtggagtcttggagtatttcgatcgatcggtcatataggcctgagtcagacatcaaatagcttcgatttgcattatccgtaggacaccttatatgtatcaaaatcgatatcaaaaagatgtacaatccaatttgtcgattcaatagaagcccaaagaggtgca

SEQ ID NO: 4061 - DNA, 753 bp, Oryza sativa
atgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcac

SEQ ID NO: 4062 - DNA, 842 bp, Oryza sativa
atgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgt

SEQ ID NO: 4063 - DNA, 842 bp, Oryza sativa
atgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggccgagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgt

SEQ ID NO: 4064 - DNA, 1310 bp, Oryza sativa
cattagatagatatcatattcatggaatatgattcactttcaagatgccttgatggtgaaatggtagacacgcgagactcaaaatctcgtgctaaagagcgtggaggttcgagtcctcttcaaggcataatacggagaatgcgcattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcgtcttttgtcattctttgctcctttttcactcaatgattcattcgaatttcccgaccaaaaattctatatgtctattcatagggcctcgttgctaagtgctacaagatctagtgcactggaactcgtggttatggacccgaatcctttagtatggaacattgtcttttccaagtaaaaacccccagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaacgattagccccatacgaggtttgggaataagtgatgagcaaggaatatacgtctttctgctaaagaggatctattaaactcataattcattagatc

SEQ ID NO: 4065 - DNA, 759 bp, Oryza sativa
aatctcgtgctaaagagcgtggaggttcgagtcctcttcaaggcataatacggagaatgcgcattcaatgagcattccccgtagaagtattccggaaatctcggcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcgtcttttgtcat

SEQ ID NO: 4066 - DNA, 6093 bp, Oryza sativa
aacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaataagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcgatttcgaaaaagaatggattcggtcttatacatacgcgaggaaggcaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcatttcaagatgccttgatggtgaaatggtagacacgcgagactcaaaatctcgtgctaaagagcgtggaggttcgagtcctcttcaaggcataatacggagaatgcgcattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcgtcttttgtcattctttgctcctttttcactcaatgattcattcgaatttcccgaccaaaaattctatatgtctattcatagg

SEQ ID NO: 4067 - DNA, 750 bp, Oryza sativa
atgacaaaagacgagactctactagtcttcactcttgtggtttcctcggtttctgttttcttattcgggatcttgcttttcatggttctcatctctgcaactcgcgattttcgcgagagaaccaaatctaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcatggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttag

SEQ ID NO: 4068 - DNA, 759 bp, Oryza sativa
aatctcgtgctaaagagcgtggaggttcgagtcctcttcaaggcataatacggagaatgcgcattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccatgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttagatttggttctctcgcgaaaatcgcgagttgcagagatgagaaccatgaaaagcaagatcccgaataagaaaacagaaaccgaggaaaccacaagagtgaagactagtagagtctcgtcttttgtcat

SEQ ID NO: 4069 - DNA, 1376 bp, Zea mays
cctaatgctaattgttttgttccgaagcaaagatatccgcggaggccggttcgttcgtcctattctgatattcaggaccaagaggtcctggattctctttcggataggcaggccctgaaaggagaagagaagctgaaatgccaacggacctctgtctattctctaattcacccgatccgatagtacccgtttttggaacgtccagtgccaaagtcactgaatgggtaagtcaccaatccaatccctttgacaaatcgggtgtcatattagatatcatattctatatatatagaaatatcatagaatagaatagacatatagaatttttggttgggaaattcgaatgaatcattgagtgaaaaaggagcaaagaatgacaaaagatgagactctactagtcttcactcttgtggtttcctcggtttctattttcttattcgggatcttgcttttcatggttctcatctctgcaactcgcgattttcgcgagagaaccaaatccaagttggtgaagatcatgatttgggctggcatagtagttattacctttgcaattgcggttcgaatctatccgatctttatctttttgctcaaagaacgaataaaaccccttgttgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaagggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttaggttctttattatctccttcgaggggttggtttttaggatcattcaggctatatttagtctattttggcttttactgtctacttttctcagggagatggttaaggacctcagaagatagaggagagcgccaggcgcagatttccggaatacttctacggggaatgctcattcaatgagcattctccgtattatgccttgaagaggactcgaacctccacgctctttagcacgagattttgagtctcgcgtgtctaccatttcaccatcaaggcatcttgaaagtgaatcgtattccatgaatatgatatctatcgaatgtgatatatggaatatatgacaaaggtggagtcttggagtatttcgatcgatcggtcatatacatataggcctgagtcagacatcaaatagcttcgatttgcattatccgtaggacaccttatatgtatcaaaatcgatatcaaaataaaaaaaaaaga

SEQ ID NO: 4070 - DNA, 1341 bp, Zea mays
atgctaattgttttgttccgaagcaaagatatccgcggaggccggttcgttcgtcctattctgatattcaggaccaagaggtcctggattctctttcggataggccctgaaaggagaagagaagctgaaatgccaacggacctctgtctattctctaattcacccgatccgatagtacccgtttttggaacgtccagtgccaaagtcactgaatgggtaagtcaccaatccaatccctttgacaaatcgggtgtcatattagatatcatattctatatatatagaaatatcatagaatagacatatagaatttttggttgggaaattcgaatgaatcattgagtgaaaaaggagcaaagaatgacaaaagatgagactctactagtcttcactcttgtggtttcctcggtttctattttcttattcgggatcttgcttttcatggttctcatctctgcaactcgcgattttcacgagagaaccaaatccaagttggtgaagatcatgatttgggctggcatagtagttattacctttgcaattgcggttcgaatctatccgatctttatctttttgctcaaagaacgaataaaaccccttgttgaagccctttatgataagcttccctggatctgggaagtttctctttcacggtattgggatcgtttgatcgatttccttgatcgctacttatgggcgtgcgctcaaaggatacaaacagggatcgcaaacaaaaaggggaattcgtagtcactttttcctgtcgcgtaaaaaaaaaggctttacgcgagagcaatagagattgggatacatctatctcttctgagcaacctctttggattcttaagaccacccttgcagtaggataccgtctgctttaggttctttattatctccttcgaggggtttttaggatcattcaggctatatttagtctattttggcttttactgtctacttttctcagggagatggttaaggacctcagaagatagaggagagcgccaggcgcagatttccggaatacttctacggggaatgctcattcaatgagcattctccgtattatgccttgaagaggactcgaacctccacgctctttagcacgagattttgagtctcgcgtgtctaccatttcaccatcaaggcatcttgaaagtgaatcgtattccatgaatatgatatctatcgaatgtgatatatggaatatatgacaaaggtggagtcttggagtatttcgatcgatcggtcatatacatataggcctgagtcagacatcaaatagcttcgatttgcattatccgtaggacaccttatatgtatcaaaatcgatatcaaaat

SEQ ID NO: 4071 - DNA, 6363 bp, Setaria italica
aacgaactaatatatagataatcgaaattgaaagaactgtcttttctgtatactttccccgttctattgctactgcgggtcttatgcaatcgatcggatcatatagatatcccttcaagacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatcgattcatacagaggaaaagttctctattgatgcaaacgctgtacctagaggatagggatagaggaagagggaaaaatcgaaatgaaataaataaagaataaagccaaaaaagaagtcgaagatagaagagcccagattcaaaatgaagaaatggaaactcgaaaaatgaagaaatggaaactcgaaaaggatccttctgattctcaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaataattgaacgaggagccgtatgagtgaaaatctcatgtacggttctgtagagggacagtaaggatgacttatctgtcgacttttccactatcaaccccaaaaaacccaactctgccttacgtaaagttgccagagtacgattaacctctggatttgaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaagatcttctttctaaagagattcgattcggaactcttatatgtccaaggtcaatatggaaattctttcagaggttttcccttactttgtccgtgtcaacaaacaattcgaaatacctcgactttttcagaacaggtccgagtcaaatagcatgattcgaagcacttctttttccattacactatttcggaacctaaggactcgatcgtatggatatggaaaatacaggatttccgatcctagcgggaaaaggagggaaacggatactcaatttaaagtgagtaaacagaattccatactcgatctcatagatccctatagaattctgtggaaagccgtattcgatgaaagtcgtatgtacggcttggagggagatctttcctatctttcgagatccaccctacaatatggggtcaaaaagccaaaaaataagtgattcgtttttagcccttataaaagaaaacggattcttgaacctctttcacgctcatgtcacgtcgaggtactgcagaaaaaagaaccgcaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccatataggagtaaaaacaagacgtaataaaaaaggatcgacgcggaaagttccgattgaaataggatctaaacaaggaagagcacttgccattcgttggttattagaagcatcccaaaagcgtccgggtcgaatatggctttcaaattaagttccgaattagtagatgctgccaaagggagtggggtgccatacgcaaaaaggaagcgactcatagaatggcagaggcaaatagagctctgcgcattttcgttaatccatgaacagaatctaggtatgtagacacatggatccatacatctcgatcggaaaagaatcaatagaaggagaatcggacgatatcttttcgaaacaaataaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaatcgaaacaatcgggacttttcggagattggctgcagttactaattcatgatctggcatgtacagaatgaaaacttcattctcgattctacgagaatttttatgaaagcgtttcatttgcttctcttcaatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctatacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctctggctatatggttcatctgggggggagatcgagcttcaagaaattgtgaatggtcttatcaatacacaaatgtataactccccaggaatttcaattgcgcttatattcatcactgtaggacttgggttcaagctttccccagccccttttcatcaatggactcctgacgtctacgaaggagtgtggttcgttcgacaaattcctacctctatatctatctctgagtgtttgggttttgcaaaactccatagacatgcagaagagaaatgctatccccactccgaccaagacaaacttttaccaaaagtttattgtgatctttttgttcaaataacaattaaggtgaagcagggtcaggaacaacgaatctctttatgataaacagatccatttgcaagctcgttattacgggtagttcctacaaagaatcggactaatgacgtatacatgcttgaattatcgatgtagatgctacatagtgggttctcatccttcagagactacgtgtaataggagcatccgttgacaaaaggatcacctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaatccatttcgaaaaagaatggattcggtcttatacatacgcgaggaaggtaatcaaaaaagaaagaagaccagttcttctttcttttatcacttagagccgtgcgagatgaaagtctcatgcacggttttgcatgagagaaagaagcgaggaatcctcttttcgactctgactccccactccagtcgttgcttttctttctgttacttcgaaagtagctgcttcagctttagccacgcgaattctcgatattcctttttatttctcatcaaacgaatggcatcttcttctggaaatcctagctattcttagcatgatattggggaatctccttgctattactcaacaagcatgaaacgtatgcttgcatattcgtccatagggcaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatcctttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcagataccctcttttagctgctaggtctatttcttagttcaagatccctcttactaactggaataaaagaattagtagatctgttccgcccaaaatgggaatgggtgctagggttatgaacttatatcatggaatcgactcgatcatcagattataagttcattccataccggaccagaccgtgcacattcttattatgagaaggggtcattcgagcctatggaaataggatactctgtttacatagaaatccctacgtccttacattctatttaggattaggaataggtgtaatcagacctgcttttgacatatctatcctatccttatttgggtaccatatgcacctcttgggcttctattgaatcgacaaattggattgtacatctttttgatatcgattttgatacatataagtgtcctacggataatgcaaatcgaagctatttgatgtctgactcagcctatatgaccgatcgatcgaaatactccaagactccacctttgtcatatattccatatatcacattcgatagatatcatattcatggaatacgattcactttcaagatgccttgatggtgaaatggtagacacgcgagactcaaaatctcgtgctaaagagcgtggaggttcgagtcctcttcaaggcataatatggagaatgctcattgaatgagcattccccgtagaagtattccggaaatctgcgcctggcgctctcctctatcttctgaggtccttaaccatctccctgagaaaagtagacagtaaaagccaaaatagactaaatatagcctgaacgatcctaaaaacccctcgaaggagataataaagaacctaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccaggaagcttatcataaagggcttcaacaaggggttttattcgttcttgagcaaaaagataaagatcggagattcgaaccgcaattgcaaaggtaataactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcatcttttgtcattctttgctcctttttcactcaatgattcattcgaatttcccaaccaaaaattctatatgtctattctatgatatttctatatatatagaatatgatatctaatatgacacccgatttgtcaaagggattggattggtgacttacccattcagtgactttggcactggacgttccaaaaacgggtactatcggatcgggtgaattagagaatagacagaggtccgttggcatttcagcttctcttctcctttcggggcctatccgaaagagaatccaggacctcttggtcctgaatatcagaataggacgaacgaaccggcctccgcggatatctttgcttcggaacaaaacaattagcat

SEQ ID NO: 4072 - DNA, 750 bp, Oryza sativa
atgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatggacgtgcgctcaaaggatacaaacagggattcgcaaacaaaaaggggaattcgtagtcactttttcctgtcgcgtaaaaaaaaggctttacgcgagagcaatagaggttgggatacatctatctcttatgagcaacctcttttggattcttaacaccacccttgcagtaggatactgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttag

SEQ ID NO: 4073 - DNA, 759 bp, Oryza sativa
aatctcgtgctaaagagcgtggaggttcgagtcctcttcaaggcataatacggagaatgcgcattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacagtatcctactgcaagggtggtgttaagaatccaaaagaggttgctcataagagatagatgtatcccaacctctattgctctcgcgtaaagccttttttttacgcgacaggaaaaagtgactacgaattcccctttttgtttgcgaatccctgtttgtatcctttgagcgcacgtccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcgtcttttgtcat

SEQ ID NO: 4074 - DNA, 842 bp, Brachypodium distachyon
aatgacaaaagacgagactctactagtcttcactcttgtggtttcctcggtttctgttttcttattcgggatcttgcttttcatgattctcatctctgcaactcgcgattttagcgagagaaccaaatccaagttggtgaagatcatgatttgggctggcatagtagttattacctttgcaattgcggttcgaatctatccgatctttatctttttgctcaaagaacgaataaaaccccttgtcgaagccctttatgataagcttccctggatctgggaagtttctctttcacggtattgggatcgtttgctcgatttccttgatttgatcgctacttatgggcgtgcgctcaaaggatacaaacagggattcgcaaacaaaaaggggaattcgtagtcactttttcctgtcgcgtaaaaaaaagtctttacgcgagagcaatagaggttgggatacatctatctcttctgagcaacctcttttggattcttaagaccacccttgcagtaggataccatccgctttgggttctttattatctccttcgagggatttttaggatcgttcaggctatatttagtctattttggcttttactgtctacttttttcagagagatggttaaggacctcagaagatagaggagagcgccaggcgcagatttccggaatacttctacggggaatgctcattgaatgagcattctccatattatgccttgaagaggactcgaacctccacgctcttcagcacgagattttgagtctcgcgtgtctaccatttcaccatcaaggcatcttgaaagtgaatcgtattccatgaatatgatatctatctaatg

SEQ ID NO: 4075 - DNA, 2352 bp, Brachypodium distachyon
ttcacaaccactgatgaaggattcctcgaaaagttaaggattagtagttctttttcgaaatcgatttcgaaaaagaatggatttggtcttatacatacgcgaggaaggtaatcaaaaaagaaagaagacgagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagtagctgcttcagcttcagccacgcgaattctcgatattcctttttatttctcatcaaacgaatggcatcttctggaaatcctagctattcttagcatgattttggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataataaagttattaatgactggacgaaaccaagaaataaccccttatgtgagaaattatagaagatcccctttaagatcaaacaattccatcgaattgagtatgactgtatgtgtgatagcatctactataccaggaatatcaatgaatcccattcttgcaattgctcaggataccctcttttagctgctaggtctatttcttagttcaagatccctcttactaactggaataaaagaattagtagatctgttccgccaaaaatgggaatgggcgctagggttatgaacttataatcatggaatcgactcgatcatcagattataagttcattccataccggactagaccgtgcacattcttattatgagaaggggtcattcgagcctatggaaataggatactctgtttacatagaaatccctacgtccttacattctatttaggattaggaataggtgtaagcagacctgcttttgacatatctatcctatttttatttgggtaccatatgcacctctttgggcttctattgaatcgagaaattggattgtacatctttcatctttttgattttgatatcgattttgatacatataaggtgtcctacggataatgcaaatcgaagctatttgatgtctgactcaggcctatatgaccgatcgatcgaaatactccaagactccacctttgtcatatattccatatatcgcattagatagatatcatattcatggaatacgattcactttcaagatgccttgatggtgaaatggtagacacgcgagactcaaaatctcgtgctgaagagcgtggaggttcgagtcctcttcaaggcataatatggagaatgctcattcaatgagcattccccgtagaagtattccggaaatctgcgcctggcgctctcctctatcttctgaggtccttaaccatctctctgaaaaaagtagacagtaaaagccaaaatagactaaatatagcctgaacgatcctaaaaatccctcgaaggagataataaagaacccaaagcggatggtatcctactgcaagggtggtcttaagaatccaaaagaggttgctcagaagagatagatgtatcccaacctctattgctctcgcgtaaagacttttttttacgcgacaggaaaaagtgactacgaattcccctttttgtttgcgaatccctgtttgtatcctttgagcgcacgcccataagtagcgatcaaatcaaggaaatcgagcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaataactactatgccagcccaaatcatgatcttcaccaacttggatttggttctctcgctaaaatcgcgagttgcagagatgagaatcatgaaaagcaagatcccgaataagaaaacagaaaccgaggaaaccacaagagtgaagactagtagagtctcgtcttttgtcat

SEQ ID NO: 4076 - DNA, 4983 bp, Brachypodium distachyon
atttcttagttcaagatccctcttactaactggaataaaagaattagtagatctgttccgccaaaaatgggaatgggcgctagggttatgaacttataatcatggaatcgactcgatcatcagattataagttcattccataccggactagaccgtgcacattcttattatgagaaggggtcattcgagcctatggaaataggatactctgtttacatagaaatccctacgtccttacattctatttaggattaggaataggtgtaagcagacctgcttttgacatatctatcctatttttatttgggtaccatatgcacctctttgggcttctattgaatcgagaaattggattgtacatctttcatctttttgattttgatatcgattttgatacatataaggtgtcctacggataatgcaaatcgaagctatttgatgtctgactcaggcctatatgaccgatcgatcgaaatactccaagactccacctttgtcatatattccatatatcgcattagatagatatcatattcatggaatacgattcactttcaagatgccttgatggtgaaatggtagacacgcgagactcaaaatctcgtgctgaagagcgtggaggttcgagtcctcttcaaggcataatatggagaatgctcattcaatgagcattccccgtagaagtattccggaaatctgcgcctggcgctctcctctatcttctgaggtccttaaccatctctctgaaaaaagtagacagtaaaagccaaaatagactaaatatagcctgaacgatcctaaaaatccctcgaaggagataataaagaacccaaagcggatggtatcctactgcaagggtggtcttaagaatccaaaagaggttgctcagaagagatagatgtatcccaacctctattgctctcgcgtaaagacttttttttacgcgacaggaaaaagtgactacgaattcccctttttgtttgcgaatccctgtttgtatcctttgagcgcacgcccataagtagcgatcaaatcaaggaaatcgagcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaataactactatgccagcccaaatcatgatcttcaccaacttggatttggttctctcgctaaaatcgcgagttgcagagatgagaatcatgaaaagcaagatcccgaataagaaaacagaaaccgaggaaaccacaagagtgaagactagtagagtctcgtcttttgtcattctttgctcctttttcactcaatgattctttctaatttccagaccaaaaattctatatgtctattctatgatatttctatatatatagaatatgatatctaatatgacacccgatttgtcaaaggggttggattggtgacttacccattcagtgactttggcactggacgttccaaaaacgggtactatcggctcgggtgaattagagaatagacagaggtccgttggcatttcagcctttcttctcctttcagggcctatccgaaagagaatccagtacctcttggtcctgaatatcagaataggacgaacgaactggcctccgcggatatctttgcttcggaacaaaaccctgcaatcaaatggattgtcccaagggcgccatattctaggagcccaagttatgctattgaaaattcgttcctctagcagttccggtttgaccattccgttccctttttcaaactccacttcttttcatatagcaatccctgatcaaagagagaacaatatccatttcaaaacatttctaacggattccttggttcggaccgacgaagtaatggcactcgattattatcaacctgactgcaatctttttctgtcggtaaggattgcaccagagcaccttctacttctaataggccatgaactatagatagagaagaatcattctgagcgagtccataagaagcgatccactttttttcatcggttccaggggaagaccaaagatcttgcgcggcaggtccgccataaaaacgcaaaagagaaagaagtctcgttaatctcttcatgctcgttccaagttcgaagtaccttttggccaaagaaaaacccgcttcctgacacgatcgcctctttatatagatagattgattctatggggttattacttataagtctattttgtacaagagcccctcctatctgatagaaaaaggtcccatgatcccgagccgatcttaccttggctcgcaaaccacaagtttgtctatgaagagttaatctaattgtatttttttctataatggatttcttatgtggaatactaatggatagggcctcgttgctaagtgctacaagatctagtgcactggaactcgtggttatgcacccgaatcttttagtatggaacattgtcttttctaagtaaaaacccctagtatatgaaagaatgaaaaggtgctttcgttcttgtggaataagaagccctcgtaccttaatgaaaggaaaatcgtaatttttcgttaggtatttgaccaaataggatcgtccagttcttatagaacctatcactaaaatacccgatagggctaagcggaacgaaaagggttttccatgagatggtaaatgaaaacgattagccccacacgaggtttgggaataagtgattgtctgataatgagcaaggaatatacgtctttctgctaaagaggatctattaaactcataattcattagatccttgttatcaatgccaactaggtatcataagtaaatggatcccggttgttcaatcctttgataaccaaggtcattctttgctaaagagaaatgatcactatgagtcagactcaatagaattggatccattccaaatagagagaattaggattcttgatccctctcaatctctctttcaattcgaggatccagagaggtgttttcatagtcatctccgaatatttgccatctccgaatattttcgatttcatttttctatgatatgtctttctatatgaaaattggttatttacgatgtaggatgatccctgttaagcatccatggctgaatggttaaagcgcccaactcataattggtaaatttgcgggttcaattcctgctggatgcacgcgaacgggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcaggattcactaagacagaaataaagcattgggtcgaactcttctttggtgttaaggtagtagctgtgaatagccatcgactacccggaaagggtagaagaataggacctattctgggacatacaatgcattacagacgtatgatcattacccttcaaccgggttattctattccacttctagatagagaaaaaaactaaaggagaatacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcattttttgcatttgcaataatgcgatgggcgaacgacgggaattgaacccgcgcatggtggattcacaatccactgccttgatccacttggctacatccgccccttatccagctacaggatttttctcttttttccattcatcattattctatttattctgacctccatacttcgatcgagatattggacatagattgccgctctttaaaaaggaaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccacaatggttggccatacaatcgcgattcataatggaaaggaacatatacctatttacataacaaatcctatggtaggtcgcaaattggg

SEQ ID NO: 4077 - DNA, 525 bp, Brachypodium distachyon
aatgacaaaagacgagactctactagtcttcactcttgtggtttcctcggtttctgttttcttattcgggatcttgcttttcatgattctcatctctgcaactcgcgattttagcgagagaaccaaatccaagttggtgaagatcatgatttgggctggcatagtagttattacctttgcaattgcggttcgaatctatccgatctttatctttttgctcaaagaacgaataaaaccccttgtcgaagccctttatgataagcttccctggatctgggaagtttctctttcacggtattgggatcgtttgctcgatttccttgatttgatcgctacttatgggcgtgcgctcaaaggatacaaatagggattcacaaacaaaaaggggaattcgtagtcactttttcttgtcgcgtaaaaaaaagtctttacgcgagagcaatagaggttgggatacatctatctcttctgagcaacctcttttggattcttaagaccacccttgcagtaggataccatccgctt

SEQ ID NO: 4078 - DNA, 4313 bp, Brachypodium distachyon
aaatagagctcttgcacattttcgttaatccatgaacagaatctaggtatgtagacacatggatccatacatctcgatcggaaaacagtagtttagaaggagaatcggacgatatctttctcgaaacaaacaaaaaggaaaagaaagagaaaacaaaaatcatgatcaactaagccctctcgagggcttgcttaagaataagaaagaagaatcttatggaaatggaataaggtttgatcctattcatggggattctgtaaatatgccattccaaaaatagaaacaatcaggacttttgggagattggatgcagttactaattcatgatctggcatgtacagaatgaaaacttcattctcgattctacgagaatttttatgaaagcgcttcatttgcttctcttccatggaagtttcattttcccagaatgtatcctaatttttggcctaattcttcttctgatgatcaattcaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttctcattttattatgttcaactttatgtattcctctatccgtagagtacattgaatgtacagaaatggctataacagagtttctgttattcgtattaacagctactctagggggaatgtttttattcggtgctaacgatttaataactatctttgtagcttcagaatgtttcagtttatgttcctacctattgtctggatataccaagagagatctacggtctaatgaggctactatgaaatatttactcatgggtggggcaagcttttctattctggttcatggtttctcttggctatatggttcatctggggggggagatcgagcttcaagaaattgtgaacggtcttatcaatacacaaatgtataactccctaggaatttcaattgcgcttatatccatcactgtaggacttgggttcaagctttccccagccccttttcatcaatggactcctgacatctaagaaggagtgtggttcgttcgacaaattcattcctacctctatatctatctccgaggtgtttgggttttgcaaaactccatagacatgcagaagagaaatgctatccccactccgaccaagacagaacttttaccaaaagtttattgtgatctttttgttcaaataacaattaaggtgaagcagggttaggaacaacgaatctctttatgataaacagatccattttgcaagttcgttattacgggtagttcctacaaagaatcggactaatgacgtatacaatgcttgagttatcgatgtagatgctacatagtgggttctcatccttcaaagactacgagtgtaataggagcatccgttgacaaaaggatcgccctaagatgatcatctcatggctattgggaacaaatcaaatcggatggttctatttctcaacctttctgacttgctcctacggaaccaaggtcgaaaggattgaaaaagtcagtcattcacaaccactgatgaaggattcctcaaaaagttaaggattagtagttctttttcgaaatcgatttcgaaaaagcatggatttggtcttatacatacgtgaggaaggtaatcaaacaagaaagaagacgagttcttcttccttttatcacttagaagccgtgcgagatgaaagtctcatgcacggttttgcatgagagaaagaagcgaggaatcctctttccgactctgactcccccactccagtcgttgcttttctttctgttacttcgaaagtagctgcttcagcttcagccacgcgaattctcgatattcctttttatttctcatcaaacgaatggcatcttcttctggaaatcctagctattcttagcatgattttggggaatctccttgctattactcaaacaagcatgaaacatatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctccgtaccagaactgataacattcgagattatgcaggattatacacgaaagatccttttttggctctctctttagccctatgtctcttatccctaggagccttcctccactagcaggtttcttcagaaaactctatctattctggtgtggatggcaagcaggcctatatttcttggtttcaataggactccttacgagcgttctttctatctactattatctaaaaataataaagttattaatgactagacgaaaccaagaaataaccccttatgtgagaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgccaaaaatgggaatgggcgctagggttatgaacttataatcatggaatcgacttgatcatcagattataagttcattccataccggactagaccgtgcacattcttattatgagaagggggattcgagcctatggaaataggatactctatttacatagaaatccctacgtccttacattctatttaggattaggaataggtgtaagcagacctgcttttgacatatctatcctatttttatttgggtaccatatgcacctctttgggcttctattgaatcgagaaattggattgtacatctttcatctttttgattttgatatcgattttgatacatataaggtgtcctacggataatgcaaatcgaagctatttgatgtctgactcaggcctatatgaccgatcgatcgaaatactccaagactccacctttgtcatatattccatatatcgcattagatagatatcatattcatggaatacgattcactttcaagatgccttgatggtgaaatggtagacacgcgagactcaaaatctcgtgctgaagagcgtggaggttcgagtcctcttcaaggcataatatggagaatgctcattcaatgagcattccccgtagaagtattccggaaatctgcgcctggcgctctcctctatcttctgaggtccttaaccatctctctgaaaaaagtagacagtaaaagccaaaatagactaaatatagcctgaacgatcctaaaaatccctcgaaggagataataaagaacccaaagcggatggtatcctactgcaagggtggtcttaagaatccaaaagaggttgctcagaagagatagatgtatcccaacctctattgctctcgcgtaaagacttttttttacgcgacaagaaaaagtgactacgaattcccctttttgtttgtgaatccctatttgtatcctttgagcgcacgcccataagtagcgatcaaatcaaggaaatcgagcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaataactactatgccagcccaaatcatgatcttcaccaacttggatttggttctctcgctaaaatcgcgagttgcagagatgagaatcatgaaaagcaagatcccgaataagaaaacagaaaccgaggaaaccacaagagtgaagactagtagagtctcgtcttttgtcattctttgctcctttttcactcaatgattctttctaatttccagaccaaaaattctatatgtctattctatgatatttctatatatatagaatatgatatctaatatgacacccgatttgtcaaaggggttggattggtgacttacccattcagtgactttggcactggacgttccaaaaacgggtactatcggctcgggtgaattagagaatagacagaggtccgttggcatttcagcctttcttctcctttcagggcctatccgaaagagaatccagtacctcttggtcctgaatatcagaataggacgaccgaactggcctccgcggatatctttgcttcggaacaaaaccctgcaatcaaatggattgtccca

SEQ ID NO: 4079 - DNA, 2417 bp, Zea mays
acagcaaccgccgtcgccctcccccgccaaaatcgcaacaagaatgtccacaagccacagccttgtcttgtcttctgtatctacatcctctcgcaattccccatcgtcttctacccttctgtcctccgatccccaccctccggttaactcctcaccaagaaaaaggaaccggccgtcctcgttcctgtcgtcgctgttctttcctcgccattaccggcgtataaaaccagccctcggcctgatcgcacagcatccggccaagcgggactagtccctgtcgtctgtccaccaccctctgcgagtacgtctcctcctcccgtctgtctctctctgtgtgtcggtctgccgttcccgccgccgccgccgcagatgggcctgttcagctcgccggccaaggtgtacaagccggccgccgacgtggacctcggcccaggcagcgacgagctctacatcagccccaatgtcaaagctcctcgggtcgccgggctcctggtgaagatcttcgtgtggatcctggagatgcccatcgtcgggcagatcgtgctctacatcctgaagaaggacaacctcatcaacaagctggtgtccgacgccgacatcccggagccgccgctgttcacggcatcgcacagctgggaagacaccccggagcagagcgtgcggctgaccaagcccgacctgtcggcggcggagcgggtccaggaggccgtgggctgcctcccggcgcggctggaggccgcgctggccgccgacgcgcgcggcatcaggcgctggaccgtccgcgacttctccgacgcgtacaggtccggcgaggtgacgcctgtccaggtggcggcgaggttcctcgcggcggtgagggagagctcgggccctggcgtgagcaatatggccttcttcatcagctgcgaccccgacgacgtcatgaggcaggccgaggaatccaccctcaggtaccagagaggggcgccgctgtccgcgctggacggcgtgctggtgggcgtgaaggacgagatcgactgcctgccgtacccgaccacgggcgggacgcggtggctgggcgcggcgcggcgctgcgaggccgacgccgcgtgcgtcgcgcagctgcgcgcctgcggggccgtcctcgccggcaaggccaacatgcacgagctcggcgccggcaccagcggcatcaacccgcaccatgggtcgacgaggaacccgtacaacgccagcacgatcgccgggggctcctccagcggctccgccgccatcgtgtgcgccggcctctgccccgtcgcgctcggcgtcgacggaggcggctccgtccggatgccggcggcgctgtgcggcgtcgtcgggttcaagcccaccgccgggcgcctctccaacgccggcgtcctcccgctcaactggacggtcgggatgccggggatcctggcggggacggtcgaggacgcgctcatcgcctactcggcgatcgtcgaccagtcccagccgtcctacttgcggccggaactgaatcttcctcagctcggctccacactctccatcggcaacatcaagctcgccagatacggaaagtggttcaatgacagcgccgaggacatcaggagctgctgcgacaaggcgctgcaggcgctgcgcgcgaactacggctggcagaccgtggacgtgaccatcccggaggtggaggagatgcggctggcgcactacgtcaccatcggctccgagtgcacgacgtcgctcgccaagtacctcgacaagctcaagaggtccgagatcggctgggacgcgagggtggcgctcagcgtctacggctccttcagcagcagggcgtacctgaacgcgcagcggctccggaaccgccagatgtacttccacaagcagatcttcaaggccgcggacgtcatcgtctcgccgatgaccggtgtgactgcgtacccgctgcaagacgacgcgctcagcaccggggagctcgactacataaacggagccgcgctggtccggtactccatagccggcaacttcctcggcctgccggccatcaccgtcacggtcggctacgacaggggcggcctccccatcggcctccagttcatcggcaggccgtgggccgaggccaccctcctccacgtggccttcgccacgcagcaggcgtgcgccaaggggtacaagaagccgccggtgttctacgacctcctcggcaagcaacaggactgaggtcagcgacgcgccgccgccgccggcggcgagcgagcgaggatccaccgtatatgtatccgtgggggtcgatcggaggagaagagacgtatagcagcaggacaattgttgtcatgtataccttcattctcgaatcattatcgagtatttgtcgttgactactagttcattcttgaactaaaacacggtaaataaaaaataattgaggtcgttca

SEQ ID NO: 4080 - DNA, 2303 bp, Panicum virgatum
atccttttgtcctctgtcctccgattaactctgaaccaagaaatcaatcaccttcaactcgtccttgttctggtcgtcgctcttcttcttcttcttcgccgttaccggcgtataaaagcaacaaccctcggcctattcacacaacagctggcgacaagcagtagtcccttcccacgctttgagagtgccctgctagctgtggctgtctgcctgccgctctcatcgtcgccgtcctccatgggcctcttcagctcgccagcgaaggtctacaagccggccgccgacgtcgacctcggccccggcagcgacgagttctacatcagccccaatgtcaaagctcctcgagttgctgggctcctggtgaagatcttcgtgtggatcctggagatgccgatcgtcgggcagattgtactctacatcctgaagaaggacaatctcatcaacaagctggtatctgacgccgacatcccggagccgccgttgttcacggcaacccacaactgggaagacattcctgagcagaacgtggtgctgaccaagcccgacctgtcggcggccgagcgggtccaggaggccgtcggctgcctcccggcgcggctggaagccacgctcgccgccgacgcgccgttgtcgggtctgaagcggtggacgatccgggacttctacgacgcgtacagctcgggggagacgacacctgttcaggtggcgacgaggttcctggcggcggtgaaggagagctcggggcctggcctgaacatggccttcttcatcagctgcgaccccgaggacgtgatgaggcaggccgaggagtccaccctgagataccagagaggtgcgccgctgtcggcgcttgacggcgtgctggtggcggtaaaggacgagatcgactgcgcgccgtacccgacgacgggcgggacgcggtggctggccgcggcgcgccggtgcgaggcggacgccgcgtgcgtggcgcagctgcgggcctgcggcgccgtcctcgccggcaaggccaacatgcacgagctcggcgccggcaccagcggcatcaacccgcaccacgggtccgcgaggaacccgtacaacgccggcaagatcgccggcggttcctccagcggctcggccgccgtcgtctgcgccggcctctgccccgtcgccctcggcgtcgacggaggcggttccgtccggatgccggcggcgctgtgcggcgtcgtggggttcaagcccaccgccggccgcctctccagcgccggggtgcttccgctcaactggacggtcgggatgccggggatcttggcggggacggtcgaggacgccctcgtcgcatactcggcgatcgtcgatcagtcccagccgtcctacttgcggcctgaactgaatctgcctcagctcaagtccagcatgtccatcaacaacatcaaacttgcaaaatatgcaaagtggttcaacgacagtgccgaggacatcaggagctgctgcgacaaggctctcaagacgctgcaagcgcactacggctggcagaccgtggacgtgaccattcctgagatcgaggagatgcggctggcgcactacgtcaccatcggctccgagtgcacgacgtcgctcgccaaatacctcgacaagctgaagaggtctgagatcggctgggacgccagggtcgcgctgagcgtctacggttccttcagcagcagagcctacctgaactcgcaaagaattcggaaccggcagatgtacttccacaaggagatcttcaagaccgccgacgtgatcgtctcgccgatgaccggtgtgaccgcctacacgctgcaagacgacgcgttcgacaccggggaactggactacataaacggagccgcgctggtccgctactccatcgcagggaacttcctgggcctgccggccatcaccgtcaaggtcgggtacgacaagggcgggctccccatcgggctccagttcatcggccggccgtggtccgaggcgaccctgctccacatcgcgttcgcgatgcaggaggcctgcgccaagggctacaagaagccggcggtgttctacgatctcctcaagaaagagtgacagcgaccgacgagcgcggaggggatctccagctccgtccgttgccatttttcatgtttcttccatctgttgccattttgcgggtattctggggaaacagaggcgatcagcagctgccatcatgcgatggtatttcactgcttctttgtttgtctcgtcatcagaaaaaaaaaagtggcggatgaggctgcatgtggaggcctctgacgtcgccaccaatcgtgttgttctagttc

SEQ ID NO: 4081 - DNA, 2842 bp, Setaria italica
ctcgtccttgttcttgtcgtcgctttcttcttcttcttcttcttcgccgttaccggcgtataaaagcaacagtcctcggcctaatcacacaacagctggccacaagcagtagccccctatccacgctccgagagtacccggctgtggctgtctgtctgccgcctcgtcgtcgtcgtccatgggcctcttcagctcgccggcgaaggtctacaagccggccgccgacgtcgacctcggccccggcagcgacgagttctacatcagccccaatgtcaaagctcctcgggtcgccgggctcctggtgaagatcttcgtgtggatcctggagatgccgatcgtcggacagattgtgctctacatcctgaagaaagacaacctcatcaacaagctggtctctgacgccgacatcccggagccgccgctgttcactgcaacccacagctgggaagacatcccagagcagaacgtgaggctgatcaagcccgacctgtcggcggcggagcgggtccaggaggccgccggctgcctccccgcgcggctggaagccacgctcgccgccggcgcggcgtcgtcggggctgaagcggtggacgatccgggacttcgccgacgcgtacagctcaggggagacgacgcccgtgcaggtggcgacgaggttcctggcggcggtgaaggagagctcggggcctgacctgaacatggccttcttcatcagctgcgaccccgaggacgtgatgaggcaggcggaggagtccactcgcagataccagagaggtgcggcgctgtcagcgctggacggcgttctggttgcggtgaaggacgagatggactgcgtgccgtacccgacgacgggcgggacgcggtggctggccgcggcgcggcggtgcgaggcggacgccgcctgcgtggcgcagctgcgggcctgcggcgccgtcctcgccggcaaggccaacatgcacgagctcggcgccggaaccagcggcatcaacccgcagcacgggtccgcgaggaacccgtacaactccaacaagatcgccggcggctcctccagcggctcggccgccgtcgtctccgccggcctctgccccgtcgccctcggcgtcgacggaggcggttccgtccggatgccggcggcgctgtgcggcatcgttggcttcaagcccaccgccggccgcctctccaacgccggggtgcttccgctgaactggacggtggggatgccggggatcttggcggggacggtggaggacgccctcatcgcgtactcggcgatcgtcgaccaatcccagccgtcctacttgcggcctgagctgaatctgcctcagctcaagtccacactgtccatgagcaacatcaaactagccaagtacgcaaagtggttcaacgacagcgccgaggacataaggagctgctgcgacaaggctctcaagacgctgcaagcgcactacggctggcagaccgtggatgtgaccattcctgagatcgaggagatgcggctggcgcactacgtcaccatcggctccgagtgcaccacgtcgctcgccaagtacctcgacaagctgaagaggtctgaaatcggctgggacgcaagggtcgcgctgagcgtgtacggttccttcagcagcagagcgtacctcaactcgcaacggcttcggaaccggcagatgtacttccacaaggagatcttcaagaccgccgacgtgatagtctcgccgatgaccggtgtgaccgcctacactctgcaagacgacgcgttcaacaccggggaactggactacataaacggagccgcgcttgttcggtactccatcgccgggaacttcctcggcctgccggccatcaccgtcatggttgggcatgacaagggcgggctccccatcgggctccagttcatcggccggccctggtccgaggcgacgctgctccacatcgccttcgccatgcaggaggcgtgcgcaaagggccacaagaagccggcggtgttctacgatctcctcaagaaagagtagtgtgatcccagacgagcgcagaagagatcacgcatcagctctgtccgttttgatatcaggtgacatgccttgagttggtaatgggtggcagaaccatgcgtccaagtgaaggattggaatagcaaatttgatcttgtctagagtacagggtcttcagttcagagaaagaaagcagttctttctttctgagagcacaatggttcaagttcagtgtagcggtgaatcaagcagttccatcttattcttatgaatgtcactgtaggcggtgtatgcgaaatgaaatcttccaagatgtttctgtgtaccgagtctatctcgtgcaagagcacgttgatgatgttttttcatctgttgcgttgcatttcccgagtctgaacagaggagatcaggaaatgcgaatgcctgctgcatcttggtttgtcttcttctcagacaaaaaaaatgaaaaatggatgggatcatgggaatgcactctgacgtgcgggccccgcgggggcgtcgccgccaatcatgttgctgtctcagcgccttgaacgcgcggtacacgtgggcgcaggcggcgagccacagacgtggcgaccagcacctccaactattattccgcgggtggacgcggcactacccctccgtccatgtgttggcgcctcggcacaaaggtcctcgagagggcataatggtcagcgcctagaagaccagcgcatcgacgcgacacgccacgtcgccacggctgagatatcaaggggtacggttttgtaacagacgcattggatttggaccggacaaacgaatgactgagcattagtgtgataaagtctaatttccacaaacgttgta

SEQ ID NO: 4082 - DNA, 2202 bp, Setaria italica
cccggcagcgacgagttctacatcagccccaatgtcaaagctcctcgggtcgccgggctcctggtgaagatcttcgtgtggatcctggagatgccgatcgtcggacagattgtgctctacatcctgaagaaagacaacctcatcaacaagctggtctctgacgccgacatcccggagccgccgctgttcactgcaacccacagctgggaagacatcccagagcagaacgtgaggctgatcaagcccgacctgtcggcggcggagcgggtccaggaggccgccggctgcctccccgcgcggctggaagccacgctcgccgccggcgcggcgtcgtcggggctgaagcggtggacgatccgggacttcgccgacgcgtacagctcaggggagacgacgcccgtgcaggtggcgacgaggttcctggcggcggtgaaggagagctcggggcctgacctgaacatggccttcttcatcagctgcgaccccgaggacgtgatgaggcaggcggaggagtccactcgcagataccagagaggtgcggcgctgtcagcgctggacggcgttctggttgcggtgaaggacgagatggactgcgtgccgtacccgacgacgggcgggacgcggtggctggccgcggcgcggcggtgcgaggcggacgccgcctgcgtggcgcagctgcgggcctgcggcgccgtcctcgccggcaaggccaacatgcacgagctcggcgccggaaccagcggcatcaacccgcagcacgggtccgcgaggaacccgtacaactccaacaagatcgccggcggctcctccagcggctcggccgccgtcgtctccgccggcctctgccccgtcgccctcggcgtcgacggaggcggttccgtccggatgccggcggcgctgtgcggcatcgttggcttcaagcccaccgccggccgcctctccaacgccggggtgcttccgctgaactggacggtggggatgccggggatcttggcggggacggtggaggacgccctcctcgcgtactcggcgatcgtcgaccaatcccagccgtcctacttgcggcctgagctgaatctgcctcagctcaagtccacactgtccatgagcaacatcaaactagccaagtacgcaaagtggttcaacgacagcgccgaggacataaggagctgctgcgacaaggctctcaagacgctgcaagcgcactacggctggcagaccgtggatgtgaccattcctgagatcgaggagatgcggctggcgcactacgtcaccatcggctccgagtgcaccacgtcgctcgccaagtacctcgacaagctgaagaggtctgaaatcggctgggacgcaagggtcgcgctgagcgtgtacggttccttcagcagcagagcgtacctcaactcgcaacggcttcggaaccggcagatgtacttccacaaggagatattcaagaccgccgacgtgatagtctcgccgatgaccggtgtgaccgcctacactctgcaagacgacgcgttcaacaccggggaactggactacataaacggagccgcgcttgtccggtactccatcgccgggaacttcctcggcctgccggccatcaccgtcatggttgggcatgacaagggcgggctccccatcgggctccagttcatcggccggccctggtccgaggcgacgctgctccacatcgccttcgccatgcaggaggcgtgcgcaaagggccacaagaagccggcggtgttctacgatctcctcaagaaagagtagtgtgatcccagacgagcgcagaagagatcacgcatcagctctgtccgttttgatatcaggtgacatgccttgagttggtcatgagtggcagaaccatgcgtccaagtgaaggattggaatagcaaatttgatcttgtctagagtacagggtcttcagtccagagaaagaaagcagttctttctttctgagagcacaatggctcaagttcagtgtagcggtgaatcaagcagttccatcttattcttatgaatgtcactgtaggcggtgtatgcgaaatgaaatcttccaagacgtttctgtgtaccgagtctatctcgtgcaagagcatgttggtgatgttttttcatctgttgcattgcatttcccgagtctgaacagaggagatcagcaaatgcgaatgcctgctgcatcttggtttgtcttcttctcag

SEQ ID NO: 4083 - DNA, 2206 bp, Avena sativa
agttcttgttgttcttgttcatacagcgcagaagcgtcctcttgttcttgccagaatcgttgtcgtccatgggtgtcttcagctcgtcggcgaaggtgtaccagccggcggcggaggtcgacctcggtcccagcagcggcgagctctacatcagccccaatgtcaaagctcctcgggtcgccgggcttctggtgaagatcttcgtgtgggtcctcgagctgccgatcgtcggatgggtcttgctttacatcctgaagaaggataatctcatcaacaagcttgtctccgaggctgagatccctgagcctccactgttcactgcaacccacagctgggaagacaccccagagcagaatgtcagcctgacgaagccggatctgtcgcctgctgagcgcgtccaggaggccgtaagctgcctccccgcgcgcctagagtcgacgctcaccggcgacggcctgaaacgctggacgatcagggacttctccaaggcttacagctcaggagagaccacacctgttcaggtggccaagaggttcctggctgcagtgaaggagtcctcaggtcctaccctgaacatggccttcttcatcaactgcgaccctggggacgtcatgaagcaggctgaagaatccaccctcagatacgagagaggggcaccgctgtctgcgctggacggcgtgctggtgggagtgaaagacgagatcgactgcttgccgtaccccaccacaggcgggacgcggtggctgggcaaggctaggccgtgcgacgccgacgcggcgtgcgtggcgcagctgcgcgcgtgcggcgccgtcctcgccggcaagaccaacatgcacgagctcggcgccggaaccagcggcatcaacccccactacgggtcggcgaggaacccctacaacgtcggcaaggtcgccggaggctcatccagcggctcggccgccgtggtctgcgcggggctctgcccagtcgcgctcggcgtcgacggaggaggttccgtccggatgccagcggcgttgtgcggcgtggtcggcttcaagcccaccgccgggcgtctctccggcgcaggggtcctaccattgaattggacggtcgggatggcggggatcttggcagggacggtggaggatgcagccatcgcttactcagctatcgttgatcagtcccaaccatcttacctgaggcctgagctgaatttgcctttgctgacgtcgacaccctcaattagcaacgtcaagctagcaaaatctgcaaagtggtttaacgacagttcagacgacatcagaacctgctgtgacaaagctctacagaccctgtacacacactacggttgggagactgtggatgtgacggtcccagagatcgaggagatgcggctagcgcactacgtgacgatcggttcggaatgcactgcttccctatccaagtatctggacaaactgaagaggtccgagatcgggtgggacgtgagagtcgcgctgggcgtctacggttcattcagcagcagagcctacctgaactcgcaacgactccggaaccgtcagatgttcttccacaaagagatcttcaagacagcagatgtcatcgtctcaccaatgaccggtgtgactgcccctgcactgcaagatgacgcgcgaaacaccggtgaacttgactacataaatggcgctgcgttgatacggtactcgatagcagggaacttcctcggtttgccggcaataactgtcatggttgggcaggataaggccgggctacccatcggtcttcagttcatcggcaggccgtggtctgaggccactctgctccacatcgcattcgcaatgcaggaatcctgcagcaagaaccacagaaagcctgcggtgttctatgatctcctcaagaaagagtgagagagtgaccgggagaaaggaatgtgcagatgacgaagagaattactataccgttgatgtgaaggagatgcagcagattcttgcagcaactgaagtctgaatagtaattctcttccgcgagtgttaattctataccttgagtttgaccacctgtagcgttcttccgtgtgttaacgtacatggtctgattgaaatgaaatgaagcaaaatagctcgagttcagtagcagttaggctcaggaaattcagttcgatgtgagaagtcattgcgaaatgatgtgtgcaactttgtgaaaaaaaaaattatagtgtgaaatttcg

SEQ ID NO: 4084 - DNA, 2182 bp, Secale cereale
ttcagacacccatcttgtcgttcgttctgagtttttccagccacagccagaccgtccatgggcgtcttcggctcctcggccaaggtctaccggccggcgccggaggtcgacctcggccccggcagcggcgagctctacatcagccccaatgtcaaagctccgcgggtcgccggccttctggtgaagatcttcgtgtgggtcctggagatgccggtggtgggctgggtcctgctctacatcctcaagaaggacaatctcatcaacaagcttgtctcggaagcagagatccctgagccgccactgttcacctcaacccaccgctgggaagacaccccggagcagaacgtcagcctgaccaagcccggcctgtcgccggcggagcgcgtccgggaggccgtcgactgcctccccgcgcgcctcgagtcgacgctcgccgccgacgccccgccgtcgtccagcctgaaacgctggacgatcatggacttctccagggcctacagctccggagagaccacgcctgtccaggtggccaagaggttcctggccgcagtgaaggagtgctcaggccctaccatgaacatggccttcttcatcagctgcaaccctgaggacgtcttgaagcaggcccaagaatccaccctcagataccagacagggacacctctgtcagtgatggacggcgtgctggtggcggtgaaagacgagatcgactgcttgccctaccccacgacaggcgggacgcggtggctggggaaggcgcggccgtgcgaggcggacgcggcgtgcgtggcgcagctgcgcgcgtgcggcgccgtcctcgccggcaagaccaacatgcacgagctgggcgccggcaccagcggcatcaacccacaccacggatcggcgaggaacccgtacaacgtcggcaaggtggccggtggctcctccagcggctcggccgccgtggtctgcgccggcctctgcccggtcgcgctaggcgttgacggaggaggctctgtccggatgccggcagctctgtgcggcgtggtcggcttcaagcccaccgccggacgcctctccaacgccggagttcttccactgaattggacggtcgggatggcggggatcttggcagggacagtggaggacgccgtcgtagcttactcggccattgttgatcagtcccaaccatcttacttgaggcctgagctgaatctgcctatgctgacgtcgacaccgtcgattagcaacgtcaggctagcaaaatatggaaagtggtttaacgacagttccgaggacatcagaacctgctgtgacaaagctcttcagacactgcgcgcacaatacggctgggagactctggatgtgacggtaccggagatcgaggaaatgcggctcgcgcactacgtgacgatcggatcagaatgcactgcttcacttgcaaagtatctcgacaaactgaagaggtccgagatcgggtgggacgtgagagtcgcgctggctgtctacgggtcattcagcagcagagcttacctgaactcgcaacgactccggaatcgtcagatgttctttcacaaagagatcttcaagacagcagatgtcatcgtctcaccgatgaccggtgttactgcctacacgctgcaagatgacgcgctaaacagtggtgaactcgactacataaacggagccgcgttgatccggtactcgatagcagggaacttccttggtttgccggcgataacagtcatggttgggcaagataagggcgggctgcccataggtcttcagttcatcggcaggccgtggtccgaggcgactctgctccacatcgcattcgcaatgcaggaagcttgcagcaagaaccacaggaaacctgtggtgttctatgatctcctcaagaaagactgagagagcgacaaggaagacagaaaagtacagaaacagcgtcgattcatcattccaatcaagtctctagtatattgattgttcatgctgcgagttgaaggatgtattatattctctggttaggaaatggtagatgtatatgcggttattatgctttccagtttgctgatgagctatctgtttcaaccatggaaatatatttttagtgtaatcaatctcttgtcatgccatcttctcaagtgaccagtaaaaatgtagcccatctctatatcagttgtccactacccaaaaagtc

SEQ ID NO: 4085 - DNA, 2370 bp, Oryza sativa
tttctctctctctctctgtcacaatctatgcctttgtccattgctctctgattaattaattcttcaccaagaaatcaattaccttttttttttctcttttctcctcgtttttgccgttcatcttgggtcttgtcgtcgtataaaaggcaccaattcttgtcagtaatcagacaggaagggaggagcttagcagcagtcgttgtgcagaggagagtctcctttgcttcccaagttgccatccatggccgccaaggtgtacaagccggccgccgaggtcaatctcggcccggacagcgacgagttctacatcagccctaacgtcaaagctcctcgggtagcagggctgctggtgaagatcttcgtgtggattcttgagatgccgatcatcggctcaatggtgctttacatcctcaagaaggataatctcatcaacaagcttgtccaagatgctgaaatcccagagcctccactgttcacttccacacacagctgggaagacattccagagcagaatgtgtgcctgacgaagccggacctgtcgccgccggagcgtgtccaggaagccgtcagctgcctccctgcgagcctcgaatcgaccctcgccggctcgccgccgtcgagcccgaaacgctggacgatcagggatttcaacagggcgtacagctcaggggaggtcactcctgttcaggttgcaaagaggttcttggctgcagtgaaggagtgctcaggcccaggcctcaacatggccttcttcatcagctacagccctgaagacatcatcaggcaggctgaagaatccaccctgagataccagagagggacacctctgtctgccatggacgggatactggtcgctgtcaaggacgagatcgactgtttgccctacccaaccacaggcgggacgcggtggctggggcgggcgcgggcgtgcgcggcggacgcggcggtggtggcgcagctgcgcgcgtgcggcgcggtgctcgccggcaagaccaacatgcacgagctcggcgcggggaccagcggcatcaacccgcaccacggctccaccaggaacccccacaaccccggccgcgtctccggcggctcgtccagcggctccgccgccgccgtctgcgccggcctctgccccgtcgccctcggcgtcgacggcggagggtccgtgcgaatgccggcggcgctgtgcggcgtggtcgggttcaagccgacggcggggcggctgtcgaacgccggagttctgccgctgaactggacggtcgggatgcccgggatcctcgctgggacggtcgaggacgccgccgtcgcatactcagcaattgttgatcagtctcagccatcctacttgcggcctgagttgaatctgcccttgctgaagtcttcactctccatcaagaacatcaagcttgcaaaatatgcaaagtggttcaatgacagttcagaggacatcagaagctgctgcgacaaatctcttcagatgctgcatgcgcactatggttgggagactctggatgtaaccataccggagatcgaagagatgcgccttgcgcactatgtgacaattggttcagaatgcactgcatcacttgctaaatatcttgacaagctgaagagatctgaaatcggttgggatgtaagggtcgcacttggcgtgtatggttccttcagcagtagagcctacctgaattcgcaacggctccggaatcgtcagatgtacttccacaaggagatattcaagacggcagacgtgatcgtctcaccaatgaccggtgtgactgcctacaagctgcaagacgacgcgctaaaaagcggagaactggactacataaatggagccgcgttggtccggtactcaattgcaggaaacttccttggtttgccggccatcaccgtcatggttgggtatgacaaagccgggctgcccatcggcctccagttcatcggcaggccgtggtccgaggcgactctgctccacatagcatttgcaatgcaggaggcgtgcaagaagcactacaagaagcctgaagtgttctacgatctcctcaagaaagattaaatccgtaggctgtatgtatgtcagaattcagaaaattcagatcattgcttcgatcaagtctccaacattgaagagaatccattttaagttagcacggaagctgttcttccatttgtgtcagggagaacaatgtagctacatgaccagaaggacgagagcaaaattagatcaattgcagaaactgtttgattagcggaacaaaaattaagtgaaaatgtatgcattatatgacaaatagtttctgtatgatggtgccaaaaaaaagggcaaaaatatatatgtgtgaaattttagtagcatttctgctgcatcagctg

SEQ ID NO: 4086 - DNA, 2184 bp, Oryza sativa
agacaggaagggaggagcttagcagcagtcgttgtgcagaggagagtctcctttgcttcccaagttgccatccatggccgccaaggtgtacaagccggccgccgaggtcaatctcggcccggacagcgacgagttctacatcagccctaacgtcaaagctcctcgggtagcagggctgctggtgaagatcttcgtgtggattcttgagatgccgatcatcggctcaatggtgctttacatcctcaagaaggataatctcatcaacaagcttgtccaagatgctgaaatcccagagcctccactgttcacttccacacacagctgggaagacattccagagcagaatgtgtgcctgacgaagccggacctgtcgccgccggagcgtgtccaggaagccgtcagctgcctccctgcgagcctcgaatcgaccctcgccggctcgccgccgtcgagcccgaaacgctggacgatcagggatttcaacagggcgtacagctcaggggaggtcactcctgttcaggttgcaaagaggttcttggctgcagtgaaggagtgctcaggcccaggcctcaacatggccttcttcatcagctacagccctgaagacatcatcaggcaggctgaagaatccaccctgagataccagagagggacacctctgtctgccatggacgggatactggtcgctgtcaaggacgagatcgactgtttgccctacccaaccacaggcgggacgcggtggctggggcgggcgcgggcgtgcgcggcggacgcggcggtggtggcgcagctgcgcgcgtgcggcgcggtgctcgccggcaagaccaacatgcacgagctcggcgcggggaccagcggcatcaacccgcaccacggctccaccaggaacccccacaaccccggccgcgtctccggcggctcgtccagcggctccgccgccgccgtctgcgccggcctctgccccgtcgccctcggcgtcgacggcggagggtccgtgcgaatgccggcggcgctgtgcggcgtggtcgggttcaagccgacggcggggcggctgtcgaacgccggagttctgccgctgaactggacggtcgggatgcccgggatcctcgctgggacggtcgaggacgccgccgtcgcatactcagcaattgttgatcagtctcagccatcctacttgcggcctgagttgaatctgcccttgctgaagtcttcactctccatcaagaacatcaagcttgcaaaatatgcaaagtggttcaatgacagttcagaggacatcagaagctgctgcgacaaatctcttcagatgctgcatgcgcactatggttgggagactctggatgtaaccataccggagatcgaagagatgcgccttgcgcactatgtgacaattggttcagaatgcactgcatcacttgctaaatatcttgacaagctgaagagatctgaaatcggttgggatgtaagggtcgcacttggcgtgtatggttccttcagcagtagagcctacctgaattcgcaacggctccggaatcgtcagatgtacttccacaaggagatattcaagacggcagacgtgatcgtctcaccaatgaccggtgtgactgcctacaagctgcaagacgacgcgctaaaaagcggagaactggactacataaatggagccgcgttggtccggtactcaattgcaggaaacttccttggtttgccggccatcaccgtcatggttgggtatgacaaagccgggctgcccatcggcctccagttcatcggcaggccgtggtccgaggcgactctgctccacatagcatttgcaatgcaggaggcgtgcaagaagcactacaagaagcctgaagtgttctacgatctcctcaagaaagattaaatccgtaggctgtatgtatgtcagaattcagaaaattcagatcattgcttcgatcaagtctccaacattgaagagaatccattttaagttagcacggaagctgttcttccatttgtgtcagggagaacaatgtagctacatgaccagaaggacgagagcaaaattagatcaattgcagaaactgtttgattagcggaacaaaaattaagtgaaaatgtatgcattatatgacaaatagtttctgtatgatggtgccaaaaaaaagggcaaaaatatatatgtgtgaaattttagtagca

SEQ ID NO: 4087 - DNA, 2250 bp, Triticum aestivum
tcctcgggattctgccagacagacaccgctcttgtcctttctatctttcctgggctcctcgggactcagacaccgctgctgccatgggcctcttcggctcctcggccaaggtgtaccggccggcgccggaggtcgacctcggccccggcagcggcgagctctacatcagccccaatgtcaaagctccgcgggtcgccggccttctggtgaagatcttcgtgtgggtcctggagatgccggtggtgggctgggtcctgctctacatcctcaagaaggacaatctcatcaacaagcttgtctccgaagccgagatccctgagccgccactgttcacctcgacccaccgctgggaagacaccccggagcagaacgtctgcctgaccaagcccggcctgtcgcccgcggagcgcgtccgggaggccgtcgactgcctccccacgcgcctcgagtcgacgctcgccgccgacgtcccgccgtcgtccagcctgaaacgctggacgatcatggacttctccagggcttacagctcgggagagaccacgcctgtccaggtggccaagaggttcctggccgcagtgaaggagtgctcaggccctaccatgaacatggccttcttcatcagctgtgatcccgaggacgtcttgaagcaggccgaagaatccaccctcagataccagacagggacaccgctgtcagtgatggacggcgtgctggtggcggtgaaagacgagatcgactgcttgccctaccccacgacaggcgggacgcggtggctggggaaggcgcggccgtgcgaggcggacgcggcgtgcgtggcgcagctgcgcgcgtgcggcgccgtcctcgccggcaagaccaacatgcacgagctcggcgccggcaccagcggcatcaacccacaccacggatcggcgaggaacccgtacaacgtcggcaaggtggccgggggctcctccagcggctcggccgccgtggtctgcgctggcctctgccccgtcgcgctcggcgtcgacggaggaggctctgtccggatgccggcagcactgtgcggcgtggtcggcttcaagcccaccgccggacgcctctccaacgccggagttcttccactgaattggacggtcgggatggcggggatcttggcagggacagtggaggacgccgtcgtagcttactcggccattgttgatcagtcccaaccatcttacttgaggcctgagctgaatctgcctatgctgacgtcgacaccctcgattagcaacgtcaggctagcaaaatatggaaagtggtttaacgacagttccgaggacatcagaacctgctgtgacaaagctcttcagacactgcgcgcacaatacggctgggagactctggatgtgacggtccctgagatcgaggaaatgcggctcgcacactacgtgacgatcggatcagaatgcactgcttcacttgcaaagtatctcgacaaactgaagaggtccgagatcgggtgggacgtgagagtcgcgctggctgtctacgggtcattcagcagcagagcttacctgaactcacaacgactccggaatcgtcagatgttctttcacaaagagatcttcaagacagcagatgtcatcgtctcaccgatgaccggtgtgactgcctacacactacaagatgacgcgctaagcagtggtgaactcgactacataaacggagccgcgttgattcggtactcgatagcagggaacttccttggtttgccggcgataacagtcatggttgggcaagataagggcgggctgcccataggtcttcagttcatcggcaggccgtggtccgaggcgactctgctccacattgcatttgcaatgcaggaagcctgcagcaagaaccacaggaaacctgtggtgttctatgatctcctcaaaaaagactgagagattgaccagcaagacagaaaagcacagaaacggcgttgactcatcatttcgatcaagtctctagtatattgattgcccatgaatctgtattgattgttcatgctctagttcaaggatatattttctggttaggaaacggtagatgcatatgcagttattatgctttccagtttgctgatgagctatctgtttcaaccatggaaatagatttattaaagtgtaatcaatctcttgtcatgccatcttctcaagtgaccagtaaaagtgtagcccatctctatatcagttatccagtactcacaggtgtatctttgatacatcttggagagca

SEQ ID NO: 4088 - DNA, 2307 bp, Brachypodium distachyon
aatttctcgggctcatctatctaatcgggaattcaggattcactcatcagagtttcagacagacagacagacagacagacagtgcactcttccttcttctttgttcttgccaccatctttcttatccatgggtatcttcggctcggcggcgaaggtgtaccggccggcggcggaggtcgacctcggccccggcagcgccgagcactacatcagccccaacgtcaaagctcctcgagtggccgggctgctggtgaagatcttcgggtgggtcctggagttgccggtcgtcggatggttcctgctctacatactcaagaaggataatctcatcaacaagcttgtctcggaggccgagatccctgagccgccactgttcacttcaacccacagctgggaagacacgccggagcagaatgtgtgcctgacgaagccggacctgtcgccggcggagcgcgtccgggaggccgtcggctgcctcccggcacgcctcgagtcgacgcttggcgccgggccggccctgaaacgctggacgatcatggacttccacagggcctacagctccggagagaccacgcctgtgcaggtggccaagaggttccttgctgcagtgaaggagagctcaggccctaccttgaacatggcattcttcatcagctgcaatcctgaagacgtcttgaagcaggctgaagaatccaccctcagataccagaaaggtgcggcgctgtctgcgttggacggcgtgctggtggccgtgaaggacgagatcgactgcatgccctaccccacaacaggcgggacgcgttggctggggaatgcccggccgtgcgcggcggacgcggcgtgcgtggccccgctccgggcctgcggcgccgtcctggccggcaaggccaacatgcacgagctcggcgccggcaccagcggcatcaacccacaccacgggtcggcgaggaacccgtacgacgccgggaaggtggcggggggatcgtcgagcggctcggcggccgtcgtgtgcgcggggctctgcccggtggcgctcggcgtcgacggcgggggatccgtccggatgcccgcggcgctctgcggcgtcgtcggcttcaagcccaccgccggcaggctctccagcgccggggttctgccgttgaattggacggtcgggatggccgggatcctcgcggggaccgtggaggacgccctcgtcgcttactctgccatcgtcgatcactcccagccatcttacatgcggcctgagctgaacctgcctatgttgacgtccacgccttcgatcagcaacgtcaagctagcaaaatacgcaaagtggtttaacgacagttcggacgacatcagatcctgctgcgacaaggctctccagacgctgcgcacgcactacggctgggagactctggacgtaacggtgcccgagattgaggagatgcggctggcgcactacgtcaccatcggctccgagtgcaccgcctcgctcgccaagtaccttgacaaactgaagagatcggagatcgggtgggacgtcagggtggcgctggccgtctacggctcattcagcagcagagcttacctcaactcgcaacgaattcggaaccgtcagatgttcttccacaaggagatcttcaagacggcggatgtcatcgtgtcaccgatgaccggcgtgacggcctacacactgcaagatgatgcgctacaaagcggtgagcttgactacataaacggagctgcgttgatccggtactcgatagcggggaacttcctcggtttgccggcaataaccgtcatggttggacaagataagggcgggctgcccattggtcttcagttcatcggcaggccgtggtccgaagcgactcttctccacatcgcattcgcaatgcaggaagcatgcagcaaaaaccacagaaagcctgcggtgttctacgatctcctcaagaaagactgagagactgaccaggaaccgcggcagacaccattgcagcgaagagagagcactggcaacatcgatgtgagggaaatgcagcagattgttgcagcgactaaagaaggcagcttaccttgagtttgaaatttgaataccctgtaatgttcttccatttgtgtaaggtacaggatccctgcaatgttctcccatttgtgtaaggtacaggatctggatgaaaggaagcaaaatagctcgagtttagtaggagcagtttaggctcaggaaattcggtgtgaacagtaattaaattattggtgtgctgtaaaaattaatttcgtatgtattgaggtgtttcatgaaagtgtcgttttacttttggc

SEQ ID NO: 4089 - DNA, 2495 bp, Brachypodium distachyon
ctcccctccggttaattattcaccaagaaattaccacccgtctccctactcctcgttgtcgtcgtcctcctctgctcttgcctcatcgccatatataagccccaaatttctcgggctcatctatctaatcgggaattcaggattcactcatcagagtttcagacagacagacagacagacagacagtgcactcttccttcttctttgttcttgccaccatctttcttatccatgggtatcttcggctcggcggcgaaggtgtaccggccggcggcggaggtcgacctcggccccggcagcgccgagcactacatcagccccaacgtcaaagctcctcgagtggccgggctgctggtgaagatcttcgggtgggtcctggagttgccggtcgtcggatggttcctgctctacatactcaagaaggataatctcatcaacaagcttgtctcggaggccgagatccctgagccgccactgttcacttcaacccacagctgggaagacacgccggagcagaatgtgtgcctgacgaagccggacctgtcgccggcggagcgcgtccgggaggccgtcggctgcctcccggcacgcctcgagtcgacgcttggcgccgggccggccctgaaacgctggacgatcatggacttccacagggcctacagctccggagagaccacgcctgtgcaggtggccaagaggttccttgctgcagtgaaggagagctcaggccctaccttgaacatggcattcttcatcagctgcaatcctgaagacgtcttgaagcaggctgaagaatccaccctcagataccagaaaggtgcggcgctgtctgcgttggacggcgtgctggtggccgtgaaggacgagatcgactgcatgccctaccccacaacaggcgggacgcgttggctggggaatgcccggccgtgcgcggcggacgcggcgtgcgtggccccgctccgggcctgcggcgccgtcctggccggcaaggccaacatgcacgagctcggcgccggcaccagcggcatcaacccacaccacgggtcggcgaggaacccgtacgacgccgggaaggtggcggggggatcgtcgagcggctcggcggccgtcgtgtgcgcggggctctgcccggtggcgctcggcgtcgacggcgggggatccgtccggatgcccgcggcgctctgcggcgtcgtcggcttcaagcccaccgccggcaggctctccagcgccggggttctgccgttgaattggacggtcgggatggccgggatcctcgcggggaccgtggaggacgccctcgtcgcttactctgccatcgtcgatcactcccagccatcttacatgcggcctgagctgaacctgcctatgttgacgtccacgccttcgatcagcaacgtcaagctagcaaaatacgcaaagtggtttaacgacagttcggacgacatcagatcctgctgcgacaaggctctccagacgctgcgcacgcactacggctgggagactctggacgtaacggtgcccgagattgaggagatgcggctggcgcactacgtcaccatcggctccgagtgcaccgcctcgctcgccaagtaccttgacaaactgaagagatcggagatcgggtgggacgtcagggtggcgctggccgtctacggctcattcagcagcagagcttacctcaactcgcaacgaattcggaaccgtcagatgttcttccacaaggagatcttcaagacggcggatgtcatcgtgtcaccgatgaccggcgtgacggcctacacactgcaagatgatgcgctacaaagcggtgagcttgactacataaacggagctgcgttgatccggtactcgatagcggggaacttcctcggtttgccggcaataaccgtcatggttggacaagataagggcgggctgcccattggtcttcagttcatcggcaggccgtggtccgaagcgactcttctccacatcgcattcgcaatgcaggaagcatgcagcaaaaaccacagaaagcctgcggtgttctacgatctcctcaagaaagactgagagactgaccaggaaccgcggcagacaccattgcagcgaagagagagcactggcaacatcgatgtgagggaaatgcagcagattgttgcagcgactaaagaaggcagcttaccttgagtttgaaatttgaataccctgtaatgttcttccatttgtgtaaggtacaggatccctgcaatgttctcccatttgtgtaaggtacaggatctggatgaaaggaagcaaaatagctcgagtttagtaggagcagtttaggctcaggaaattcggtgtgaacagtaattaaattattggtgtgctgtaaaaattaatttcgtatgtattgaggtgtttcatgaaagtgtcgttttacttttggcaatggccctggcaaaccatgattgtgaaaaaaatatcatccaccatgtcagcgacgtggactaaaatggaaaaataaataagga

SEQ ID NO: 4090 - DNA, 2358 bp, Setaria italica
ggcaggcaccggcgcaccgcccttggccagttcttggtcgggcgcttcgccggcgacgagcatccggcagtaattattttttctgtgtcctgcaggggcatgcgagtctggagtctcagttgatcgaaaatggttaaaatcgaagatcttactgaggacagcagcgcagatgctgatgccagggttcccagggaagcggctgtgggtctgctgcctggctcggtgcatgccagcttgaaggaggaagatcaaccaagttcttcttccagtagtttaagattacaatttattggaatggggttctcaccaaagctcgtagacaaggtgctcaaaagacatggtgatgatgactctaacaccattttggaatctcttctgtcctattctgaccttcagcagtcaggttctgaatcgtcaggttctttgggaagtctctttgattctgataatgaagaaaacaattctcctttagagtctatgaaaggaatcggtcaagacatcaagccggagcctgattctttctcagaaaagtggtcatatttactccaaacaatgaagttttcacagcaagaagttgatttagccttcaagaaactaggcgacgaagctccattggaacagctcgtgaactgcattgtcaatgctcaattaggaggatcctctggaggactggaaaatggtgacactacaaatgagggaaaggctgaagcactgtttggtatcatggagaaaacacttagcttgcttcagaagggttataccgaggaagaggtgtcatcagctattgacagttttggccacagagcaacagtgcaggtgctggaggactcaattttggcaaggcgaatagccaatagcatcgagcagaaagagataaaggttgaatctgactttctaggcgaagcagaaactgattattcgacataccagacctcatactctgcagtgaggtgttatgatgatgatgtcaacaacacacgggttaaaagggctaagcatatatttatgaatgacagaggggcctccagtagtaaccctgccaatccatggtctatggggcgctgtgcagggaccagtgatatgcctgttaaggtagaacttgaggcagtaacaccaggctgtcgtgcaaaagtacaaggcgaccttgctaagcccccatatttcttgtatggaaatgtcgttgagatcccaaaagacacatggcatcaactcaaacagttcttatacaatgtggaacctgagtttgttagcagtcagttcttctcagctctaactcgaaaggaaggttatattcataaccttccagtggagggaaggcatgttgtggttccaaagtcaccaatgaccattgaagaagcgcttccattcacaagacaatggtggccctcatgggatacaaggaagcatatcagtgttgttaccatagaggctgccgggattgatcagacatgtgagagactggggaggatggttagagagtcaagaggagtgctttcacaagaaaggcagatgcagattatgcaccaatgcacggtttcaaaccttatttgggttggccgggacaagttaagtcctttggaacctcgtcaattggaaaggatactgggttacccacataaccacacaaatttgtttgaactaaatcaatcagatagatttgctgcgatgagatatgcatttcagactgacactttgtcatactttttgtcagtcctaaaagaccaatttccacacgggatcagagtactatccatctatagtggaattggaggtgctgaagtaacgctccatcggctaggtattcctctgaagtgtgtggtatctgttgaggaatctgaggtaaataggaaaattctgaaaaggtggtggctgaaaacagaacagactggggagctgaggcagttgcctggaatctggaagttgaaaatacaagtgattgaagactttatcaccgagtttggtggttttgacctgattattggtgggaattatacttcttgtaaaggtggtacaacagtaaatacaacaatgggcatggattccaaccgtttctatgaatatgcccgtgttgttaaaagagtaagggctgcagtgggggtcaattgacgactgacatgatccatctttagtgagttctcgccttggcaaattgccatgaacttccttgtagcatcatgtgatctgtaaatgtaggatggtagaagtaaactatgacagattccttagctcttacattgtgcactagtgtagaattttaaatgcagtgggttaatatttcttccgcctgtttgtttctcctctagttgattctgtgtacaagtttctacttttagcaatcattcatctgtgtggatcatt

SEQ ID NO: 4091 - DNA, 2657 bp, Zea mays
gcaggaaaaaacagctcgtggcagctgagactgagaggcgctgctgatataaaaacttgggaaggttgacgcctctatctctctctctctctgtctcccaccacctatcttccctccccatgtgggcggcctcgagctctgcttaggtctcacagctgtgctctcgttggttgggtgatccgccccttgtcggctcctttcaactcgagagctccgggacagcgagatctgcgctgtcgccgccttacctttcttacgagctcgcgtgcaggcaggcactgagcagtgagctcccccccgtcttcctcagcctcgtttcccctctcgttgctggatctggctcgcaagatccaatctttcgtgccccctttttccaaagatcctcgcttgggtggttcttcctggagattgctgggaggatgcagcacgaccagaagaagaaggcaccttcagagatggattttttcacagagtatggcgaaggcagcaggtacaagatagaagaggtcataggcaaaggcagctacggcgtggtttgctctgccgtggacactcatactggcgaaaaggtcgctataaagaagataaacgacatcttcgagcatgtgtctgatgcgacgcggatactccgggagatcaagctgcttaggctcctgcggcatccggatattgtggaaataaagcatatcttgctccctccgtcgaggagggagttcagggatatatatgttgtctttgaactcatggagtctgatctgcaccaagttataaaggctaacgatgacttgaccccagagcattaccagtttttcttgtatcaattgcttcgaggattgaaatacatacatacagcaaatgtatttcatcgagatctcaaaccaaaaaatattctggcaaatgctgattgtaagctcaaaatatgtgactttggcttagcaagagtagctttcaatgatactccaaccgccatcttttggacggattatgttgcaactaggtggtaccgagcaccagagttgtgtggatctttcttctccaagtatacaccggcgatagatatatggagtattggctgtatatttgcagaattgttaactggaaaacctcttttcccggggaaaaatgtggtacatcaacttgatataattacagatctccttggaacaccttctcccgaagcaatatcaaggattcgtaatgaaaaggccaggcgctacttgagcagtatgaggcgaaaaaagcctataccgtttacgcaaaagttcccaaatgcagatccacttgcactatgtttgttagagcgaatgctcgcttttgagccaaaagacaggccaagtgctgaagaggctcttgctgatccttatttcaagaatatagccagtgtggatagagagccttctgcacaggctgtcacaaagcttgaatttgaattcgagaggcggagagttacaaaggaagacataagggagcttatatatagggaaattcttgagtatcatccaaagatgctgagggagtttcttgagggaactgagtcaagtggtttcatgtacccaagtgcagtagatcattttaaaaagcagtttgcataccttgaagaacattatgccaagggatctacaggaactccacctgagaggcaacataattcattgccgcggccgtctgttgtctattccgacaaccgatcacaaaccacagccaacatcaccgaggatctttccaagtgtatgctcagagaaaatacacagaagacacatccatattctgcttctgttgcaagtaaatttccaccacatgttcctcaaggtgatgttgcaaggcctggtaaagcagttggttcggtgatgcagtacagcccatgtccagcgcctgctgccgagcgatatgagcaacgaagaatcgctaggcacccagcagttgccccaaacaatatcccttctggaagctcataccccagaagaagccagacctgcaagagtgagacaggtgatgccgaaagccatatggatgcgaaccaagctcggcagccaaagccatatgcagcgaacaaactacctgctaccgttgatagtcgtggtggtcactggtaggatttctgcggtgcaccagaaagccattccaaaccgtttcttaacatgttatcagtatcgattacttctgctgagtgctacattattctgacaaatccagaaatgtagttctgtacagatttgtgttctttttccggatacctgaataccgaaagactgtacaactgtagtttctgattcctactccttgtcgctattcaatcgctaaaggatctgtccctggtggagaagaaccggcagattcaatgcaatgttcttgactgacgtcatggattttgttcttcaacctggtagctctgaagacgaattgaatagctgctagtttctgctaatcatctacagtcaggtgcagagtgttctgggagctagttctgaatatcactgtcacgctgtaatctgcacgtttctgagctcctaacttctaagcatgccactaccgtatccctttgtaatttaatcagctgtaccatccagtactctgtttacatttgtagaaacgctctgcaaagaagctattatgtgggagtttctttgctattattataaatgttctgttgttataaa

SEQ ID NO: 4092 - DNA, 2645 bp, Setaria italica
gggccactggtggtggtggtctccctcacttgactcctcagctactaccttcctggcttcctctctctcctcagctccatgtgggcggcctcgagctccgcttagatcacagctgtgttcgttggttgggtgatccgccccttgtcggctcctttcagttccgagctctggaacagggagatctgcgctgtctccacctcggctccctccctcgtgtgcgcgtgggcactgagcagtgagctcctttcctcctcggccttgttgctcccccttcttgctggatctggcttaaaagatccgacctttcgtgcccgccttggccaaagatcctcgcttgggtggttcctggagattgctgggaggatgcagcacgaccagaagaagaaggcaccttcagaaatggatttcttcacggaatatggtgagggcagcaggtacaagatagaggaggttatagggaaagggagctatggtgtggtttgctctgctctggacacccatactggcgaaaaggtcgctataaagaagataaatgacatcttcgagcatgtgtctgatgcgacacggatactccgtgagatcaagttgcttagactactgcggcatccggatattgtggaaataaaacatattctacttcctccatcaaggagagaattcagggatatatatgtagtttttgaactcatggagtctgatttgcaccaagttataaaggctaatgatgacttgaccccagagcattatcaatttttcttatatcagttgcttcgaggattgaaatacatacatacagcaaatgtatttcatcgagatctgaaaccaaaaaatattctggcaaatgctgattgcaagctcaaaatatgtgatttcggcctagccagagtagctttcaacgatactccaactgccatcttttggacggattatgttgcaactaggtggtaccgagcacctgagctgtgtggatcttttttctccaagtatacaccagcaatagatatatggagtattggctgtatatttgcagaactattaactgggaaacctcttttccctgggaaaaatgtggtacatcaactcgatataattacagatctcctgggaacaccttctccagaagcaatatctaggattcgaaatgagaaggctaggcgctacttgagcactatgaggcggaaaaaggctataccatttacacagaagttcccaaatgcagatccacttgcactaagtttgttagagcgaatgctagcttttgagccaaaagacaggccaagtgctgaagaggctcttgctgatccttatttcaagaatatagccaatgtggatagagaaccttctgcacaggctgtcacaaagcttgaatttgagtttgagaggcggagagttacaaaggatgacataagggaactcatatatagagagattcttgagtatcatccaaagatgttgagagaattccttgagggaactgagtcaagtggtttcatgtacccaagtgcagtagatcattttaaaaagcagtttgcgtaccttgaggaacattattgcaagggatctacaggaaccccacctgagaggcaacataactcattgccacggccttctgttgtctattcggacaaccgacaacaaagcacagccaacatcacggaggatctttccaagtgtttaatcagagagaatacacaaaagacacagcagcattctgcttcagttgctgcaaataaatttccactccatgttcctcatggtgctgctgcgaggcctggtaaagcagttggttcagtgctgcagtacaaccccggtccagcatctgccgctgagcagtatgagcaacgtaggattgctaggcacccagcaattgccccaaacaatatcccttctggaagctcatacccgagaagaaatcagacctgcaagagcgagacaggtgatgctgaaaggatggacgtgaaccaagctgggcagccaaagccatatgcagcaaacaagttacctgctaccgtggacggtcgcggtggccactggtagatttccgcagcagtgcaccagcgaaccatttcctaacatgttatcagcagcggttacttatgctaagcgctacattattctgacaaattcagaaatgtagtcctgtacagatttgtattcttaatccagatacctgagttctaaaagaacgtagaactaaaggattcctaaattccggattctttgcactcgaagttgctgggtttcgatttgtcgctattcaatcactaaaatctggtgaagatttgtcagcctgatgtatagtggaaactcactggtaagtggcaacattggacctgtctgcagagttcgtgattgaagctgttcatgaacttgttcttcaaccaggtagctctagagccgaactgaaaagctagtagttgctcttaatcacttacacatcaggtgcacaatgatcatttcgggggcctaggagctacagctatgtacacttccttaatatcatttcattgttgtaatctgcacgtttctgagttctaactccagagcgtgtgactttgtattttaatttgttaattaactgtactattgaactttttttacgtttataataacacttgtgaaaaaactattatttggaagttaca

SEQ ID NO: 4093 - DNA, 2611 bp, Panicum virgatum
ctcttcccttccgcttcccatgtgggcggcctcgagctctgcttagatcacagctgtgctcgttggttgggtgatccgccccttgtcggctcggctcctttcagctccgagctctgggacagggaggtctgcgctgtcgcccgcctcggctcccttttgtgttgtgcgcctaggggcactgagcagtgagctcctttcctccccggcctttgttgccccccttcttgctgtatctggcttgcaagatccgatctttcctgccccctttggccaaagatctatcgctcgggtggttcgtgcagatcgctgggaggatgcagcacgacctgaagaagaagggaccttcagaaatggattttttcacggaatatggtgagggcagcaggtacaagatagaagaggtcatagggaaagggagctatggtgtggtttgctctgcgatggacacccatactggcgaaaaggttgctataaagaagataaatgacatcttcgagcatgtgtctgatgcgacaaggatactccgtgagatcaagttgcttagactactgcgacatccagatattgtggaaataaaacatattctacttcctccatcaaggagagaattcagggatatatatgtagtttttgaactcatggagtctgatttgcaccaagttataaaggctaatgatgacttgaccccagagcactatcagtttttcttgtatcagttgcttcgaggattgaaatacatacatacagcaaatgtatttcatcgagatctgaaaccaaaaaatattctggcaaatgctgattgcaagctcaaaatatgtgacttcggcctggccagagtagctttcaacgatactccaactgccatcttttggacagattatgttgcaactaggtggtaccgagcacctgagctgtgcggatcttttttctccaagtatacaccagcgatagatatatggagtattggctgtatatttgcagaactattaactggaaaacctcttttccctgggaaaaatgttgtacatcaactcgatataattacagatctcctgggaacaccttctccagaagcaatatctaggattcgaaatgagaaggctaggcgctacttgagcagtatgaggcggaaaaagcctataccgttcacacagaagttcccaaatgcggatccacttgcactaaatttgctggagcgaatgctagcttttgagccaaaagacaggccaagtgctgaagaggctcttgctgatccttatttcaagaatatagccaatgtggatagagaaccttctgcacaggctgtcacaaagcttgaatttgagtttgagaggcggagagttacaaaggatgacataagggaactcatatatagagaaattcttgagtatcatccaaagatgttgagagaatttcttgagggaactgagtcaagtggtttcatgtacccaagtgcagtagatcattttaaaaagcagttcgcgtttcttgaggaacattatgccaagggttctacaggaaccccacctgagaggcaacataactcattgccacggccttctgttgtctattcggataaccgacaacaaagcacagccaacatcacggaggatctttccaagtgtttaatcagagaaaatacacaaaagacacagcaacattctgcttcagaagctgcaaataaatttccactccatgttactcatggtgctgccacgagacctggtaaagcagttggttcagtgctgcagtacaaccctggtccagcatctgctgctgaacagtatgaccaacgaagggtcgctaggcacccagcaattgcccccaacaatatcccttctggaagctcataccctagaagaaatcagacctgcaagggcgagacaggtgatccagaaaggatggacgtgaatcaagctggacagccaaagccatacgcagcaaacaagttacctgctaccgtcgatggtcgcggtggccactggtagatttccactgtgcaccagcaaactatttcctgacatgctataagcatcagttacttatgctaagtgctacatcattctgacaaattcagaaatgtagtcctgtacagatttgtattctttgtcctgatgcctaaattctgaaagatcgtagaactaaaagattctctaaattccggattctttgtacctgaagttcctgggtttcaacttgtcgctgctcaaccactaaaatccggtgaagatttgtcagtgatggacggtggaaactcactgccagcaggtggacctggctgcagagatcgagattgaagctgttcgtgaacttcaacctggtaggtctggagccaaactgaaaagctagtagttgccgttaatcatgtacacgtcaggtgcagaatgttcatttggggatcggaaccacgagctgcaaccatgtacacttgatatcatgtcattgtaatctgcaactttctgagttctaacatcggagagtgggaccattgtattttaatttattaattaactgtaatattgaacaatttatttacgcttataataactcatgtgaaaaattctattatgtggaggatatgtgatatagtggaaatgtggaacctgccttc

SEQ ID NO: 4094 - DNA, 2275 bp, Setaria italica
gcaccttcagaaatggatttcttcacggaatatggtgagggcagcaggtacaagatagaggaggttatagggaaagggagctatggtgtggtttgctctgctctggacacccatactggcgaaaaggtcgctataaagaagataaatgacatcttcgagcatgtgtctgatgcgacacggatactccgtgagatcaagttgcttagactactgcggcatccggatattgtggaaataaaacatattctacttcctccatcaaggagagaattcagggatatatatgtagtttttgaactcatggagtctgatttgcaccaagttataaaggctaatgatgacttgaccccagagcattatcaatttttcttatatcagttgcttcgaggattgaaatacatacatacagcaaatgtatttcatcgagatctgaaaccaaaaaatattctggcaaatgctgattgcaagctcaaaatatgtgatttcggcctagccagagtagctttcaacgatactccaactgccatcttttggacggattatgttgcaactaggtggtaccgagcacctgagctgtgtggatcttttttctccaagtatacaccagcaatagatatatggagtattggctgtatatttgcagaactattaactgggaaacctcttttccctgggaaaaatgtggtacatcaactcgatataattacagatctcctgggaacaccttctccagaagcaatatctaggattcgaaatgagaaggctaggcgctacttgagcactatgaggcggaaaaaggctataccatttacacagaagttcccaaatgcagatccacttgcactaagtttgttagagcgaatgctagcttttgagccaaaagacaggccaagtgctgaagaggctcttgctgatccttatttcaagaatatagccaatgtggatagagaaccttctgcacaggctgtcacaaagcttgaatttgagtttgagaggcggagagttacaaaggatgacataagggaactcatatatagagagattcttgagtatcatccaaagatgttgagagaattccttgagggaactgagtcaagtggtttcatgtacccaagtgcagtagatcattttaaaaagcagtttgcgtaccttgaggaacattattgcaagggatctacaggaaccccacctgagaggcaacataactcattgccacggccttctgttgtctattcggacaaccgacaacaaagcacagccaacatcacggaggatctttccaagtgtttaatcagagagaatacacaaaagacacagcagcattctgcttcagttgctgcaaataaatttccactccatgttcctcatggtgctgctgcgaggcctggtaaagcagttggttcagtgctgcagtacaaccccggtccagcatctgccgctgagcagtatgagcaacgtaggattgctaggcacccagcaattgccccaaacaatatcccttctggaagctcatacccgagaagaaatcagacctgcaagagcgagacaggtgatgctgaaaggatggacgtgaaccaagctgggcagccaaagccatatgcagcaaacaagttacctgctaccgtggacggtcgcggtggccactggtagatttccgcagcagtgcaccagcgaaccatttcctaacatgttatcagcagcggttacttatgctaagtgctacattattctgacaaattcagaaatgtagtcctgtacagatttgtattcttaatccagatacctgagttctaaaagaacgtagaactaaaggattcctaaattccggattctttgcactcgaagttgctgggtttcgatttgtcgctattcaatcactaaaatctggtgaagatttgtcagcctgatgtatagtggaaactcactggtaagtggcaacattggacctgtctgcagagttcgtgattgaagctgttcatgaacttgttcttcaaccaggtagctctagagccgaactgaaaagctagtagttgctcttaatcacttacacatcaggtgcacaatgatcatttcgggggcctaggagctacagctatgtacacttccttaatatcatttcattgttgtaatctgcacgtttctgagttctaactccagagcgtgtgactttgtattttaatttgttaattaactgtactattgaactttttttacgtttataataacacttgtgaaaaaactattatttggaagttacatgactgtttgattggag

SEQ ID NO: 4095 - DNA, 2170 bp, Pennisetum glaucum
gcaccttcagaaatggatttcttcacagaatatggtgagggcagcaggtacaagatagaagaggtcatagggaaagggagttatggtgtggtttgctctgctctggacactcatactggcgaaaaggtcgctataaagaagataaatgacatcttcgagcatgtgtctgatgcgacacggatactccgtgagatcaagttgcttagactactgcggcatccggatattgtggaaataaaacatattctacttcctccatcaaggagagagttcagggatatatatgtagtttttgaactcatggagtctgatttgcaccaagttataaaggctaatgatgacttgaccccagagcattatcagtttttcttatatcagttgcttcgaggattgaaatacatacatacagcaaatgtatttcatcgagatctgaaaccaaagaatattctggcaaatgctgattgcaagctcaaaatatgcgatttcggcctagccagagtagctttcaacgatactccaactgccatcttttggacggattatgttgcaactaggtggtaccgagcacctgagctgtgtggatcttttttctccaagtatacaccagctatagatatatggagcattggctgtatatttgcagagctattaactgggaaacctcttttccctgggaaaaatgtggtacatcaactcgatataattacagatctcctgggaacaccttctccagaagcaatatctaggattcgaaatgagaaggccaggcgctacttgagcactatgaggcggaaaaaggccacaccatttacacagaagtttccaaatgcagatcctcttgcactaagtttattagagcgaatgctagcttttgagccaaaagacaggccaagtgctgaagaggctcttgctgatccttatttcaagaatatagccaatgtggatagagaaccttcagcacaggctgtcacaaagcttgaatttgagtttgagaggcggagagttacaaaggatgacataagggaactcatatatagagagattcttgagtatcatccaaatatgttgagagaataccttgagggaaccgagtcaagtggtttcatgtacccaagtgcagtagatcattttaaaaagcagttcacgtaccttgaggaacattatgcccagggatctacaggaaccccacctgagaggcaacataactcattgccacggcccgctgttgtctattcagacaaccgacaacaaagcacagccaacatcacggaggatctttccaagtgtttaatcagagagaatacacaaaagacacagcaacattctgctccagttgctgcaagtaaatttccactccatgttcctcatggtgctgctgcaaggcctggtaaagcagttggttcagtgctgcagtacaaccccggtccagcatctgctgctgagcagtatgagcaacgaagagttgctaggcacccagcaattgccccaaacaatatcccttctggaagctcataccccagaagaaatcagacctgcaagagcgagacaggtgatgctgaaaggatggacgtgaaccaagctgggcagccaaagccatatgcagcaaacaagttacctgctaccgtggacggtcgcggtggctactggtagatttccgcaatgcaccagcaaatcatttcctaacatgttatcagctgcggttacttatgctaagcgctacattattctgacaaattcagaagtgtagtcctgtacagatctgtattccttttccagctacttgaattctaaaagattgtagaactaaaagattcctaaattgcggacccgttgtactccaagctgctgggtttcgaattgtcactattcaatcactaaaatccggtgaagatttgtcaggctgatgcatagtggaagctcattggcaacagttggacctggctgctgagttctgtgattgaagctggtcatgaactttttcttcaatcaggtagctctatagcccaactgaaaaactagtagttactgttaatcacctacacgtcaggtgcaaaatgatttatgttcattccaggagcctaggagaggagttgcagctctgtacacttaataccatttcactgttgtaatctgcacgtttctgagttctaactacttcagagcgtgtgac

SEQ ID NO: 4096 - DNA, 2255 bp, Zea mays
tcgtgcctaccttggctaaagtttctcgcttggttggctcgcgttgactgctgagaggatgcagcacgaccagaagaagaagcaccttcagaaatggattttttcacagagtacggcgaggggagcaggtacaagatagaagaggtcatagggaaaggcagttacggtgtggtttgctctgccttggacactcatactggtgaaaaggtcgccataaagaagataaatgacatctttgagcatgtgtctgatgcgacaaggatacttcgggaaatcaagttgcttagactcctgcggcatccggatatcgtggaaataaagcatattctacttcctccatcaaggagggaattcagggatatttacgttgtgtttgaacttatggagtctgatttgcaccaagttataaaggctaatgatgacttgaccccagagcattatcagttcttcttgtatcagttgcttcgaggtttgaaatacatacacacagcaaatgtattccatcgagatctcaaaccaaaaaatattctggcaaatgctgattgtaagctcaaaatatgtgattttggcctagcaagagtagctttcagtgatactccaaccgcgatcttttggacagattatgttgcaactaggtggtaccgagcaccggagctgtgtggatcatttttctcaaagtatacaccagcgatagatatatggagtattggttgtatatttgcggaactattaactggaaaaccgcttttcccggggaaaaatgtggtacatcaacttgatataattacagatctcatgggaacaccttctccagaagcaatatcgaggattcgtaatgagaaggccaggcgctacttgagtaatatgaggcggaaaaagcccataccttttacacagaagttcccaaatgcagatccacttgcattaggtttgttagagcgaatgctagcttttgagccaaaagacaggccaagtgctgaagaggctcttgctcatccttattttaagaatatagccaatgtggatagagagccttctgcacaagctgtcacaaagctcgaatttgagttcgagagacggagagtcactaaagatgacataagggaacttatatatagagaaattcttgagtatcatccaaagatgttgaaagaatttattgagggaactgagtcaagtggtttcatgtacccaagtgcagtagataattttaaaaagcagtttgcataccttgaggaacattatgccaagggatctacgggaactccacctgagaggcaacataactcattgccacggccttctgttgtctattcagacaaccaatcacaaagcacggccaatataacagaggatctttccaagtgtataatcagagaaaatgcacagaagtcacagcaatataatgcttcagttgcaaataaatttccatcccatgttcctcaaggtgctgctgcaaggcctggtaaagcagttggttcggtgctgcagtacaacctctctcaagcatctgctgctgagcaatatgagcagcgaagggttgctaggcacccagcagttgccccaaacaacatcccttctggaagctcataccccagaagaaatcagacctgcaagagcgagacaggcgacactgagaggatggacgtgaaccaagctgggcagccgaagtcctatgcagcaaacaaactacctgcaactgttgatggtcgcggcggccattggtagatctccgcgttgtgtaacacgttatcagcatctgttacttgtgctaagcgctacattattctgacaaattcagaaatgtagttctgtacagatccgtattctttccccggattcctaagtactgtagaacggtgctcgaaatcgctgggtttccacctcctgtcgctattcattcactgaaagatctgctggctggtggagatttgtcagactgaagtatactggaagctcactggcaacagcgggaactcaagcaagcagagttcttgactgacgttgtcatttgttcttcagcctggtaggtctaacgagctgaatactggtagttcctgtgaatcatctacacgtcaggtgcagaattctgttgagctagctaggaggtgcaagcatgttgtacgctgaatatcaaagtcattgatcctttactcatgttatcttggttaaacgtgagatatatgctagcgtgtagtatccctgtttcccaacaatatacttactcaccacattgttcacgtatagctgatact

SEQ ID NO: 4097 - DNA, 5359 bp, Oryza sativa
ccagatggctccatgtgctccaatcccttattctagtgggagctctctcacctccagaccaaacaacaccaagagaaaaattttttttccaagaaacgaaagcgaaatcaacctgcaattaccagcataaatcaatcaatcggaaaagcagaggccacaacgatctctctctccagtctcgactccccagctaccacctcctctcctctcctctctcctccatgagctttgcctagatcacagctggatttcttggccgcatcctcctcttcttccaggtctcttccagctagctagcttgttcttcccttccctttctttttgccttgtgcgcgtgaggatcagtgagctgtgcggctctcttttcttgttcttgctggactgctgctgccttaaaagatcctgcctttcttgctcactttccccggaggagagagagaggagatccacatctctgatggttcttgggatctcctaggagttgtttctacctgtgctgctgctgctgatttcttcttcgatttgctagcggctgtgtggtcggagctcgtcttcttggttcgagatctcgacaccttctgagatggattttttcaccgagtacggtgagggaaacaggtacaagatagaagaggttataggaaaagggagttatggtgtggtttgctctgctttggacactcacaccggtgataaagttgctatcaagaaaatcaatgacatctttgagcatgtgtccgatgcaacacggatacttcgcgagatcaagttgcttagactcctgcgacatccggatatcgtggaaattaagcatattctacttcctccatcaaggagagaattcaaggatatctacgttgtttttgaactcatggagtctgatttgcaccaagttataaaggccaacgatgacttgactcctgaacactaccagtttttcttgtatcagttgctccgaggactgaaatatatacacacagcaaatgtatttcatcgagatctcaaaccaaaaaatatcttggcgaatgctgattgtaagctcaaaatatgtgatttcggccttgcaagggtagcttttagtgatactccaaccgccatcttctggacggattatattgcaacaaggtggtaccgagcaccagagctgtgtggatcttttttctccaagtatacaccagcaatagatatatggagtattggctgcatatttgccgagcttttaaccggaaaacctcttttccctgggaagaatgtggttcatcaacttgatataattacagatctactaggaacaccttctccagaaacaatatctaggattagaaatgagaaggcaagacgttacttgaacagtatgaggcggaaaaaacctataccatttacacagaagttcccaaatgcagatccacttgcaatgcggttgttagagagaatgttagcttttgatccaaaagatcggccaagtgctgaggaggcgcttgctgatccttatttcaagaacatagccaatgttgatagagagccttctgctcaacctatcacaaagctagagtttgagttcgagaggcggagaattactaaggaagatataagggaactcatatatagagaaattctggagtatcatccaaagatgctgagggagttccttgagggaactgagtccactggtttcatgtacccaagtgcagtagaccattttaaaaaacagtttgcataccttgaagaacattatgccaagggatcaacagcagctccacctgagagacaacataactcattaccaaggccttgtgttgtctattcagataaccggccacaaagcacagccagtgtcactgaggatctttccaggtgtttaatcagagacaacaatctaaaatcacaggattctgcttcagtcggtgcaagcagaatccctcaaggtgctgctgcaagacctggtaaagcagttggttcggtgctgcgttacggtaactgttcgacatccgctgctgagcaacaatatgagcagcgaagggttgttcggaacccagcaattgctccaaacagcagtgttcctctggggagctcataccccagaagaaaccagacctgcaagagtgaaacaggtgatgttgaaaggatcgattccagccaaaccggtccaccgaagccatatgtggcgaacaaactgcctgctaccgtcgatggtcggagtggccactggtaaatttctgcagcgcaccagcgaaaacgctagttattaccacagcatcagcatgggtttattgttctatgtagtaaattcttagacatttaaaacatgtcattctgtacagacttgtattgtttcttgggggcttttccatgataaaaacagtagaattgtactgcaagccctagtggattaggctgcctgtttcttcatttcttcatagctcaacctctgaatgatctggtacacaaacaagatctcatggaattggacatcacatgattcagttcgaagggggtatagtggaaactggaagcaacaagtggactgtaacattttcttgctgagaaaacaagggactctttactgacctgactgatgctgctattcaatttattttccaagtaaatccgaagaaggatcatgtaaacagcacaatgttggacattgctttagtatttcgttctcaggaacattgttccctttgcagagctaggagctgcaactatgtactactatctgacattgctgtaacttgtaaaacttaattgcatttcaagtattttccctcctttagcctgtaattcagctctagtatttgaactactatgtttcaaattactttggtgttcaagctttgttctaagtcaaaaatttatatctttgacaattaatttctataaagagtgaagtgcacgagcggtcctcaaacttgtgcgggtgtgtcatctagatccctaaactctcaaaatgtatttttgggtccttaaacttgttttggtgtcatataggtctaaacgggtgtgtcatttaggtccctaaactctcaaaatgtatttttgggtccttaaactttttttgggtgttatataggtccaaacgagctccaaccccttcatgcgctgacgtggcatgccacgatagtgtatacgtgttagttggactcacgtgctagtcacatagaataaaatataattagaaaaacatattttctcctctctaccttataatttttatcttttttctgtctacctaagaggagaaaatatggtttttaattttaatttttatatatgtttgacatgtggattccactgacacgtagacgtcaccgtggcattgccacgtcagcgcatggaacgggttagaactcgtttggacctatatgacatacatagcaagggacctaaaaatgcattttaggagttcagggacctaatgacacaccaggcccatctactatactcttctataaattcatacagtttaacatcactagttttatgtttctaggaccattatatggttaaaatagtactatctctattctaaaatataatcatttatagttatgaatttagacaaacaactgactaagtttatagttgaaaattattacattttgaaacgagcagtacagtactatgtttgcagtgcaattacctgccctgaaccattggcgttggcgttggcgttggcgttgaccctagctagcctcgcactatcattcaacctagccaagctggtgctgatcctctattgcattctctggtgttctggtgttcgttgtttgtacttgctttgtcacattaaagactcgactgctcgcttttcaatgcataaaatataattttttttctatttcaaagaataaggcataatcacatttttacctaaagacaaaaaaataataattattattaccttattgtttgaatcatcctaatacaataaaattagagatcttgagaatgaataggttaaaatttaatagtagacgctagttaattacatgcatgcacgcatgccttatattatgaaacatcttaaaaaaaaattatgccttatattttgaaatggttgaagtacaagtatagcattagtacgtactccatttgtcccaaaatggctaacctaatatcggacgagatattttctagtacaatgaatttagatatgagtatgttcaaattagttgtattaggaaaggctccatctaatactagtttgatttttttttatggagggagtaggtaggtgcagcaagacatactgaaggaataaacctattgattttgtggactaaaggtatatataaaaaaatacataaattagcttatttagagataaaatttaaactctaaaaattagtttattttgggacggaaagattatgtacctagagataaaattgtttgttttactttctatcaagtgaaacaaaacaattcatttctacatttagtttttataatctacctgcttaaacatagtacttcttccatttaaatgtctaagacttgtttttcatcaagatagaggaagaattaacttatccactatgtgacaaaagaaaggaatcatatacatgcatgcaaccaattaatattaaaatggtttattggattccaatcaataatttaatttagcataagcatactacaaaggatgggagttcgattactaatgacggttgtactcatcctattgggagaagcaaagtcgtccataattttagacaaatctaaagaccaaaatcctctataattatggacagagggagtatgtttatctaccgagaccaaggataatttgtctaaatcacatcaaccaagacaccatgtacacattctctcacagtgcatgcataaattaaaacaccataccaattactccctccattccataataatcagcacataacgaaagtggagatattccgatttgatcagcatattatcgctggtagcatgtgcatgttggatggattaactagttatcacggagatcgagtaggccatgcgattttcgagctgcatgcagcatggaacattccttgcctgtgcaatcatgcagcggcagtaacgtcgtttcgtttctccaagccgattaatatggagattaattacaaggattaaatagaaaacgggtagaggatctctccttggtcttgatgccacaatgaaatatgctgatcattatggaatggagggagtataccttagcatgcacacattcacacattctcccatgctgtactaattgtattatgataaaatccatatctatgcggttatatgatgatcaatttaagaaattttaaatttattatatgatgattaatttgggaatgagggagtaacgtggcagctcaaaagtcac

SEQ ID NO: 4098 - DNA, 2805 bp, Oryza sativa
aaacaacaccaagagaaaaattttttttccaagaaacgaaagcgaaatcaacctgcaattaccagcataaatcaatcaatcggaaaagcagaggccacaacgatctctctctccagtctcgactccccagctaccacctcctctcctctcctctctcctccatgagctttgcctagatcacagctggatttcttggccgcatcctcctcttcttccaggtctcttccagctagctagcttgttcttcccttccctttctttttgccttgtgcgcgtgaggatcagtgagctgtgcggctctcttttcttgttcttgctggactgctgctgccttaaaagatcctgcctttcttgctcactttccccggaggagagagagaggagatccacatctctgatggttcttgggatctcctaggagttgtttctacctgtgctgctgctgctgatttcttcttcgatttgctagcggctgtgtggtcggagctcgtcttcttggttcgagatctcgacaccttctgagatggattttttcaccgagtacggtgagggaaacaggtacaagatagaagaggttataggaaaagggagttatggtgtggtttgctctgctttggacactcacaccggtgataaagttgctatcaagaaaatcaatgacatctttgagcatgtgtccgatgcaacacggatacttcgcgagatcaagttgcttagactcctgcgacatccggatatcgtggaaattaagcatattctacttcctccatcaaggagagaattcaaggatatctacgttgtttttgaactcatggagtctgatttgcaccaagttataaaggccaacgatgacttgactcctgaacactaccagtttttcttgtatcagttgctccgaggactgaaatatatacacacagcaaatgtatttcatcgagatctcaaaccaaaaaatatcttggcgaatgctgattgtaagctcaaaatatgtgatttcggccttgcaagggtagcttttagtgatactccaaccgccatcttctggacggattatattgcaacaaggtggtaccgagcaccagagctgtgtggatcttttttctccaagtatacaccagcaatagatatatggagtattggctgcatatttgccgagcttttaaccggaaaacctcttttccctgggaagaatgtggttcatcaacttgatataattacagatctactaggaacaccttctccagaaacaatatctaggattagaaatgagaaggcaagacgttacttgaacagtatgaggcggaaaaaacctataccatttacacagaagttcccaaatgcagatccacttgcaatgcggttgttagagagaatgttagcttttgatccaaaagatcggccaagtgctgaggaggcgcttgctgatccttatttcaagaacatagccaatgttgatagagagccttctgctcaacctatcacaaagctagagtttgagttcgagaggcggagaattactaaggaagatataagggaactcatatatagagaaattctggagtatcatccaaagatgctgagggagttccttgagggaactgagtccactggtttcatgtacccaagtgcagtagaccattttaaaaaacagtttgcataccttgaagaacattatgccaagggatcaacagcagctccacctgagagacaacataactcattaccaaggccttgtgttgtctattcagataaccggccacaaagcacagccagtgtcactgaggatctttccaggtgtttaatcagagacaacaatctaaaatcacaggattctgcttcagtcggtgcaagcagaatccctcaaggtgctgctgcaagacctggtaaagcagttggttcggtgctgcgttacggtaactgttcgacatccgctgctgagcaacaatatgagcagcgaagggttgttcggaacccagcaattgctccaaacagcagtgttcctctggggagctcataccccagaagaaaccagacctgcaagagtgaaacaggtgatgttgaaaggatcgattccagccaaaccggtccaccgaagccatatgtggcgaacaaactgcctgctaccgtcgatggtcggagtggccactggtaaatttctgcagcgcaccagcgaaaacgctagttattaccacagcatcagcatgggtttattgttctatgtagtaaattcttagacatttaaaacatgtcattctgtacagacttgtattgtttcttgggggcttttccatgataaaaacagtagaattgtactgcaagccctagtggattaggctgcctgtttcttcatttcttcatagctcaacctctgaatgatctggtacacaaacaagatctcatggaattggacatcacatgattcagttcgaagggggtatagtggaaactggaagcaacaagtggactgtaacattttcttgctgagaaaacaagggactctttactgacctgactgatgctgctattcaatttattttccaagtaaatccgaagaaggatcatgtaaacagcacaatgttggacattgctttagtatttcgttctcaggaacattgttccctttgcagagctaggagctgcaactatgtactactatctgacattgctgtaacttgtaaaacttaattgcatttcaagtattttccctcctttagcctgtaattcagctctagtatttgaactactatgtttcaaattactttggtgttcaagctttgttctaagtcaaaaatttatatctttgac

SEQ ID NO: 4099 - DNA, 2388 bp, Oryza sativa
aaaatcattgcgagtcgatagcatctcccccgtccctccgcgtcaaaggaaaatctcccgtcttcgtctccgctccctgcgcccgcgccgatctccatctcgcgagcacagcagccgcgccgtcgtcctcgttaactgtctgaaatggacttctttaccgagtatggtgaggggaacaggtataagatagaagaggtcataggaaaagggagttacggtgtagtatgctccgcgctggatactcatactggtgagaaagttgctatcaagaagattaatgacatttttgaacatgtgtctgatgctactcggatacttcgtgaaatcaagttgctccggctactgcgacacccagatatcgtggaaataaaacatattttgcttcctccgtcgaggagagaattcaaggacatttatgttgtttttgaactcatggagtctgatttgcaccaagttataaaggccaacgacgacttgactccagaacactaccagtttttcctctatcagttgcttcgaggattgaagtacatacatacagcaaatgtgtttcaccgagatcttaaaccaaaaaatattttggcaaatgctgattgtaagctcaaaatatgtgattttggccttgcaagagttgctttcagtgatacaccaactgccatcttttggacggattatgttgcaacaaggtggtatcgtgcacctgaactttgtggatcttttttctctaagtacacaccagcaatagatatatggagcatcggttgcatatttgcagaacttttaacaggaaaacctcttttccccgggaaaaatgtggtgcatcaacttgatataattacagatcttttggggacaccttctacagaagcaatatctaggattcgaaatgagaaggccaggcgatatttgagcagtatgagacgcaaaaagcctataccatttactcagaagttcccaaatgcagatccacttgcattacgtttgttggagagaatgctatcttttgagcccaaagataggccaaatgctgaagaggctcttgccgatccttatttcagaaacatagcaaatgtagatagagaaccttcagcacagcctgtgacaaagctggaatttgagtttgaaaggaggaggattacaaaggaagatataagggaactcatctatagagatattctggagtatcatccaaatatgttgagggaataccttgaagggactgagtcagctggtttcatgtaccctagtgcggtagatcattttaaaaagcagtttgcatatcttgaagaacattatgctaagggatcaacagcagctccacctgagaggcaacataactctttaccaagaccttctgtgttatattcggatgaccgtccacaaaacacagccaacatcgccgaggatctttcaaaatgtgtacttggagataatacacaaaaaatgcatcaaggttctgcttctgtttgtgcgaatagagttcctcaaggtggtgctgcaagacctggtaaagttgttggttctgcgcttcgatatggtaactgctcaacatctactgctgagcaatatgagcatcgacgaaccgatagaaacccagcattggctactaacactgtttctccccgaggctcttacccctgaagaaatccatcctgcaagactgaaacaggtgattctgaaaggatcgatgtgaaccaagctgggcaaccaaagccatacataccaaacaaactacctgctactgttgatggccggagcgcccactggtaggcaacaaggtatgtgtgcgcaaatgaaacagcaaatcctttgccttaccaaggttccgaggcatcggcgcggattaccatttctaagttgttacatgctgacacattcaaagatactattctgtacagagttgtattaattacagatcttggtatgctctagaagactgaagactaaagtactatagaaatatatttcatatcctgcgtgataggctgctagtttccgttctttttggatcggttgcaaaaatacccacagcagaagcttacacggtatctactacagttcatggtatacgcatagattacaacttctgacttgactctgtagttcatcactttgttcttaaagctggtgacttcacatcgtctgattgttgattaaacgtggaagttttgaagccctggagtatcttggaatgcttctagtaagctgtcattcaaatgtaatatttaactatatcattttgtagacttttcaacactattagctgggaagattatgttaatttgagatgcttttctctccccctccttttgatgtgatatggagttgtctcatgctcagcttttcttgaaagcatatgaagatcaaatgtgcaagttcatctttacc

SEQ ID NO: 4100 - DNA, 2302 bp, Oryza sativa
aaaatcattgcgagtcgatagcatctcccccgtccctccgcgtcaaaggaaaatctcccgtcttcgtctccgctccctgcgcccgcgccgatctccatctcgcgagcacagcagccgcgccgtcgtcctcgttaactgtctgaaatggacttctttaccgagtatggtgaggggaacaggtataagatagaagaggtcataggaaaagggagttacggtgtagtatgctccgcgctggatactcatactggtgagaaagttgctatcaagaagattaatgacatttttgaacatgtgtctgatgctactcggatacttcgtgaaatcaagttgctccggctactgcgacacccagatatcgtggaaataaaacatattttgcttcctccgtcgaggagagaattcaaggacatttatgttgtttttgaactcatggagtctgatttgcaccaagttataaaggccaacgacgacttgactccagaacactaccagtttttcctctatcagttgcttcgaggattgaagtacatacatacagcaaatgtgtttcaccgagatcttaaaccaaaaaatattttggcaaatgctgattgtaagctcaaaatatgtgattttggccttgcaagagttgctttcagtgatacaccaactgccatcttttggacggattatgttgcaacaaggtggtatcgtgcacctgaactttgtggatcttttttctctaagtacacaccagcaatagatatatggagcatcggttgcatatttgcagaacttttaacaggaaaacctcttttccccgggaaaaatgtggtgcatcaacttgatataattacagatcttttggggacaccttctacagaagcaatatctaggattcgaaatgagaaggccaggcgatatttgagcagtatgagacgcaaaaagcctataccatttactcagaagttcccaaatgcagatccacttgcattacgtttgttggagagaatgctatcttttgagcccaaagataggccaaatgctgaagaggctcttgccgatccttatttcagaaacatagcaaatgtagatagagaaccttcagcacagcctgtgacaaagctggaatttgagtttgaaaggaggaggattacaaaggaagatataagggaactcatctatagagatattctggagtatcatccaaatatgttgagggaataccttgaagggactgagtcagctggtttcatgtaccctagtgcggtagatcattttaaaaagcagtttgcatatcttgaagaacattatgctaagggatcaacagcagctccacctgagaggcaacataactctttaccaagaccttctgtgttatattcggatgaccgtccacaaaacacagccaacatcgccgaggatctttcaaaatgtgtacttggagataatacacaaaaaatgcatcaaggttctgcttctgtttgtgcgaatagagttcctcaaggtggtgctgcaagacctggtaaagttgttggttctgcgcttcgatatggtaactgctcaacatctactgctgagcaatatgagcatcgacgaaccgatagaaacccagcattggctactaacactgtttctccccgaggctcttacccctgaagaaatccatcctgcaagactgaaacaggtgattctgaaaggatcgatgtgaaccaagctgggcaaccaaagccatacataccaaacaaactacctgctactgttgatggccggagcgcccactggtaggcaacaaggtatgtgtgcgcaaatgaaacagcaaatcctttgccttaccaaggttccgaggcatcggcgcggattaccatttctaagttgttacatgctgacacattcaaagatactattctgtacagagttgtattaattacagatcttggtatgctctagaagactgaagactaaagtactatagaaatatatttcatatcctgcgtgataggctgctagtttccgttctttttggatcggttgcaaaaatacccacagcagaagcttacacggtatctactacagttcatggtatacgcatagattacaacttctgacttgactctgtagttcatcactttgttcttaaagctggtgacttcacatcgtctgattgttgattaaacgtggaagttttgaagccctggagtatcttggaatgcttctagtaagctgtcattcaaatgtaatatttaactatatcattttgtagacttttcaacactattagctgggaagattatgttaatttgagatgcttttctctccc

SEQ ID NO: 4101 - DNA, 2459 bp, Brachypodium distachyon
gacggcagaggccagcggtttgccttcttctcttcctttttcccgactcctcagctaccaccaccgcccctctccccctttctctctcctcgagctttgcttggatcgcagctggacctggactccgcggccgcggcctttcccctcgtcctgcgcgtcagcagcaaacatccgagatggattttttcactgagtatggtgagggaaatagatacaagatagaagaggtcataggaaaaggaagttacggtgtggtttgctcagctctggatactcacacgggtgacaaagttgctatcaagaagataaatgacatctttgaacatgtgtctgatgcgacacggatactccgcgagatcaagttgcttagactcctgaggcatccggatattgtggaaataaaacatatattacttcctccgtcaaggagagagttcaaggatatatatgttgtttttgaactcatggagtctgatttgcaccaagttataaaggctaatgatgacttgactccagaacattatcagtttttcttgtatcagctgctccggggattgaagtacatacatacagcaaatgtatttcatcgagatctcaaaccaaagaatatcttggcaaatgcggattgtaagctcaaaatatgtgattttggccttgcaagggtagctataagtgatactccaactgccatattttggacggactatattgcaacaaggtggtaccgagcacctgaactgtgcggatcctttttctccaagtatacaccagcgatagatatatggagtatcggctgtatatttgcagaactactaactggaaaacctcttttccctgggaaaaatgtggtgcatcaacttgatataattacagatctcctggggacaccttctgcagagacaatagctaggattcgaaatgagaaggcccggcgctacttgagcagtatgaggcggaaaaagactgtaccatttacacagaagtttccgaatgcagacccacttgcattaaatttgttagagagaatgctagcgtttgatccaaaagatcggccaagtgctgaagaggcccttgctgatccttatttcaagaacatagctagtgtggatagagagccttccgcacagcccattacgaagctggaatttgagtttgaaaggcgaagaattacaaaggatgacataagggaactaatatacagagaaattctagaatatcatccaaacatgctgagggaattccttgagggggctgagccaactggtttcatgtacccaagtgcagtagatcattttaaaaagcaatttacattccttgaggagcattatgccaagggatcaacagcagctccgcctgagaggcaacacaattcattaccaagaccgtctgttatctattcggataaccggccacaaaatgctgccaacatcactgatgatctttctaggtgcgcaatcagagataatacacaaaaggcacagaaagattctgcttcagttggggcaaacagaattccccatggtgctgctgctgctgccgcaaggcctgggaaagtggttggttcagtgctacgctatggtaactgttcaacatctggtactgagcaatatgaacagcgaagggttgtcagaagcccgggaatcgctccaaacggtgtaacttcgggcagctcataccccagaagaaacaacacctgcaagagcgaaacaggtgaagctgaaaggatcgatacaaaccaaggtgggccaccaaagccatatgtagcaaataaactacctgctaccgttgatggtcgcaacgggcactggtagactattgcaacataccagaaaaaacccttgtcatgacgtcagcaggggttactcactcggaaatctatgtccacgttcaaacatgtcatctgtacagacttatattatttgtccggtttagatatctgaaagaacataagactgcactcctaagtcctcacgacaatccagttgttcccactttgctgttagctcaatccctgaataatctggtacagaagattacctacaattcggtaaattcagttcaactgttcgaaaaagtatagtggaaactggatactctggggcctgaaacaaatggacagttactgacctgactgatggtgtttctcaatttgttctccagctggtgtctgatgaagggtgaaagagctcattgtacactatctaatgttgtaacttgtaagctaaacgacttcatagtatgttcctgctgctagtagttcagtcagttgtagtattgaattattgaacgattttatgtttctgataaaacatttgaggactactcactattgatatatgatctgtaatatgaaccatcaagtattctgaatgaacaaaaagcataatttctgagattgtacgtctgagaatgtgttagttgcgacaactgatttagtgaatggatattttcttttggtg

SEQ ID NO: 4102 - DNA, 2279 bp, Setaria italica
gggaaaaaccgcaaagctgccgactgcgagcacgaggcaaccgtccctcgtcctcccacccctcagctggatcctccgccgccgcatcctcagtccgcttacccttccgcagccgccacagcgctggccctcccttgcggacgtggattggtgcccccacctcttctcctggcatcccctgaatggattttttcactgagtatggtgagggaaacagatacaagatagaagaggtcataggaaaagggagttatggtgtggtttgctctgctttggatactcacactggtgaaaaagttgcaataaagaagataaatgacatctttgaacatgtgtctgatgcaacacggatacttcgggagatcaagctgcttcggctcctgcgacatccggatattgtagaaataaaacacattttacttcctccatcaaggagggaattcaaggatatatatgttgtgtttgaactcatggagtctgatttgcaccaagttataaaggctaatgatgacttgactccagaacactatcaatttttcctgtatcagttacttcgaggattgaaatacatacatacagcaaatgtgttccacagagacctaaagcccaaaaatattttggcgaatgctgattgcaagctcaaaatatgtgattttggacttgcaagagtagctttcagtgatactccgactgccatcttctggacggattatgttgcaacaagatggtaccgagcacctgagctgtgtggatcttttttctccaagtacactccagcaatagatatatggagcatcggctgtatatttgcagagcttttaactggaaaacctctcttccctgggaaaaatgttgtacatcaacttgatataattacagatctcctgggtacaccatctcctgaagcaatctctaggattcgaaacgagaaggcaaagcgctacctgagcagcatgaggcggaaaaagcctataccgtttactcataaatttccaaatgcagatccacttgcattacgtttattggagaggatgctagcttttgatccaaaagatcggccaagtgcggaggaggcccttgctgacccgtatttcaagaacatagctaatgtggatagagaaccagccgcacagccggtcatgaagctggaatttgagtttgagaggcggaggattacaaaagaagatatcagggaactcatctacagagaaattctggagtatcatcctaatatgttgagagaattccttgaggggactgagtcaactggtttcatgtacccaagtgccgtggatcattttaagaagcaatttgcatatcttgaagaacattatgcaaagggatcaacagcagctccacctgaaaggcaacataactctctaccaaggcctagcgtgttatactcggataaccgaacccaaagcacaaccaatgtcacggaggatctttcaaagtgtgtaatcagagatgatgcacggagagcacagctagattcttcctctgttggtgcaaatagagttcctcaaggtggtgctacgaggcctgctagaggggttggttctgcagagcgttatggtaattatgcatcacctgctgctgaccaatatgaacagagacgaatagctaatggtgtctcacctagaagctcataccccaaaagaattcctacctgcaagggcgaaacaagtgaggctgacaggattgatgtgagacaaactgggcaaccaaagccatacataccaaacaaactacctactacagttgatggccggaatggccactggtagctttacctgcaattcatcagcaatctgaaccaagcatctgcagttctcttgtggaaggtatctccaagacatgacacattctaaaaaggatgttctgtatagagttctcacatttttcaggacgggtacaccctgaagcactgcagacctaattcaagcaggcatggcaggctgcttgatttttacgtacattgggtcaaccattagacttgtccacattgctagctgattgattcagatttaacgtggtagggtgtatagtgaaaactttgtggcactagcagcatggggctgctactgacatagctgatgatgctgatcaatttgttcttgaagctggtggctccagactctgaattatgcacatggtcttattgttgtaaaatgtaacatatggagtttgaatttgaacagtcaaattttcctgtagccttttgttcaaatgtaataatatttattttttgaacggaatgaagatgcagatttgtgcaa

SEQ ID NO: 4103 - DNA, 2411 bp, Hordeum vulgare
ttcggcacgaggcctcgtgccgaattcggcacgaggcaccgcccccctcccctcccctctgtcctcgagcttcgccttggatcgcagcgcagcgcagcgcagctggacgaggactccttccctcggccgcggccccctccccctcgtcgcgcgcgcgagtgagcgaacatctcaaatggacttttttaccgagtatggtgaggggaacagatacaagatagaagaggttataggaaaggggagttatggcgtggtctgctctgctttggatactcacacgggtgagaaagttgctatcaagaagatcaatgacatctttgagcatgtgtctgatgccacacggatactccgcgagatcaagttgcttaggctcctaagacatcccgatattgtggaaattaaacatattctacttcctccgtcgaggagagagttcaaggatatatacgttgtttttgaactcatggaatctgatttgcaccaagttataaaggcaaatgatgacttgactccggaacattatcagtttttcttgtatcagttgctccggggattgaaatacatacatacagcaaatgtatttcatcgcgatctcaaaccaaagaatatcttggctaatgctgattgtaagctcaaaatatgtgactttggtcttgcaagggtagctataagtgatactccaactgccatattttggacggattatatcgcaacaaggtggtaccgagcacctgaactatgtggatcttttttctccaagtacacaccagcaatagatatatggagtattggatgtatatttgcggaacttctaactggcaaacctctttttcctgggaaaaatgtggtgcatcaacttgacataatcacagacctcctgggaacgccttctccagaaacaattgctaggattcgaaatgagaaggccaggcgctacttgagcagcatgaggcggaaaaagcctgtaccgtttacgcagaagtttccgaatgcagatccacttgcattaaatttgttggagagaatgctagcatttgatccaaaagaccggccaagtgctgaagaggctcttgctgatctttatttcaagaacatagctagtgtggatagggagccttctgcacagcccatcactaagcttgaattcgagtttgagaggcgaagaattacgaaggacgacataagggaactcatatacagagaaattctggaatatcatccaaacatgctgagggaattccttgagggggctgagccaactggtttcatgtacccaagtgcagtagatcatttcaaaaaacaattcacattccttgaagagcattatgcaaagggatcaacagcagcaccgcctgagaggcaacataattcattaccaaggcctagtgttatcttttcggataaccgaccacagggttcagatagccgaccacagggtgcagccaacattaccgatgacctttccaggtgtataatcagagataatacacaaaagccacgcagagatactgcttcagttggtgcaaacagagttcctcaaggtgctgctgtcgcaagacctggtaaagtggttggttcggcacttcgttatggtaactgttcaacatctggtactgagcaatatgaacagcgaagggttatcacaggccaaggaattgttccaaacggcgttccttcaggcagctcataccctagaagaaataacacctgcaagagcgaaacaggtgaagctgaaaggatcgacgtgagccaagctgggccaccaaagccatatacaggaaataaactacctgcaaccgtggatggccgcaacgggcactggtagacttctcttccaatgtcagaaaatccttgtcactggatcaggaagggttactcattccaagggcacaccttcaaacatggcattctgtacagagttatattatctgtcacgcttacatctcccggagacgatagaaccgcatgctaagtcgttgcggcaggctagtctcctgttaagctcaaactctgctctggttacctgcaattgggtagatccagttcagctgttcaacaagtataaccaaaaactgaagcttcgagcggcattcgcgacaagggactgttactgaccttactgatggtgttcctcaatttgttttttcaagctggtggtcctgagggaggttctgagagcccactgtacactatctaatgttgtaacacggagttgattaattgactttaaagtatgttcttgttgcttgtagtctgtcatccagctgtagtattgaactattgaacactgctatttctgataacacattatttggaccctgctcgctattgaaacccccaggttttttgtgcggaatttgtaataatgtatgcagtaatttagtagcccgagtaaaaacggagttgcgacc

SEQ ID NO: 4104 - DNA, 2431 bp, Secale cereale
gactaccgccccctcccctctgtcctcgagcttcgccttggatcgcagcgcagctgggctcctcccctcggccgcctcccccctcgtcgtgcgcgcgcgtgagcgaacatctcaaatggacttttttaccgagtatggtgagggaaacagatacaagattgaagaggttataggaaaagggagttatggcgtggtctgctctgctttggatactcacacgggtgagaaagttgctatcaagaagataaatgacatctttgaacatgtgtctgatgcgacgcggatactccgcgagatcaagttgcttaggctcctaagacatcccgatatcgtggaaataaaacatattctacttcctccatctaggagagagttcaaggatatatacgttgttttcgaactcatggaatctgatttgcaccaagtcataaaggccaatgatgacttgactccggaacattatcagttcttcctgtatcagttgctccgaggattgaaatacatacatacagcaaatgtatttcatcgagatctcaaaccaaagaatatcttggctaatgctgattgtaagctcaaaatatgtgacttcggtcttgcaagggtagctataagtgatactccaaccgccatattttggacggattatatcgcaacaaggtggtaccgagcacctgaactatgtggatcttttttctccaagtacacaccagcaatagatatatggagtattggatgtatatttgcggaacttctaactggcaaacctctttttcctgggaaaaatgtggtgcatcaacttgatataatcacagatctcctgggaacgcctgctccagaaacaattgctaggattcgaaatgagaaggccaggcgctacttgagcagtatgaggcggaaaaagcttgtaccgttcacgcagaagtttccaaatgcagatccacttgcattaaatttgttagagagaatgctagcatttgatccaaaagacaggccaagtgctgaagaggctcttgctgatctttatttcaagaacattgcgagtgtggatagggagccttctgcacagcccattactaagcttgagttcgagtttgagagacgaagaattacgaaagacgacataagggaactcatatacagagaaattctggaatatcatccaaacatgctgagggaattccttgaggggccgagccaactaatttcatgtacccaagtgcagtagatcatttcaaaaagcaattcacattccttgaagagcattatgcaaagggatcaacagcagcaccgcctgagaggcaacataattcattaccaaggccgagtgtcatctattcggataaccggtcacagggttcagatagccgaccacagggtgctgccaacattacggatgatctttccaggtgtataatcagagataatgcacaaaagccacgcagagatcctgcttcagttggtgcaaacagagttcctcaaggagctgctgtcgcaaggcctggtaaagtggttggttcggcacttcgttatggtaactgttcaacatctggtaccgagcaatatgaacagcgaagggtcatcacaagccaaggaattgttccaaacggtgttccttcgggcagctcataccctagaagaaataacacctgcaagagcgaaacaggtgaagctgaaaggatcgacgtgagccaagctgggccaccaaagccatatactggaaataaactacctgcaactgtggatggccgcaacgggcactggtagactgctgtggcaatgccagaaaatccttgtcactggatcaggaagggttactcactccaaggaggcaccttcaaacatgccattctgtacagagttatattatctgtcacggttacatctcccggagacgatagatctgtatgcaaggtcgttgtggcaggctagtctcctgttaagctcaactctggtctggttacctgcaattgggtagatccagttcaactgttcaacaagtataaccaaaaactgaagcttggagcggcattcgcaacaaaaggattgttactgacctgactgatggtgttcctcaatttgtttctccaagctggtggccctgagggagggtcagagagcccactgtacactatctaatgttgtaacacggagttaattaattgactttaaagtatgttcttgttgcttggtagtctgtcatccagctgtagtattgaactattgaacactgctatttctgataacacattatttggaccctgctcgctattgaaaccccaggttttttgtgcggaatttgtaatatgtatgcagtaatttagtagcctgagtaaaaacagaagttgcgaataagaaaaaaaaaaaaaaaaaaaaaaaaaaaaactaacgaaagagtacgcgaacgagacacacggaggtagagggggggggg

SEQ ID NO: 4105 - DNA, 2419 bp, Triticum aestivum
aattcggcacgaggccttctctctcctgactgcccagctaccgccgcccccctccctcccctctgtcctcgagcttcgccttggatcgcagcgcagcgcagcgcagctggactcctcccctcggccgcgtcccccctcgtcctgcgcgcgcgtgagcgaacatctcaaatggacttttttactgagtatggtgagggaaacagatacaagatagaagaggttataggaaaagggagttacggcgtggtctgctctgctttggatactcacaccggtgagaaagttgctatcaagaagataaacgacatctttgaacatgtgtctgatgcgacacggatactccgcgagatcaagttgcttaggctcctaagacatcccgatatcgtggaaataaaacatattctacttcctccatcgaggagagagttcaaggacatatacgttgttttcgaactcatggagtctgatttgcaccaagttataaaggcgaatgatgacttgactccagaacattatcagtttttcttgtatcagttgctccgaggattgaaatacatacatacagcaaatgtatttcatcgagatctcaaaccaaagaatatcttggctaatgctgattgtaagctcaaaatatgtgatttcggtctcgcaagggtagctataagtgatactccaaccgcaatattttggacggattatatcgcaacaaggtggtaccgagcacctgagctatgtggatcttttttctccaagtatacaccagcaatagatatatggagtattggatgtatatttgcggaacttctaactggcaaacctctttttcctgggaaaaatgtggtgcatcaacttgatataatcacagacctcctcggaacgcctgctccagaaacaattgctaggattcgaaatgagaaggccaggcgctacttgagcagtatgaggcggaaaaagcctgtaccgtttacgcagaagtttccgaatgcagatccacttgcattaaatttgttagagagaatgctagcatttgatccaaaagaccggccaagtgctgaagaggctcttgctgatctttatttcaagaacatagctagtgtggatagggagccttctgcacagcccattactaagcttgaattcgagtttgagagacgaagaattacgaaggacgacataagggaactcatatacagagaaattctggaatatcatccaaacatgctgagggaattccttgagggggcagagccaactaatttcatgtacccaagtgcagtagatcatttcaaaaaacaattcacattccttgaagagcattatgcaaagggatcaacagcagcaccgcctgagaggcaacataattcattaccaaggccgagtgttatctattcggataaccgaccacagggttcagatagccggccacagggtgcagccaacattacggatgatctttccaggtgtataatcagagataatacacaaaagccacgcagagatcctgcttcagttggtgcaaacagagttcctcaaggtgctgctgtcgcaaggcctggtaaagtggttggctcggcacttcgttatggtaattgttcaacacctggtactgagcaatatgaacagcgcagggtcatcacaagccaaggagtcgttccaaacggtgttccttcaggcagctcataccctagaagaaataacacctgcaagagcgaaacaggtgaagctgaaaggatagacgtgagccaagctgggccaccaaagccatatacaggaaataaactacctgcaaccgtggatggccgcaacgggcactggtagactgctgtggcaatgccagaaaatccttgtcactggatcaggaagggtttactcattccaaggacacaccttcaaacatgccattctgtatattatctgtcacgcttacatctcccggagacgataaaactgtatgcgaagtcattgtggcaggctagtctcctgttaagctcaactctggtctggttacctgcaattgggtagatccagttcagctgttcaacaagtgtaaccaaaaaactggaaactttgagcggcattcgcgaccaaggactgttactgacctgactgatggtgttcctcaattcgtttctccaagctggtggccctgagggaggttcagagagcccattgtacactatctaatgttgtaacacggagttaattaattgactttaaagtatgttcttgttgcttgtagtcttgtcatccagctgtagtattgaactattgaacactgctatttctgataacacattatttggaccctgctcgctattgaaaccccaggttttttgtgcggaatttgtaatgtgatatgcagtaagttagtagcccgagcaaaacggagttgcgacgtatgtttcctgaactgcgcaac

SEQ ID NO: 4106 - DNA, 2320 bp, Secale cereale
ttccgaaagcggaggccaccggtggccttctctctcctgacttcccagctaccaccgcccccctcccctctgtcctcgagcttcgccttggatcgcagcgcagctcggctcctcccctcggccgcctccccctcgtcgtgcgcgcgcgtgagcgaacatctcaaatggacttttttaccgagtatggcgagggaaacagatacaagattgaagaggttataggaaaagggagttatggcgtggtctgctctgctttggatactcacacgggtgagaaagttgctatcaagaagataaatgacatctttgaacatgtgtctgatgcgactcggatactccgcgagatcaagttgcttaggctcctaagacatcccgatatcgtggaaataaaacatattctacttcctccgtcgaggagagagttcaaggatatatacgttgttttcgaactcatggaatctgatttgcaccaagttataaaggccaatgatgacttgactccggaacattatcagtttttcttgtatcagttgctccgaggattgaaatacatacatacagcaaatgtatttcatcgagatctcaaaccaaagaatatcttggctaatgctgattgtaagctcaaaatatgtgacttcggtcttgcaagggtagctataagtgatactccaactgccatattttggacggattatatcgcaacaaggtggtaccgagcacctgaactatgtggatcttttttctccaagtacacaccagcaatagatatatggagtattggatgtatatttgcggaacttctaactggcaaacctctttttcctgggaaaaatgtggtgcaccaacttgatataatcacagatctcctgggaacacctgctccagaaacaattgctaggattcgaaatgagaaggccaggcgctacttgagcagtatgaggcggaaaaagcttgtaccgttcacgcagaagtttccaaatgcagatccacttgcattaaatttgttagagagaatgctagcatttgatccaaaagacaggccaagtgctgaagaggctcttgctgatctttatttcaagaacattgcgagtgtggatagggagccttctgcacagcccattactaagcttgagttcgagtttgagagacgaagaattacgaaagacgacataagggaactcatatacagagaaattctggaatatcatccaaacatgctgagggaattccttgagggggccgagccaactaatttcatgtacccaagtgcagtagatcatttcaaaaagcaattcacattccttgaagagcattatgcaaagggatcaacagcagcaccgcctgagaggcaacataattcattaccaaggccgagtgttatctattcggataaccggccacagggttcagatagccgaccacagggtgctgccaacattacggatgatctttccaggtgtataatcagagataacgcacaaaagccacgcagagatcctgcttcagttggtgcaaacagagttcctcaaggtgctgctgtcgcaaggcctggtaaagtggttggttcggcacttcgttatggtaactgttcaacatctggtactgagcaatatgaacagcgaagggtcatcacaagccaaggaattgttccaaacggtgttccttcgggcagctcataccctagaagaaataacacctgcaagagcgaaacaggcgaagctgaaaggatcgacgtgagccaagctgggccaccaaagccatataccggaaataaactacctgcaaccgtggatggccgcaacgggcactggtaggctgctgtggcaatgccagaaaatccttgtcactgaatcaggaagggttactcattccaaggacacaccttcaaacatgccattctgtacagagttatattatctgtcacggttacatctcccggagacgatagtactgtatgcgaggtcgtggtggcaccgtggcaggctagtctcctgttaagctcaactctggtctggttacctgcaattgggtagatccagttcaacaagcataaccaaaaactgaagcttcgagcggcattcgcaacaaaaggattgttactgacctgactgatggtgttcctcaatttgtttctccaagctggtggccctgagggaggttcagagagcccactgtacactatctaatgttgtaacacggagttaattaattgactttaaagtatgttcttgttgcttggtagtctgtcatccagctgtagtattgaactattgaacactgctatttctgttaacacattatttggaccctgctcgctatt

SEQ ID NO: 4107 - DNA, 2421 bp, Secale cereale
gactaatctagttaagcaaagagagaaataaatctccggtataaattccgaaagcggaggccaccggtggccttctctctcctgacttcccagctaccaccgcccccctcttctctgtcctcgagcttcgccttggatcgcagcgcagctgggctcctccccccgcccgtcgtcgtgcgcgcgcgtgagcgaacatctcaaatggacttttttaccgagtatggcgagggaaacagatacaagattgaagaggttataggaaaagggagttatggcgtggtctgctctgctttggatactcatacgggtgagaaagttgctatcaagaagataaacgacatctttgaacatgtgtctgatgcgacgcggatactccgcgagatcaagttgcttaggctcctaagacatcccgatatcgtggaaataaaacatattctacttcctccgtcgaggagagagttcaaggatatatacgttgttttcgaactcatggagtctgatttgcaccaagttataaaggccaatgatgacttgactccggaacactatcagtttttcttgtatcagttgctccgaggattgaaatacatacatacagcaaatgtatttcatcgagatctcaaaccaaagaatatcttggctaatgctgattgtaagctcaaaatatgtgacttcggtctcgcaagggtagctataagtgatactccaaccgccatattttggacggattatatcgcaacaaggtggtaccgagcacctgaactatgtggatcttttttctccaagtacacaccagcaatagatatatggagtattggatgtatatttgcggaacttctaactggcaaacctctttttcctgggaaaaatgtggtgcatcaacttgatataatcacagatctcctgggaacgcctgctccagaaacaattgctaggattcgaaatgagaaggccaggcgctacttgagcagtatgaggcggaaaaagcttgtaccgttcacacagaagtttccaaatgcagatccacttgcattaaatttgttagagagaatgctagcatttgatccaaaagacaggccaagtgctgaagaggctcttgctgatctttatttcaagaacattgcgagtgtggatagggagccttctgcacagcccattactaagcttgagttcgagtttgagagacgaagaattacgaaggacgacataagggaactcatatacagagaaattctggaatatcatccaaacatgctgagggaattccttgagggggccgagccaactaatttcatgtacccaagtgcagtagatcatttcaaaaagcaattcacattccttgaagagcattatgcaaagggatcaacagcagcaccgcctgagaggcaacataattcattaccaaggccgagtgttatctattcggataaccggccacagggttcagatagccgaccacagggtgctgccaacattacggatgatctttccaggtgtataatcagagataacgcacaaaagccacgcagagatcctgcttcagttggtgcaaacagagttcctcaaggtgctgctgtcgcaaggcctggtaaagtggttggttcggcacttcgttatggtaactgttcaacatctggtactgagcaatatgaacagcgaagggtcatcacaagccaaggaattgttccaaacggtgttccttcgggcagctcataccctagaagaaataacacctgcaagagcgaaacaggcgaagctgaaaggatcgacgtgagccaagctgggccaccaaagccatataccggaaataaactacctgcaaccgtggatggccgcaacgggcactggtaggctgctgtggcaatgccagaaaatccttgtcactgaatcaggaagggttactcattccaaggacacaccttcaaacatgccattctgtacagagttatattatctgtcacggttacatctcccggagacgatagtactgtatgcgaggtcgtggtggcaccgtggcaggctagtctcctgttaagctcaactctggtctggttacctgcaattgggtagatccagttcaacaagcataaccaaaaactgaagcttcgagcggcattcgcaacaaaaggattgttactgacctgactgatggtgttcctcaatttgtttctccaagctggtggccctgagggaggttcagagagcccactgtacactatctaatgttgtaacacggagttaattaattgactttaaagtatgttcttgttgcttggtagtctgtcatccaactgtagtatcgaactattgaacactgctatttctgataacacattatttggaccctgctcgctattgaaaccccaggttttttgtgcggaatttgtaatttgtatgcagtaatttagtagcctgagtaaa

SEQ ID NO: 4108 - DNA, 2312 bp, Secale cereale
gctaccaccgcccccctcccctctgtcctcgagcttcgccttggatcgcagcgcagctcggccgcctcccccctcgtcgtgcgcgcgcgtgagcgaacatctcaaatggacttttttaccgagtatggcgagggaaacagatacaaaattgaagaggttataggaaaagggagttatggcgtggtctgctctgctttggatactcacacgggtgagaaagttgctatcaagaagataaacgacatctttgaacatgtgtctgatgcgacgcggatactccgcgagatcaagttgcttaggctcctaagacatcccgatatcgtggaaataaaacatattctacttcctccgtcgaggagagagttcaaggatatatacgttgttttcgaactcatggagtctgatttgcaccaagttataaaggccaatgatgacttgactccggaacattatcagtttttcttgtatcagttgctccgaggattgaaatacatacatacagcaaatgtatttcatcgagatctcaaaccaaagaatatcttggctaatgctgattgtaagctcaaaatatgtgacttcggtctcgcaagggtagctataagtgatactccaaccgccatattttggacggattatatcgcaacaaggtggtaccgagcacctgaactatgtggatcttttttctccaagtacacaccagcaatagatatatggagtattggatgtatatttgcggaacttctaactggcaaacctctttttcctgggaaaaatgtggtgcatcaacttgatataatcacagatctcctgggaacgcctgctccagaaacaattgctaggattcgaaatgagaaggccaggcgctacttgagcagtatgaggcggaaaaagcttgtaccgttcacgcagaagtttccaaatgcagatccacttgcattaaatttgttagagagaatgctagcatttgatccaaaagacaggccaagtgctgaagaggctcttgctgatctttatttcaagaacattgcgagtgtggatagggagccttctgcacagcccattactaagcttgagttcgagttcgagagacgaagaattacgaaggatgacataagggaactcatatacagagaaattctggaatatcatccaaacatgctgagggaattccttgagggggctgagccaactaatttcatgtacccaagtgcagtagatcatttcaaaaagcaattcacattccttgaagagcattatgcaaagggatcaacagcagcaccgcctgagaggcaacataattcattaccaaggccgagtgtcatctattcggataaccggccacagggttcagatagccgaccacagggtgctgccaacattacggatgatctttccaggtgtataataagagataatgcacaaaagccacgcagagatcctgcttcagttggtgcaaacagagttcctcaaggtgctgctgtcgcaaggcctggtaaagtggttggttcagcacttcgttatggtaactgttcaacatctggtactgagcaatatgaacagcgaagggtcatcacaagccaaggaattgttccaaacggtgttccttcgggcagctcataccctagaagaaataacacctgcaagagcgaaacaggtgaagcggaaaggatcgacgcgagccaagctgggccaccaaagccatatactggaaataaactacctgcaacagtggatggccgcaacgggcactggtagacttctgtggcaatgccagaaaatccttgtcactgaatcaggaagggttactcattccaaggacacaccttgaaacatgtcattctgtacagagttatattatctgtcacggttacatctcccggagacgtagaactgtatgcgaggtcgttgcggcaggctagtctcctgttaagctcaactctggtctggttacctgcaattgggtagatccagttcaactgttcaacaagtataaccaaaaactgaagcttcgagcggcattcgcaacaaaaggattgttactgacctgactgatggtgttcctcaatttgtttctccaagctggtggccccgagggaggttcagagagcccactgtacactatctaatgttgtaacacggagttaattaattgactttaaagtatgttcttgttgcttgtagtctgtcatccagctgtagtattgaactattgaacactgctatttctgataacacattatttggaccctgctcgctattgaaaccccaggttttttgtgcggaatttgtaatatgtatgcagtaatttagta

SEQ ID NO: 4109 - DNA, 2254 bp, Sorghum bicolor
aataaactcgcaaagctgccgactgcgagcacgaggccgccgtcctttgtcatcctctcgtttcagctggatcctccgccgccgcatcctcagctcgctgctgccgtcaccacagcgctggctcctccgtcacgggcgtggatttgttccccttttctggcatcccctgaatggattttttcactgagtatggtgagggaagcaggtacaagatagaagaggtcataggaaaaggaagttacggtgtggtttgctctgctttggacactcacactggtgaaaaggttgcaataaagaagataaatgaaatatttgaacatgtgtctgatgcaacacgtatacttcgtgagatcaagctgcttcggctcctgcgacatccggatattgtagaaataaaacatattttacttcctccatcaaggagggaattcaaggatatatatgttgtgtttgaactcatggagtctgatttacaccaagttataaaggctaatgatgacttaactccagaacactatcaatttttcctgtatcaattacttcgaggattgaagtacatacatacagcaaatgtgtttcaccgagacctaaaaccaaaaaatattttggccaatgctgattgcaagcttaaaatatgtgattttggacttgcaagagtagctttcaatgatactcctactgccatcttctggacggattatgttgcaacaagatggtaccgagctcctgagctgtgtggatcttttttctctaagtatactccagcaatagatatatggagcattggctgtatatttgcagagcttttaactggaaaacctctcttccctgggaaaaatgtggtacatcaacttgatataattacagatctcctgggaacaccatctcctgaagcaatctctaggattcgaaatgagaaggccaagcgctacctgagcagtatgaggcggaaaaggcctataccacttactcagaaatttccaaatgcagatccacttgcattacgtttattggagaagatgctagcttttgatccaaaagataggccaagcgcagaggaggcccttgctgatccatatttcaagaacatagccaatgtggatagagaaccatcagcacagcctgtgacaaagctggaatttgagtttgagaggcggaggattaccaaagaagatataagggaactcatttacagagaaattctggagtatcatccaaatatgttgagagaattccttgaggggacagagtcaactggtttcatgtacccaagtgctgtggatcattttaagaagcaatttgcatatcttgaagaacactatgcaaagggatcaacagcagctccacctgagaggcaacacaactctcttccaaggccttgtgtgttatattcggataatctaactaaaagcacagccaatgtcatggaggatctttccaagtgtgtaatcagagatgaaacgcagaggggacagctagattcttcctctatcggtgcaaatagagttcctcaaggtggtgcttcaaggcctgctagagtggttggttctgcaatgcgatatggtaacagttcatcatctggtacctaccaatatgaacagaggacagctaaaaacccagcaattggtgctactggtgtttcacctaggggctcatactctagaacaattcctacctgcaagagcgaaacaagcgaggctgacaggattgatgcaagtcaaactagacagcccaagccatacatcccaaacaaactacctactacagtagatggccggaatggtcattggtaggtttacctgcaatctaccagcaaacttaacaaaaatatctgcagatctctgagacatcctgacgcagttaaagatgacattctgtacagagtgaacatttttcagggacacagtcagagctgaactgtaatagaagcaggcttgatgggctgcttggttccacgtagatttggccttcgctagctgattgatgattcagattaatcatgtacggtgtatagtaaaaatattgtggtaggcagcaagaggctgctagcctgctactgacgtagaaactatacacgctgtctgatcgtttttgtaactatacacgtagaaactatatactgtttcttgtagctgtccattcaaatgtagcaacaatcagctatttagttttacaatggaatcttagaagacgtcaatttgtgtacatgtatcaagctttctctggaacctatggttgtagtaatttataacga

SEQ ID NO: 4110 - DNA, 2361 bp, Sorghum bicolor
taaaagtccaaaacctggagaaaataaataaataaataaactcgcaaagctgccgactgcgagcacgaggccgccgtcctttgtcatcctctcgtttcagctggatcctccgccgccgcatcctcagctcgctgctgccgtcaccacagcgctggctcctccgtcacgggcgtggatttgttccccttttctggtacaagcatcccctgaatggattttttcactgagtatggtgagggaagcaggtacaagatagaagaggtcataggaaaaggaagttacggtgtggtttgctctgctttggacactcacactggtgaaaaggttgcaataaagaagataaatgaaatatttgaacatgtgtctgatgcaacacgtatacttcgtgagatcaagctgcttcggctcctgcgacatccggatattgtagaaataaaacatattttacttcctccatcaaggagggaattcaaggatatatatgttgtgtttgaactcatggagtctgatttacaccaagttataaaggctaatgatgacttaactccagaacactatcaatttttcctgtatcaattacttcgaggattgaagtacatacatacagcaaatgtgtttcaccgagacctaaaaccaaaaaatattttggccaatgctgattgcaagcttaaaatatgtgattttggacttgcaagagtagctttcaatgatactcctactgccatcttctggacggattatgttgcaacaagatggtaccgagctcctgagctgtgtggatcttttttctctaagtatactccagcaatagatatatggagcattggctgtatatttgcagagcttttaactggaaaacctctcttccctgggaaaaatgtggtacatcaacttgatataattacagatctcctgggaacaccatctcctgaagcaatctctaggattcgaaatgagaaggccaagcgctacctgagcagtatgaggcggaaaaggcctataccacttactcagaaatttccaaatgcagatccacttgcattacgtttattggagaagatgctagcttttgatccaaaagataggccaagcgcagaggaggcccttgctgatccatatttcaagaacatagccaatgtggatagagaaccatcagcacagcctgtgacaaagctggaatttgagtttgagaggcggaggattaccaaagaagatataagggaactcatttacagagaaattctggagtatcatccaaatatgttgagagaattccttgaggggacagagtcaactggtttcatgtacccaagtgctgtggatcattttaagaagcaatttgcatatcttgaagaacactatgcaaagggatcaacagcagctccacctgagaggcaacacaactctcttccaaggccttgtgtgttatattcggataatctaactaaaagcacagccaatgtcatggaggatctttccaagtgtgtaatcagagatgaaacgcagaggggacagctagattcttcctctatcggtgcaaatagagttcctcaaggtggtgcttcaaggcctgctagagtggttggttctgcaatgcgatatggtaacagttcatcatctggtacctaccaatatgaacagaggacagctaaaaacccagcaattggtgctactggtgtttcacctaggggctcatactctagaacaattcctacctgcaagagcgaaacaagcgaggctgacaggattgatgcaagtcaaactagacagcccaagccatacatcccaaacaaactacctactacagtagatggccggaatggtcattggtaggtttacctgcaatctaccagcaaacttaacaaaaatatctgcagatctctgagacatcctgacgcagttaaagatgacattctgtacagagtgaacatttttcagggacacagtcagagctgaactgtaatagaagcaggcttgatgggctgcttggttccacgtagatttggccttcgctagctgattgatgattcagattaatcatgtacggtgtatagtaaaaatattgtggtaggcagcaagaggctgctagcctgctactgacgtagaaactatacacgctgtctgatcgtttttgtaactatacacgtagaaactatatactgtttcttgtagctgtccattcaaatgtagcaacaatcagctatttagttttacaatggaatcttagaagacgtcaatttgtgtacatgtatcaagctttctctggaacctatggttgtagtaatttataacgaactggcgaacggtgagtgacgttctataagtagcaatgggcggggtttcttgggacttgtgagaaca

SEQ ID NO: 4111 - DNA, 2253 bp, Triticum aestivum
cgagcttcgccttggatcgcagcgcagcgcagctggactcctccccctcgtcgtcgtgtgcgcgcgtgagcgaacatctcaaatggacttttttaccgagtatggcgagggaaacagatacaagatagaagaggttataggaaaagggagttatggcgtggtctgctctgctttggatactcacacgggtgagaaagttgctatcaagaagataaacgacatctttgaacatgtgtctgatgcgacacggatactccgcgagatcaagttgcttaggctcctaagacaccctgatattgtggaaataaaacatattctacttcctccgtcgaggagagagttcaaggatatatacgttgttttcgaactcatggagtctgatttgcaccaagttataaaggcgaatgatgacttgactccagaacattatcagtttttcttgtatcagttgctccgaggattgaaatacatacatacagcaaatgtatttcatcgagatctcaaaccaaagaatatcttggctaatgctgattgtaagctcaaaatatgtgacttcggtcttgcaagggtagctataagtgatactccaaccgccatattttggacggattatatcgcaacaaggtggtaccgagcacctgagctatgtggatcttttttctccaagtacacaccagcaatagatatatggagtattggatgtatatttgcggaacttctaactggcaaacctctttttcctgggaaaaatgtggtgcatcaacttgatataatcacagatctactgggaacgcctgctccagaaacaattgctaggattcgaaatgagaaggccagacgctacttgagcagtatgaggcggaaaaagcctgtaccgtttacacagaagtttccgaatgcagatccacttgcattaaatttgttagagagaatgctagcatttgatccaaaataccggccaagtgctgaagaggctcttgctgatctttatttcaagaacatagctagtgtggatagggagccttctgcacagcccattactaagctcgagtttgagtttgagagacgaagaattacgaaggacgacataagggaactcatatacagagaaattctggaatatcatccaaacatgctgagggaattccttgagggggcagagccaactaatttcatgtacccaagtgcagtagatcatttcaaaaagcaattcacattccttgaagagcattatgcaaagggatcaacagcagcgccgcctgagaggcaacataattcattaccaaggccgagtgttatctattcggataatcggccacagggttcagatagccgaccacagggtgctgccaacattacggatgatctttccaggtgtataatcagagataatgcacaaaagccacgcagagatcctgcttcagttggtgcaaacagagttcctaagggtgctgctgtcgcaaggcctggtaaagtggttggttcggcacttcgttatggtaactgttcaacatctggtactgagcaatatgaacagcgaagggtcatcacaagccaaggaattgttccaaacggcgttccttcaggcagctcataccctagaagaaataacacctgcaagagtgaaacaggtgaagctgaaaggatcgacgtgagccaagccgtgccaccaaagccatataccggaaataaactacctgcaactgtggatggccgcaatgggcactggtagactgctgtgacaatgccagaaaatccttgtcacctcattccaaggacacaccttcaaacatgccattctgtacagagttatattatctgtcaagcttacatctcccggagacgatagaactgtatgagaggcctttgcgacaggctagtctcctgttaagctcaactctggtctggttacctgcaattgggtagatccagttcaactgttcaacaagtataacaaaaaaactggaaactttgagcggcattcgcgacaaaggactgttactgacctgactgatggtgttcctcgatttgtttctccaagctggtggccttgagggaggttcagagagcccactgtacactatctaatgttgtaacacggagttaattaattgactttaatgttcttgttgcttgtagtctgtcatcaagctgtagtattgaactattaaacacggctatttctgataacacattatttggaccctgctcgctattgagtgcggaatttataatgatgtatgcagtaatcaa

SEQ ID NO: 4112 - DNA, 2364 bp, Triticum aestivum
ctgtcctcgagcttcgccttggatcgcagcgcagcgcagcgcagctggactcctcccctcggccgcgtcccccctcgtcctgcgcgcgcgtgagcgaacatctcaaatggacttttttactgagtatggtgagggaaacagatacaagatagaagaggttataggaaaagggagttacggcgtggtctgctctgctttggatactcacaccggtgagaaagttgctatcaagaagataaacgacatctttgaacatgtgtctgatgcgacacggatactccgcgagatcaagttgcttaggatcctaagacatcccgatatcgtggaaataaaacatattctacttcctccatcgaggagagagttcaaggacatatacgttgttttcgaactcatggagtctgatttgcaccaagttataaaggcgaatgatgacttgactccagaacattatcagtttttcttgtatcagttgctccgaggattgaaatacatacatacagcaaatgtatttcatcgagatctcaaaccaaagaatatcttggctaatgctgattgtaagctcaaaatatgtgatttcggtctcgcaagggtagctataagtgatactccaaccgcaatattttggacggattatatcgcaacaaggtggtaccgagcacctgaactatgtggatcttttttctccaagtacacaccagcaatagatatatggagtattggatgtatatttgcggaacttctaactggcaaacctctttttcctgggaaaaatgtggtgcgtcaacttgatataatcacagatctcctgggaacgcctgctccagaaacaattgctacgattccaaatgagaaggccaggcgctacttgagcagtatgatgcggaaaaagcctgtaccgttcacgcataagtttccaaatgcagacccacttgcattaaatttgttagagagaatgctagcatttgatccaaaagacaggccaagtgctgaagaggctcttgctgatctttatttcaagaacattgcgagtgtggatagggagccttctgcacagcccattactaagcttgagttcgagtttgagagacgaagaattacgaaggacgacataagggaactcatatacagagaaattctggaatatcatccaaacatgctgagggaattccttgagggggctgagccaactaatttcatgtacccaagtgcagtagatcatttcaaaaagcaattcacattccttgaagagcattatgcaaagggatcaacagcagcaccgcctgagaggcaacataattcattaccaaggccgagtgttatctattcggataaccggccacagtgttcagatagccgaccacagggtgctgccaacattacggatgatctttccaggtgtataatcagagataatgcacaaaagccacgcagagatcctgcttcagttggtgcaaacagagttcctcaaggtgctgccgttgcaaggcctggtaaagtggttggttcggcacttcgttatggtaactgttcaacatctggtactgagcaatatgaacagcgaagggtcgtcacaagccaaggaattgttccaaacggtgttccttcgggcagctcataccctagaagaaataacacctgcaagagcgaaacaggtgaagctgaaaggattgacgtgagccaagctgggccaccaaagccatataccggaaataaactagctgcaaccgtggatggccgcaacgggcactggtaggctgctgtggcaatgccagaaaatccttgccattggatcaggaagggttactcattccaaggacacaccttcaaacatgccattctgtacagagttatattatctgtcatgcttacttctcccggagacgataaaactgtatgtgaagttgttgcggcaggctagtctcctgttaagctcaactctggtctggttacctgcaattgggtagatccagttcaactgttcaacaagtataaccaaaaaactggaaactttgagtggcattcgcgacaaaggactgttactgacctgactgatggtgttccgcaattcgtttctccaagctggtgaccctgagggaggttcagagagcccactgtacactatctaatgttgtaacacggagtttaattaattgactttaaagtatgttcttgttgcttgtagtctgtcatccagctgtagtgtcgaactattgaacactgctatttctgataacacattatttggaccctgctcgctattgaaaccccaggttttttgtgcggaatttgtaatgtgatatgcagtaagttagtagcccgagcaaaacggagttgcgacgtatgtttcctgaattgcgcaac

SEQ ID NO: 4113 - DNA, 1474 bp, Zea mays
attcgtccgtgttcctgctgctgctatcccccgccgcgacctcccagctcggccagggccccgccattgccgcctggattaacggctcgccgccgcctagccctgacgccgccgccgccgccgccgccgccgcctcgggcccgcggagccaggagtacgcggcgctgcaggcgctgaaggtggccgtcaccgacgaccccaagggagcgctcgcgtcgtggcagggcgccaatgtgtgcgcctacaagggcgtgtactgctccgcgccgcccgacggcgccgcggccgccggcgcgtcgacggtagtcgcgggcatcgacctcaaccgcgccaacctcaggggcacgctccccgacgcggtgtccctcctggcgcacctcaccttcctccacctcaacagcaaccggctcgggggcgccgtccccgacacgctccgggacctgcagtacctgacggagctggacctgagcaacaacctcttctcgggcccgttcccggcgtccacgctgctcatcccgtcgctggtgtacctggacctccgcttcaacgccttctccggggaggtcccgcccgaggtgttcgccaaggagctggacgccgtgttcctcaacgacaaccagttcgagggccagatcccggacacgctgtgggcgtcgcccgccacggtcatcacgctggccaacaaccacttcaccggcgccgtcccggcggcctacgagttcggcgccggcgccggggccggggccggtggccgggtccgcgaggtgctgttcctgaacaacaacctgaccggctgcgtgcccgaggcgctgggcttcctccccagcatgcaggtgctggacctcagctacaacgcgctgtcgggacacctcccggggacgctctcgtgcctgtcggggatcgaggtgctcaacctcgcgcacaaccagctcacgggcgagctcccggacctgctgtgcgacctgcgccggatcaccaacctgtccgtgtccttcaacttcttctccgggatcagccagcgctgcgaccggcagctggggagccgcggcgtgttcgacttcgtgggcaactgcgtgcccgggcgggacatgcagcggccgcagcccgagtgcgacgagttcccgggggaaggcggcctcagctgcctccgcatccccggggcgcggccagccgggtgtggcgacgcgggcgtcactattggcgtgggcgtcggagtgggcatcggggggctgccgttcgggttgccaggcgctgccgctggaggcgtggtcaccgtcaccgtgccgtgagctgccgggggcactgcacctttgtttggttttctttttttttttctttctcttcttccttttgggcggcaattaccttccattcggctcggcgtaacgtacgcatcgatggtaatgggtgaacattggttggttctcggctggttaatactcctgctactgtagtataatttcgccatagtgta

SEQ ID NO: 4114 - DNA, 1767 bp, Setaria italica
ttcctgcacccatcacatcccagttccagctgtggtttgatcagcgagagcatctagcagcacaacccacatagagagacaggaagagaggagatcaatcaatgcattaccacccgagctgatcatctctctcctccggccactcccccaccgtcccgttcctctcacaagaatcactcctgctccctcctcagatctcgcaagcaaaacaggcaaagctttacccgggtaaggttacgggtagccatgaggcggcggccacctttccattcccgtgccgccgccgccgtgctcctgctcctagtgctgctgacccccgccccgacctcccagctcggcctaggccccgccattgccgcctggatcaacggcgcaccgcctccgtcccctagccctgccgccgccggggcctcctcctcgtccgcgccgagccaggagtacacggcgctgcaggcgctgaaggctgccgtcaccgaggacccccgcggcgcgctttcgtcgtggcagggcgccaatgtgtgcgcctaccgcggcgtctactgctccgcgccgcccgacggcgccgcggccgcgggtgcgcccacggtggtggccgggatcgacctcaaccgcgcgaacctcaggggcacactccccgaggcggtctccctcctcgcccacctcacgttcctccacctcaacagcaaccgcctcggcggcgccgtcccggactcgctccgcgacctggagtacctgacggagttggacctcagcaacaacctcttctccggcccgttcccgtcgtcaacgctgctgatcccgtcgctggtctacctcgacctccgcttcaacggcttctccggggagctcccgcccgaggtcttcgccaaggacctcgacgccttgttcctcaacgacaaccagttcgagggccagatcccggacacgctgtggtcgtctcccgccaccgtcatcacgctcgccaacaaccacctgaccggccccgtccctgcctcctacgggtacgccggcggccgggtccgggaggtgctgttcctgaacaacaacctgacggggtgcgtgccggaggcgctggggttcctccccagcatccaggtgctggacctgagctacaacgcgctgtcggggcacctcccggggacgctgtcgtgcctatcagggatcgaggtgctcaacgtggcgcacaaccagctgacgggggagctgccggacctgctgtgcggcctgcggcggatcaccaacctgtcggtggcgttcaacttcttctccgggatcgggcagcggtgcgaccggcagctggggagccgcggggtgttcgacttcgtggggaactgcgtgcccgggcgggacatgcagcggccgcagcccgagtgcgacgggttccccggggagggagggctcagctgcctccgcatccccggggcgcgccccgccgggtgcggcgacgcggccgtgtccgtgggcgtcggagtcggcgtcggggtcggggtcggcggtgtgccgtttgggctgccgggcgccgccgccggggccgggggcgtggtcaccgtcaccgtgccctgatcgatcagtctgcaggccgctggctttgcttctttttttctttttcttcttctctgatttcttctgaaatttttggaggcaaaggcaattagcctcgatcggcttggcgtgtcgcatcgatcattaattacatggcgatggtaacgggtgaatattggttggttcctggctggttaatactagtataatctcgccatttctgta

SEQ ID NO: 4115 - DNA, 1520 bp, Setaria italica
gttacgggtagccatgaggcggcggccacctttccattcccgtgccgccgccgccgtgctcctgctcctagtgctgctgacccccgccccgacctcccagctcggcctaggccccgccattgccgcctggatcaatggcgcgccgcctccgtcccctagccctgccgccgccggggcctcctcctcgtccgcgccgaaccaggagtacacggcgctgcaggcgctgaaggctgccgtcaccgaggacccccgcggcgcgctttcgtcgtggcagggcgccaatgtgtgcgcctaccgcggcgtctactgctccgcgccgcccgacggcgccgcggccgcgggtgcgcccacggtggtggccgggatcgacctcaaccgcgcgaacctcaggggcacactccccgaggcggtctccctcctcgcccacctcacgttcctccacctcaacagcaaccgcctcggcggcgccgtcccggactcgctccgcgacctggagtacctgacggagctggacctcagcaacaacctcttctccggcccgttcccgtcgtcaacgctgctgatcccgtcgctggtctacctcgacctccgcttcaacggcttctccggggagctcccgcccgaggtcttcgccaaggacctcgacgccttgttcctcaacgacaaccagttcgagggccagatcccggacacgctgtggtcgtctcccgccaccgtcatcacgctcgccaacaaccacctgaccggccccgtccctgcctcctacgggtacgccggcggccgggtccgggaggtgctgttcctgaacaacaacctgacggggtgcgtgccggaggcgctggggttcctccccagcatccaggtgctggacctgagctacaacgcgctgtcggggcacctcccggggactcgtgcctatcggggatcgaggtgctcaacgtggcgcacaaccagctgacgggggagctgccggacctgctgtgcggcctgcggcggatcaccaacctgtcggtggcgttcaacttcttctccgggatcgggcagcggtgcgaccggcagctggggagccgcggggtgttcgacttcgtggggaactgcgtgcccgggcgggacatgcagcggccgcagcccgagtgcgacgggttccccggggagggagggctcagctgcctccgcatccccggggcgcgccccgccgggtgcggcgacgcggccgtgtccgtgggcgtcggagtcggcgtcggggtcggggtcggcggtgtgccgtttgggctgccgggcgccgccgccggggccgggggcgtggtcaccgtcaccgtgccctgatcgatcagtctgcaggccgctggctttgcttctttttttctttttcttcttctctgatttcttctgaaatttttggaggcaaaggcaattagcctcgatcggcttggcgtgtcgcatcgatcattaattacatggcgatggtaacgggtgaatattggttggttcttggctggttaatactagtataatctcgc

SEQ ID NO: 4116 - DNA, 2460 bp, Zea mays
tcttctcccatctcatcgtcccatcccatctccaactcgtctcacttgtccatccatccgtgtttcttcaccgccttctcttcggattgagattgtaatcagaatcggattgagattgtaatcagaatcggattccatcgttacatactcaaggcacatacagcagcaccaatgatgagcgacgcgtggccgtcatccccctactcctcgtcggcgcccgacggggaggtcctgcgctccctgcaccgcctggcgcgggacctgtcggcggccgaggcgccggcgccgttcctgcggccggtcttcgcagcggtggccaggcgggcgcgcctgctggccgccgtgttcgacgacctgctgctgtgcggcgcggccgcgggcccgctgctgctgctgctgctgccgcgctccgcgtccctgtgcctccgggagctcctgctcgtgctgcagcggttcaaggcgctcgtggccgactgcgccacgcgcagccgcacgcgcctgctgcttcagtcggatgaggtggccgcgcgcgcgcgggagctccagcacgacctcgccacgctgatcgacctgctccccgccgcggagctcgggctcgccgacgacgtgtcggacctcctggcgctcgcgtcgcggcagtgccgccgcgcggcggccccggagctggagctgaaggcgggcgtgctcgcgctgatccaggaggtggagcgggagatcgtgccggagcgggagaggcttgagggtatcctggaggacgtgggcatcaacgaccccgccagctgcagcgacgagatcgagaccctggagcgggagatcggcgaccgcgtcgccgagaggtggacgtcgtcgatgatcgccctcgtcggcctcctccgctacgccaagtgcgtcctcttcagtgccgccacgccgcggcccgtggactccaaggtggatctcgacgacgcggagccaccgtcgccgccgccggacttccggtgccccatctccctcgagctgatgggcgaccccgtcgtggcttctagcggtcagacgtacgaccgtgactccatcacgcgctggttcggctctggcaaatccacgtgccccaagaccgggcaagtgctgctgaatctggaactcgtgcccaacaaggcgctcaagaacttgatatcgcggtggtgccgggagaacggcatccccatggagagcagcgagtccgggaaagccgagccggcgccggcggtaggcgcgaacaaggccgcgctgaaggcggcgcgcatgaccgcgtcgttcctcgtgaagaagctgtcggcctctttctcccccgaggcgacgaagcgcgtggtccaagagatccggcagctggccaagtccgggtccgacaaccgcgcgttcatcggggaggccggcgccgcggggctcctcgtgccgctgctcctgtccgaggactcggctctccagctcaacgccgtgacggcgctgctcaacctctccatcctggaggccaacaagaagcgcatcatgcacgcggagggcgccgtggacgcgctctgccacgtcatgggcacgggcgccacgtggcgcgccaaggagaacgccgcggccaccgtgctcagcctggcggccgtccacgcgtaccgccgccggctcgggcggaacccacgcgtcgtcgagagcgtcgtgcggctcgcgcgcacgggcccctccagcaccaagaaggacgcgctcgcggcgctcctgtgcctgtccgccgagcgggagaacgtgccgaggatcgtcgaggccggcgccgcggaggcggcgctggccgcggtcggcgaggccgaggccgaggccgccgcggcggtgctggcgtcgctggcgaagcgcggcggcgcggaggcgatcgtcgcgctggacggcgccgtggcgcggctggtgaacgagatgcggcgcggcacggagtggtcgcgggagtgcgcggcggccgcgctggtgctgctgtgcaggcgcgccggcgccgccgctgcgtcgcaggtggtggcggtccagggcgtggagtgggccatctgggagctgctgggcaccggcacggagcgcgcgcgccgcaaggccgcgtcgctcggcagggcgtgccggcggtgggcggcggccgccaacgcggagcagagcacagagtgccccgcctccgccgatgcgccggcgctcacgtcggcggcgtgaagtgaaatccactactcaactactgcgcgatcagtagtagaagctccaagaacaagccgaagcatttttttttcccattacgaatgttgtacaaaatttgttcttggccgttaaggccttcccgattctttggtccgtggtagtgagtaattgatcaactgtaaatacaagataggtgtagtacgtacattttttttctttttcatcaaacattgttacgcattcattgtactgtctcaagaaaatacaaaggtaaacaacaaaatcactccatgc

SEQ ID NO: 4117 - DNA, 2487 bp, Setaria italica
cgtgtccttccttctcttctcatctcaagttctcaactcaactcacttgttcatccaatccattcgtgtttgttcaccgcctgctcttcggattcaaattggagttggattgcaacgctacagcctagtacagacatcttacagcgacagcagcaatggctagcagcgcgacgatcgacgcgtggccgtcgtcgccctactcctcgtcggcgcccgacggggaggtgctgcgctccctgcaccgcctggcgcgggacctgtcggcggccgaggcgccggcgccgttcctgaggccgattttcgcgtcggtggccaggcgggcgcggctgctcgccgccgtcttcgacgacctgctgctgagcggcgcggccgcggagccgctcctgctgctgccgcgctcggcgtcgctctgcctcagggaggtgctcctggtgctgcagcggttcaaggcgctggtggcggactgcgccgcgcggagccgcatgcggctgctgctgcagtcggacgaggtggcctcgcgggcgcgggagctgcagcaggacctcgcaacgctgctcgacctgctccccgtggcggacctcgggctcgccgacgacgtggcggacctcctcgcgctcgcgtcgcggcagtgccgccgcgtggcggccgcggagctggagctcaaggcgggcgtgctcgcgctcatccaggaggtggagcgggagatcgtgcccgagcgggagaggctggagggcatcctggaggaggtgggcatcaacgaccccgccagctgcagcgacgagatcgagaccctggagcgggagatcggcgaacgcgtcgccgagaggtggacgtcgtcgatgatcgcgctcgtcggcctcctccggtacgccaagtgcgtcctcttcagcgccgccacgccgcggcccgcggactttaaggtggatctcgacgacgacgacggcgccgagcccccgtcgccgccgctggacttccggtgccccgtctccctcgagctgatgagcgaccccgtcgtggcttccagcggccagacgtacgaccgcgactccatcgcgcggtggttcggctccggcaagtctacgtgcccaaagacagggcaggtgctgacgaatctggagctcgtgcccaacaaagcgctcaagaacttgatagcgcggtggtgccgggagaacggcatcgctgtggaggtcagcgaggctgggaaggccgatccggcgccggtggtggccgcgaacaaggccgcgctgaaggcggcgcgcatgaccgcgtcgtttctggtgaagaagctgtcggcgtcgttctcccctgagtcgaccaagcgcgtggtgcacgagatccggcagctggccaagtccgggtccgacaaccgcgcgttcatcggggaggcaggcgccgccgcgctcctcgtgccactgctccgctccgaggactcggcgctccagctccacgccgtgacggcgctgctcaacctctccatcctggaggccaacaagaagcgcatcatgcacgcggagggcgccgtggacgcgctgtgccacgtcatgtgctccggcgcgtcgtggcgcgccaaggagaacgccgcggccaccgtgctcagcctggcgaccatccacacgtaccgccgccggctgggccggaacccgcgcgtcgtcgacagcgtcgtgcagctcgcgcgcacggggccatccagcaccaagaaggacgcgctcgcggcgctgctgtcgctgtccggcgagcgggagaacatcgggaggctcgtggaggccggcgccgcggaggcggcggtggctgcgattggcgaggccgaggccgccgcggcggtgctggcgtcgctggccaagcgcggtggcgcggaggcgatcgtgggcatcgacggcgccgtggcgcgcctcgtggccgagatgcggcgcggcacggagtggtcgagggagtgcgcggcggccgcgctggtgctgctgtgccggcgctctggcgccaaggcggcggcgcaggtgatggcggtcgcaggcgtggagtgggccatctgggagctgctgggcaccggcaccgaccgcgcgcgccgcaaggccgcgtcgctcggcagggcgtgcaggcggtgggcggccgccggcgcggagcagagcaccaccgtgtgccccacctccggcgccgcgccggcgctcacgatggcgtcgtgaatacacgattcgtagcagaaacaacattttttttcaccacgattcttgtacaaaatttgttcctggtcattgaggccttccacgattctttggcccgtactgcgggcagtgagtaattgatcaactgtaaatacaagacgctcttgttctcttttttcatcaaatattgtctcgagaaataaagagaaagaaacaaataacaatgttcactacttgttccgtgacttcatgtcccctgttctgatgttgctattcagatcgcatcttcctagcgagcacaattaactaggagtattgtcatttgtgctcc

SEQ ID NO: 4118 - DNA, 2475 bp, Brachypodium distachyon
ctcgtctctgccccttcgtctatccatatatcgcatcattcaacccttcacgcattcgttgccttctgatcaccgcaaatggctaacgcaagaaacgcagcggcggctgggtcgccttcttcttcttcgtcttcatactcctcatcggcgcccgacgcggagatcctccggtccctgcaccgcctggcgcgcgacctggccgccgccgaggcgccggcgccgttcctgcgggcggtgttcgcgtccgtgtcgcggcgcgcgaagctcctcgtcgcggtgttcgacgacctgctgggcgtggtggggcggctgccgcggtcggcgtcgctgtgcctccgcgaggtgctcctggtgctgcagcggttcaaggccgtcgtggccgactgctcggcgcgcagccgcatgaggctcctgctccagtccgacgaggtcgccgcgcgcgtgcgggagctgcagcacgacctggccacgcttctcgacatcctccccgccgccaccgagctcgggctcgccgacgacgtggcggacctcctcgcgctcgcctcgcgccagtgccggcgccccgcgccggaggccgcggcggagcaggagctcaaggcgagcgtgctgaggctgatacaggaagtggagcaggagatcgtgccggagcgggagaggctggaggccatcctcgacgaggtggacatcaacgaccccgcgagctgcagcgaagagatcgagatcttggagcgggagatcggcgaccgcctcgcggagaggtggacgcctgccatgattgccctcgttgggctccttcggtacgccaagtgcgtcctcttcagcgcagccacgccgcggccgctggattccaaggcggatcttggcgacggcgacgacgatggcgccgaacccccggcgccgccgctggacttccggtgccccatctctctcgatttgatgcgcgaccctgtcgtatctgctagtggccagacgtacgaccgcgagtccatcacacggtggttcggatccggcaagtcgacgtgcccaaaaaccggccaagtactcaccagtctggagcttgtccccaacaaggcgctcaagaatttgatctcgcggtggtgcagggagaacggcgtggccatggagggcagcgagccaggcaagcccgagcctgcgccgctggcgaccgcgaacaaggccgcggtggaggcggcgcgcatgaccgcgtcgttcctcgtgaagaagctcacggcgtccttctcccctgcctcggacaaccgcgtggtccacgagatccggcagctcgccaagtcggggaccgagagccgcgccttcatcggggaagccggcgcgatcccgctcctcgtgccgatgctccagtccgaggacgccgcgctgcagctcaacgccgtcacggcgctgctcaacctctccatcctcgaggccaacaagaagcgcatcatgcacgccgagggcgccgtggccgcgctctgccacgtgatgggctccggcgcgacgtggcgcgccaaggagaacgccgcggccgccgtgctcagcttgtcggccgtccactcgtaccgccgcaggctcggccgcaacccgcgggtcgtcgagaaggtgctgctcctggtgcgcacgggccccgcgagcacgaagaaggacgcgctcgccgcgctgctgtgcctgtcaggggagagggagaacgtgggcaagctcgtgggggcgggcgccgtggaggcggcgttgtcggcgatcggcgaggaggagaccgcggccgcggtgctggcgtcgctggccaagcgcgggggcgcggaggcgatcgtcaacgtcgacggcgccgtggcgcggctcgtggccgagatgcgccgcggcggcacggattggtcgagggagtgcgcggcggcggcgctggtgctgctgtgccggcgcgcgggggccgcggccgtggcgcaggtgatggcgatccccggggtggagtgggcgatatgggagctcatgggctccggctcggagcgcgcgaggcgcaaggcggcgtcgctcggcagggcgtgccggcgctgggcggtcgccaacgcggagcagaccacggaatgccccaccaactccaccaccgtcacgctgccggtcatggcggcctcgtgaattcctccatacatttgatttgattcataggaacagcacaaaaaaaaatccagaaaaaaactggaaaaatcactgtacatagtttattctttggcttctaaagctgtcacgattctttggtccgtgggagacagagcactttgaggaactgtgcatatagaaatgaaattcattgttttcttttcgttgttcaatcttgtaacacattttattctcaagaaacagtacacatgaaagaagtcttgtaccgctaccactgtatcaatttgtgctcattatgaaatttcctattaaacgcaacagccgcgtcttttgagatcgttctatactggacagaatggaacacggcttgca

SEQ ID NO: 4119 - DNA, 2372 bp, Secale cereale
gacatccaattcattcaactcgactccatccaaagccttcacgcgcccctcgccctctggctgccgcaatggccagcgcgcggaacgccgcggcgtcctcttcgccgtactcctcgtcggcgcccgacgtggacatcctccgctccctgcgccgcctggcgcgcgacctggcggccgcggacccgccggcgccgttcctcagggccgtcttcgcgtccgtgtcccgccgggcgcgcctcctcgtcgccgtgttcgacgacctgctgctcgcgctgggcgcgggcgccgggatgccgcggtccgcctcgctctgcctccgcgaggtgctgcttgtgttgcagcggtttaaggccgttgtggccgactgctccgcgcgcagccgcatgcgcctgctgctgcagtccgatgaggtcgccgcgcgcgtgcgcgagctgcagcacgacctcgccacgctgctcgacatcctcccggttggcgagcttgggctggccgacgacgtggccgacctcctcacgctcgcctcgcgccagtgccggcgccgcgcgcccgaggcggctgcggagcaggagctcaaggccagcgtgctggcgctgatccaggaggtcgagcgggagatcgtgcctgagcgggagcgcctggaggccatcctcgaggaggtggccatcaacgacccggcgggctgcagccaggagatcgagatcttggagcgcgagatcggcgaccgactcgcggagaggtggacgtcggccatgatcgccctcgtcgggctccttcggtacgccaagtgcgtcctcttcagcgctgccacgccgcggccgctggactccaaggtggacgctgacgatgatgacgccgagccaccggcgccgccgccggacttccgctgccccatctctctcgatctgatgcgcgacccggttgtgtcctccagtggccagacgtacgaccgcgagtccatcacgcggtggttcggagccggcaagtcgacgtgccccaagaccggccaggtgctcactaatctggagctcgtgcccaacaaggcgctcaagaacttgatctcgcggtggtgccgggagaatggcgtcgccatggaaggcagcgagcctggcaagcccgagccggcgccaccggtggccgcaaacaaggccgcggtggaggcggcgcgcatgaccgcgtcgtttctggtgaagaagctctcggcctccttctcccctggctcggacaaccgcgtggtgcacgagatccgtctgctcgccaagtccggctccgagagccgcgcgttcatcggagaggccggcgccgtcccgctcctcgtgccactgctcaactccgaggacgccgcgctgcagctcaacgccgtgacggcgctgctcaacctctccattctggacgccaataagaagcgcatcatgcacaccgacggcgcagtggcggccctctgcggcgtgatgggctccggcgcgacctggcgggcgaaggagaacgccgctgccaccgtgctcagcttgtcggccgtccatacgtaccgccgccggctcggccggaacccacttgtgatcgagaaggtcgtgctcctggtgcgcacgggccccccgagcaccaagaaggacgcgctggcggcgctgctgtgcctgtccgcggagagggagaacgtgagcaagctcgtgggagcaggcgccgcggaggcggcactgtcggcgatcggcgaggaggataccgccgcggcggtgctggcgtcgctggccaagcgcggcggggcggaggcgatcgtgaacatcgagggcgccgtggcgaagctggtggccgagatgcggcgcggcacggagtggtcgcgggagtgcgcggcggcggcgctggtgctgctgtgccggcgcgcgggggccgcggcggcgtcgcaggtgctggcgatcaacggcgtggagtgggcgatctgggagctgatgggcagcgggtcggagcgggcgcgccggaaggccgcgtccctcggcaggacgtgccggcgctgggcggccgccaacgcggcgcagaacgcggactgccccgcctccaccgtctcgccgccgaccgtggcggcgtcgtgaactcattcttcctcagtgacattgaattgatccgtagaaatcgctgaaaaccccaacaaaaaagtagataattcttgtgctgtacaaaattggtttgttgaatttgaatgccttgtaattctaggctgtagtacgattctttagtcccggtatgtaaacacaaacacagagtaattgaatcaactgtccatacagaacattcgttgcgtctttcgttctttgttgctgttgtgagatcttgtaatacaaaatgaaagaaaataatagttgtacaaattatttctcaaagtc

SEQ ID NO: 4120 - DNA, 2425 bp, Sorghum bicolor
cttgggacaacaaattacagattatgtttaaagaaagcgcaatgtagtagagctccaaatttaattcaaaatctaaacaaataaccgttcccctaaaagaaaactaaaattcatcccttcggcacgcgcagaaacaaaggcagttattgtggttgtgactagtgagtgcctctgacgattgcattgcaagtccgcaatcgacaatatgtacggcttccttgctccttgcctcccaagaccacaacaccattctccccccaaatcaagaactcgggctactcccagatcccaattccccagcaggtgcatccttgtactacaggtagccacaagagcaaaatctaagccatgaagaagaccgtcgtcctgtacccgggcctcgccgtcagccacttcgtccccatggttcaggtcgccgacgtgctcctggaggagggctacgacgtcgtggtcgcgttcatcgaccccaccctgaaaggagacatcgccttggccgccgtcatcgacagcgtcgccgcctccaagccgtccgtggttttccacaagctcccacgagtcgaggacgctcccacctttgtccatgactccaagttcgtggtcaggtacttggaattcgtgggccgctactgccagcacttccacgacttcctcttctccatgcctcccggcagcgtccacgccgtgcttgtggacgtgatgtccaccgaggtgctcggcgtcaccagcaagctcggcatcccagcttacgctttcttcccctcgaatgcctccgcacttgccgtgttcgtccaggcttcatcagttcgttcagaagggcagccaagtttccgggagctaggagacgcgcctctaaacttccatggcgtcccaactatgccagcttctcatctcactgctgaaatgctcgagggtccagggagtgagacattcaagacaacgatgaacatgaagagcaggatacaaaaagccaatggaatacttgtgaacacgtccgcatcgattgagcctcgtgcggtgtcagccctcggcgatccacggcgcttgccaaaaatgcctccggtgtactgcgtcgggccgttggtcgccgggaacggcggccaggcaacagacaagcacgagtgcctggcatggctcgacgagcaaccggagcagagcgtagtgttcctctgttttggaagcacaggcgccagcaaccactcagagcagcagctaaaggagatagccaatggcctggagagggccggccaccggttcctgtgggtggtgcgggcgcctccccacgacgacccggagaagccattcgatccccgcgcggacccggacctcgacgcgcttctgcccgccggtttcttggagagaactgggggtcgcggccgcgtcgtcaagctgtgggcgccgcaggtggacgtgctccatcacgcggcgacaggggcgttcgtgacacactgtgggtggaactcggtgctcgaggggattgttgccggcgtgccgatgctctgctggcctctgtacgcggagcagaagatgaacaaggtgttcatggtggaggaatatggagtcgccgtggagatggtcggctggcagcagggattggtgaaggccgaggaggtggaggccaaggtgaggttggtgatggagtcggaggaaggcaagctactgagggcacaggtgtccgagcacaaggaaggtgcggcaatggcatggaaggatggcggctcgtcgcgcgctgcgtttgctcagttcctgtcgcacgcaggcagcgtttcgggcagagcctgacacgcccttgatgcagtgggtcagcaataataatttggtggtagaattgctttgttcgcatcttagagcagccacaatgttgctcaaaagtagtccataggtattataataatctgtatcaactagctaaaatattgtgagacagtccatagagtagtacatgtgagaccagtccatagagtagttcatattaaaaggtatccataagcttatggactactcataaagaataaaaaaattattttttttacttttttccatctctctctccttgtagtggctggtggaatgaagataaataattttttatcctctttgggtcccatcttatagactacttagggcaaccataatgtatagactaagtagtctatatgagcagcttttgtgtcagtagacaatagttattgttgtctccacaatgtttcagtcaacaagtagtccataaagtgggtccgatataagataaaaaattatttctctttacaatcctatgcaaagccaagaaagagagagtaaggagtgagaaaaagtaacattttttattccctatgggtagtctataagcttatgggtaccttttgctatggactcctctatagactagtctcacagtgttccagttacctgatagcaagtattttaa

SEQ ID NO: 4121 - DNA, 1587 bp, Zea mays
cgcagcgggctgtcttcctcgccgtggagtagatcgaggagaggagcagcacaagtgagctagctgttcatctagctaacgccactcctgcctgccttgcctccctccctcagcacgtcgtgctggtaatcgatcagaggggggcgtgacgtacgtacagcagccatgggcgtggggaagctgatgaacgacgtgaagccgtacctggcgatggtgctgctgcaggtggggttctcggggatgtacatcgtctccgtcgcctccctcaagcgcggcatgaaccacttcgtcctcgtcgtctaccgcaacctcgtcgccaccgtcgtcttggcccccttcgccctcctcttcgagaggagagtgaggcccaagatgacgccgctcatctttctcaagatcatggggcttgccgttcttgagccggtgctggaccagaacatgtactacctcggcgcgaagctgacctcggcgaccttcgcctcggcgctcgtcaacatcctccccgccatcacgttcctgatggcgctggtcctgaggatggagaggctgaggctgcggagcctccgcagccaggccaaggtcgccggcacggtctgcaccgtcgtgggcgccgtgctgatgatcctgtaccacggccccgtggtgccgttcccgtggtccgcgggccaccaccaggcctcagccgccgccgccgccgcggcagcggagagccagagcagcgcatcctggctcaacggcatcgtcatgatcatcggcagctgcctgtgctggtccggcttcttcgtcctccagtcgaacacgctgcagagctaccccgcggagctgacgctggcgacgctgatctgcttcctgggctcggtgctgaccggcggggtggcgctggtggcggagcgccacgacatgagcgcctgggtcattggcttcgacacccgcctcttcaccgccgtctactccgggatcgtgtgctccggcgtggccttctacgtgcaggggatcgtgacgcaggcgcgggggccggtgttcgtgacggcgttccagcccctgtgcatgatcatcaccacggtcctcggctccaccatactcaaagaggagaccaccttgggaagcgtgatcggcgcggcgatcatagtggtggggctgtactgcctcatctggggcaagagcaaggaccacctcggcaacggcggcaagccggccgtcgccgagctgcccctcacctcggctcccaacggcggcaccaacggctacggcaagcacgcgctcggcggcggcggcggcggccaccacgtcgccgccggcgtcgaggcaccgccgccgtcgtccaagtgcgttcactgacggacggacacggaggagctccatgcacccctcaccgcacactagtagtaattatagtagcgcattaattaattgccagtggctgtgtaaaccctgcaacgcgtgtacgatctcggaacgttgggctgctctgctgttctcgtagtcgtagagagacggggccggccggcgttgcgttaacggcttctgagttttgatgacctgcaccaccgccatcgctaatactataactaagctctctgtttgtgc

SEQ ID NO: 4122 - DNA, 1182 bp, Saccharum officinarum
cagaggagcacaacaagtgagctagctctagctactggccactgctccgctgcctccgtcctcatcactagctagtaatcaggcgtacgtgcaggggccggccgggggacatcaggagcagccatgggcgtggggaagctgatgaacgacgtgaagccgtacctggcgatggtgctgctgcaggtgggcttctccgggatgtacatcgtctccgtcgcctccctcaagcgcggcatgaaccacttcgtcctcgtcgtctaccgcaacctcgtcgccaccgtcgtcatggcccccttcgccctcatcttcgagaggggagtgaggcccaagatgacgccgcgcatcttcctcaagatcatggggcttgccgtgctcgagcctgtgctggaccagaacatgtactacatcggcgcgaagctgacctccgccaccttcgcctcggccctcgtcaacatcctcccggccatcacgttcctgatggccctcgtcatgaggatggagaagctgaggctccggagcctccgcagccaggccaaggtcgtcggcacagtctgcaccgtcgccggcgccgtgctgatgatcctctaccacggccccgtggtgccgttcccgtggtccgcgggccaccaccacgccggcgccgcggcggcggcggcggagagccagagcagcgcctcctggctcggcaccgtcatgattattggcagctgcctgtgctggtccggcttcttcatcctccagtcgaacacgctgcagagctaccctgcggagctgacgctggcgacgctgatctgcttcctgggctctgtgctgaccggcggggtggcgctggtggcggagcgccacgacatgagcgcctgggtcatcggcttcgacacccgcctcttcaccgccgtctactccgggatcgtgtgctccggcgtggccttctacgtgcagggggtcgtgacgcaggcgcgcggcccggtgttcgtgacggcgttccaacccctgtgcatgaacatcaccaccgtgctgggctccaccatactcaaagaggagaccaccctcggaagcgtgattggcgcggtgatcatagtggtggggctctactgcctcatctggggcaagagcaaggaccacctcgggcaccggaagcccggcgccgcggccgtcgccgagctgcccctgaccttgggttcc

SEQ ID NO: 4123 - DNA, 1762 bp, Zea mays
taaaaaaaagattgtccttaaatataggcgccgaaacgaagccgacctaaccgccagacccaagccaacaagcaagaccgaccgcttctgcttgtgacccgaaacctttcttcgaacgcaaaaagaaccccacccgacgtaccgcgagccggctatggcgacggtggcgatggacatctcgaagcccacgccggcagcgtccggtgacgaggcagcggcggcggcgaaggggaggagcggcggcgggggcgaggggctgcggcagtactacctgcagcacatccatgacctgcagctccagatccggcagaagacccataacctcaaccgcctcgaggcccagcgcaacgacctcaactcccgagttagaatgctcagggaagagttgcagttgcttcaagagcctggctcatatgttggtgaggtggtgaaggtcatggggaaatcaaaggttctggtgaaggtacatcccgaaggcaaatatgtggtggatatagataagagcattgatatcactaagatcacaccttcaacaagagttgctcttcggaatgacagctatatgctccatctgatcctaccaagcaaagttgatccattggtcaatctcatgaaagttgagaaggttccggattctacctatgatatgattggaggccttgaccagcaaattaaagagatcaaagaggtcattgagcttccaatcaaacatccggaactgtttgagagccttggaattgcgcaaccaaagggtgtccttctttatggacctccgggcacaggaaagacattgttggcacgtgcggttgctcatcacactgactgcaccttcatcagggtgtctggttctgagttggttcagaagtatattggtgagggctcccggatggttagggaactctttgttatggccagggaacatgcaccatccattatatttatggatgaaattgactctatcggatctgctagaatggagtctggaactggcaacggtgacagtgaagttcagcgtactatgcttgaacttctaaaccagctcgatggttttgaagcatcaaacaaaattaaggttttgatggcaacgaacagaatagacattttggatcaagcccttctgaggcctggccgcatagacaggaagattgaatttccaaatcctaacgaggattcacgtttcgatatcttgaagatccattcaagaaaaatgaacttgatgcgtggcattgatctgaaaaagatcgcggaaaagatgaatggggcctcaggagctgagctcaaggccgtctgcacagaggctggaatgtttgctcttcgtgagagaagggtgcacgttacccaggaggacttcgagatggcagtggccaaggtgatgaagaaagacacggagaagaacatgtccctgcgcaagctctggaagtgaggctcgtgcccacctttcacggcctccccgaagctagtggcagtgccttcatatccatatcttttaccaaagcagtggaatggtgtaacggcatgctctggacaatgttatctcaagttgcgccgcgcatgcttatgtttaaaattttccttataacggctgtagtgtgttgttgcaaagttgattggatttatcagatcagctagattacggtactaatacattgctagctcgcgatgtggacactgcataatggttacttgctcggattatccacattctcgtgtgtaacatgcattgcaatgtcgtggcccattcaatatctcatatttttaacgt

SEQ ID NO: 4124 - DNA, 1848 bp, Setaria italica
gccgcaccagacggccagacccaacccaacaagcaaagccacacttccgcatccagggcccgaaacctttcctcgaacgcaagaagaaccaagccggcgatggcgacggtggcgatggacatctcgaagcccacgccggcggcgtccggcgacgaggccgctgcggcggcgaaggggaggagcggcggcggaggggagggcctgcgccagtactacctgcagcacatccacgacctgcagctccagatccggcagaaaacccacaacctcaaccgcctcgaggcccagcgcaacgacctcaactcccgagttagaatgctcagggaagagctgcagttgcttcaagagcctggatcatatgttggtgaggtggttaaggtcatgggaaaatcaaaggttctggtgaaggtgcatccggaaggcaaatacgtggtggatattgacaagagcattgatattacgaagatcacaccttcaacaagagttgctcttcgaaatgatagctacatgctccatctggtcctgccaagcaaagttgatccattggtcaatctcatgaaggttgagaaggttccggattctacgtatgatatgattggaggacttgatcagcaaattaaagagatcaaagaggtcattgagcttccaatcaaacatccggagctatttgagagcctcggaattgcccagccaaagggtgttctcctttatggacctcccggcacaggaaagacattgctggcacgtgcagttgctcatcacactgactgcaccttcatcagggtttctggttctgagttggttcagaaatatattggtgagggctcccgtatggttcgtgaactctttgtcatggccagggaacacgcaccgtccattatatttatggacgaaatagactctatcggatctgctagaatggagtctggaactggtaacggtgatagtgaagtgcagcgcaccatgcttgagcttctaaaccagcttgatggttttgaagcatcaaacaaaattaaggttctgatggcaacgaacagaatagacatcttggatcaagcccttctgaggcctggacgcatagacaggaagattgaatttccaaatcccaatgaggattctcgtttcgatatcttgaagattcattcaagaaaaatgaacttgatgcgtggtattgatctgaaaaagatcgcggaaaagatgaatggggcctcaggagctgagctgaaggcggtctgcacagaagctggaatgtttgccctccgcgagagaagggtacacgttacccaggaggactttgagatggcagtcgccaaggtgatgaagaaagacacggagaagaacatgtccctgcgcaagctctggaagtgaggtccataccttgatgtcgcccacaacctttcacagtctcgccgaagctcgcgccttcatctcccgagccttttccgccttgccaaaacagtggaacggtgtcaccgcatgctccggaccttcgccatgtgcctttttaagtttacgccgtgcatgcctatgtttaaaagttgttttctgataacagatgtagtatgttgttgaaaagttgagatttatcggatcagctagatacgagataatgcattgcttgctcgcgatgtaccacgttactatgcctactacttggtttgcagtttgccggtacttggtttgcagtttgccggcccactgccccactcgtaatgatcactgcctactgtaatatctgcaagcaatgtaatattgtattaggttgtactagctagcacctagtatccgagaagctggcagctgatttgtatttcagagaagctgctcctatccggttgtgttcagaaa

SEQ ID NO: 4125 - DNA, 1789 bp, Sorghum bicolor
gaccgccagacgcccggacccaagccagcaagcaaagcccacttcagcttccgggtcgaaacctttcttcgaacgcaagaagaaccccctaccccgaacgcgacctacccgagccggcgatggcgacggtggcgatggacatctcgaagcccacgccggcggcgtccggcgacgaggccgcggcggccgcgaaggggaggagcggcgccgggggcgaggggctgcggcagtactacctgcagcacatccacgacctgcagctccagatccggcagaagacccacaacctcaaccgcctcgaggcccagcgcaacgacctcaactcccgagttagaatgctcagggaagagttgcagttgcttcaagagcctggctcatatgttggtgaggtggtgaaggtcatggggaaatcaaaggttctggtgaaggtacatcctgaaggcaaatatgtggtggatctggataagagcattgatatcacaaagatcacaccttcaacaagggttgctcttcggaatgacagttatatgctccatctgattctaccaagcaaagttgatccattggtcaatctcatgaaggttgagaaggttcctgattctacttatgacatgattggaggccttgaccagcaaattaaagagatcaaagaggtcatcgagcttccaatcaaacatccagagctttttgagagccttggaattgcccaaccaaagggtgtcctcctttatggacctccgggcacgggaaagacattgctggcacgtgcggttgctcatcacactgactgcactttcatcagggtgtctggttctgagctggttcagaaatatattggtgagggttcccggatggttcgtgaactatttgttatggccagggaacatgcaccgtccattatatttatggatgaaatagactctatcggatctgctagaatggagtctggaactggcaacggtgatagtgaagtgcaacgtaccatgcttgagcttctaaaccagcttgatggttttgaagcatcaaacaaaattaaggttttgatggcaacaaacagaatagacatcttggatcaagcccttctgaggcctggccgcatagacaggaagattgaatttccaaatcctaatgaggattcacgtttcgatatcctgaagattcattcaagaaaaatgaacttgatgcgtggtattgatctgaaaaagatcgctgaaaagatgaatggggcctcaggagctgagcttaaggctgtctgcacagaggctggaatgtttgctctccgcgagaggagggtgcacgttacccaggaggacttcgagatggcggtggccaaggtgatgaagaaagacacggagaagaacatgtccctgcgcaagctctggaagtgaggctcatgccttgttgtacccacctttcatgtccacgctgaagctagtgccttcatatttttatctttcataccactttgccaaagcagtggaatggtgtaacggcatgctctgtgcatgcctattatgtttaaagttttccttataacagctgtagtatgttattgcaaaagttgaattttatcagatcagctagatgacggtactaatgcattgctagctcgcgatgttctgagttccagttcctacttggtgtgcagtttgccagtcaactcgtaaggaacactgcataatggttgctgctctgattatccattctctatggtgtgtaacatgcattgcaatatcgtggcccattcaatccggccctgtctgagctacgttttgtagccccgtttgag

SEQ ID NO: 4126 - DNA, 1905 bp, Sorghum bicolor
cgcctctatctattaaaccgaggcgcggaaacgaagccgcccctgaccgccagacgcccggacccaagccagcaagcaaagcccacttcagcttccgggtcgaaacctttcttcgaacgcaagaagaaccccctaccccgaacgcgacctacccgagccggcgatggcgacggtggcgatggacatctcgaagcccacgccggcggcgtccggcgacgaggccgcggcggccgcgaaggggaggagcggcgccgggggcgaggggctgcggcagtactacctgcagcacatccacgacctgcagctccagatccggcagaagacccacaacctcaaccgcctcgaggcccagcgcaacgacctcaactcccgagttagaatgctcagggaagagttgcagttgcttcaagagcctggctcatatgttggtgaggtggtgaaggtcatggggaaatcaaaggttctggtgaaggtacatcctgaaggcaaatatgtggtggatctggataagagcattgatatcacaaagatcacaccttcaacaagggttgctcttcggaatgacagttatatgctccatctgattctaccaagcaaagttgatccattggtcaatctcatgaaggttgagaaggttcctgattctacttatgacatgattggaggccttgaccagcaaattaaagagatcaaagaggtcatcgagcttccaatcaaacatccagagctttttgagagccttggaattgcccaaccaaagggtgtcctcctttatggacctccgggcacgggaaagacattgctggcacgtgcggttgctcatcacactgactgcactttcatcagggtgtctggttctgagctggttcagaaatatattggtgagggttcccggatggttcgtgaactatttgttatggccagggaacatgcaccgtccattatatttatggatgaaatagactctatcggatctgctagaatggagtctggaactggcaacggtgatagtgaagtgcaacgtaccatgcttgagcttctaaaccagcttgatggttttgaagcatcaaacaaaattaaggttttgatggcaacaaacagaatagacatcttggatcaagcccttctgaggcctggccgcatagacaggaagattgaatttccaaatcctaatgaggattcacgtttcgatatcctgaagattcattcaagaaaaatgaacttgatgcgtggtattgatctgaaaaagatcgctgaaaagatgaatggggcctcaggagctgagcttaaggctgtctgcacagaggctggaatgtttgctctccgcgagaggagggtgcacgttacccaggaggacttcgagatggcggtggccaaggtgatgaagaaagacacggagaagaacatgtccctgcgcaagctctggaagtgaggctcatgccttgttgtacccacctttcatgtccacgctgaagctagtgccttcatatttttatctttcataccactttgccaaagcagtggaatggtgtaacggcatgctctgtgcatgcctattatgtttaaagttttccttataacagctgtagtatgttattgcaaaagttgaattttatcagatcagctagatgacggtactaatgcattgctagctcgcgatgttctgagttccagttcctacttggtgtgcagtttgccagtcaactcgtaaggaacactgcataatggttgctgctctgattatccattctctatggtgtgtaacatgcattgcaatatcgtggcccattcaatccggccctgtctgagctacgttttgtagccccgtttgagctacgttgtttgtgcccctgtctgagctcggctctgaacatcaagctatgttagtttgcaggatctctgaac

SEQ ID NO: 4127 - DNA, 2046 bp, Oryza sativa
acatgggccggcctcgcggcttcgtttgcagcgagttcctcaccctataaacacgcagccacacaagcagagcacgagggagacccaacccagcaagcaagcaaacccaaacccacccacctccgctccgcggccgtcttcttcttccctttcttccaccgcaagaagaagaagaaaccccacccgagccaagccccacacacaaagcgagcgactcggcggcggcggcgatggccacggtggcgatggacatctccaagccccctcccgcggcgggcggcgacgaggctgcggcggcgaaggggaggggcggcgccggaggaggaggtggggaggggctgcggcagtactacctgcagcacatccacgacctgcagctccagatccggcagaagacgcacaacctcaaccgcctcgaggcccagcgcaacgacctcaactcccgagttagaatgctcagggaagagctgcagttgcttcaagaacctggctcgtatgttggtgaggtggtgaaggtcatgggtaaatcaaaggttctagtgaaggtacatccagaaggcaaatatgtggtggatattgataaaagcattgatattacaaagatcacaccttcaacaagagttgctcttcgaaatgatagctatatgcttcatttgatcctgccaagcaaagttgatccgttggtcaatcttatgaaagttgagaaggttcctgattctacttatgatatgattggaggtcttgatcagcaaatcaaagagatcaaagaggtcattgaacttcctatcaaacatccagagctatttgagagtcttggaattgcccaaccaaagggtgtccttctctatggccctccaggcacaggaaaaacattgttggcacgtgcagttgctcatcacactgactgcaccttcatcagggtgtctggttccgagttagttcagaagtacattggtgagggttctcggatggtccgtgaactctttgttatggccagggaacatgcaccatccattattttcatggatgaaatagactccattggatctgctaggatggagtctggaactggcaacggtgacagtgaagtccagcgaaccatgcttgagcttctgaaccaacttgatggttttgaagcatcaaacaaaataaaggttctgatggcaacaaataggatagacatcttggatcaggcccttctgaggcctggtcgcatagacaggaaaattgaatttcctaatcctaatgaggattcacgctttgatatcttgaagattcattcaagaaaaatgaacttgatgcgtggtattgatctgaaaaagatcgctgaaaagatgaatggggcttcaggagccgagctcaaggcggtctgcacagaagctggaatgtttgctcttcgtgagagaagggtgcatgtaacacaagaggactttgagatggcagtggcgaaggtgatgaagaaagacacggaaaagaacatgtccctacggaagctctggaagtgaagctcacgtcttaatagcctaagctttcactgcatcgctgaagcagcggaagcatgtaactgcatgttgtggacttcttccatgtgctttagaatatgttgttccatggttaactttcagattttaagatgcacctatgataatatgatgttgaaaagtttaatttattgaattggctagatacacgatatgacattgctttcttgcaatgtacccctacgctgcctacttgggttgtttgcttgcctgttttgtgatctctcaagtcagaacatttgatttttcacccgctgtttcgccatgtgggtggttttgctgtgtcatgattgctgttgagatgaagcagcagtgtgctgattggagtgttcatggtacatgaggacatggagtgagcttggcaatagttctgaagtttggcatccatgtgcttggcacagttctgaacttctatagcggttttgcagctgcttagctgcttgtggtggttgacttgaccaaatatgaagataattttcatattataagactttttagcattgcc

SEQ ID NO: 4128 - DNA, 1771 bp, Oryza sativa
cgagggagacccaacccagcaagcaagcaaacccaaacccacccacctccgctccgcggccgtcttcttcttccctttcttccaccgcaagaagaagaagaaaccccacccgagccaagccccacacacaaagcgagcgactcggcggcggcggcgatggccacggtggcgatggacatctccaagccccctcccgcggcgggcggcgacgaggctgcggcggcgaaggggaggggcggcgccggaggaggaggtggggaggggctgcggcagtactacctgcagcacatccacgacctgcagctccagatccggcagaagacgcacaacctcaaccgcctcgaggcccagcgcaacgacctcaactcccgagttagaatgctcagggaagagctgcagttgcttcaagaacctggctcgtatgttggtgaggtggtgaaggtcatgggtaaatcaaaggttctagtgaaggtacatccagaaggcaaatatgtggtggatattgataaaagcattgatattacaaagatcacaccttcaacaagagttgctcttcgaaatgatagctatatgcttcatttgatcctgccaagcaaagttgatccgttggtcaatcttatgaaagttgagaaggttcctgattctacttatgatatgattggaggtcttgatcagcaaatcaaagagatcaaagaggtcattgaacttcctatcaaacatccagagctatttgagagtcttggaattgcccaaccaaagggtgtccttctctatggccctccaggcacaggaaaaacattgttggcacgtgcagttgctcatcacactgactgcaccttcatcagggtgtctggttccgagttagttcagaagtacattggtgagggttctcggatggtccgtgaactctttgttatggccagggaacatgcaccatccattattttcatggatgaaatagactccattggatctgctaggatggagtctggaactggcaacggtgacagtgaagtccagcgaaccatgcttgagcttctgaaccaacttgatggttttgaagcatcaaacaaaataaaggttctgatggcaacaaataggatagacatcttggatcaggcccttctgaggcctggtcgcatagacaggaaaattgaatttcctaatcctaatgaggattcacgctttgatatcttgaagattcattcaagaaaaatgaacttgatgcgtggtattgatctgaaaaagatcgctgaaaagatgaatggggcttcaggagccgagctcaaggcggtctgcacagaagctggaatgtttgctcttcgtgagagaagggtgcatgtaacacaagaggactttgagatggcagtggcgaaggtgatgaagaaagacacggaaaagaacatgtccctacggaagctctggaagtgaagctcacgtcttaatagcctaagctttcactgcatcgctgaagcagcggaagcatgtaactgcatgttgtggacttcttccatgtgctttagaatatgttgttccatggttaactttcagattttaagatgcacctatgataatatgatgttgaaaagtttaatttattgaattggctagatacacgatatgacattgctttcttgcaatgtacccctacgctgcctacttgggttgtttgcttgcctgttttgtgatctctcaagtcagaacatttgatttttcacccgctgtttcgccatgtgggtggttttgctgtgtcatgattgctgttgagatg

SEQ ID NO: 4129 - DNA, 1768 bp, Panicum virgatum
ccaacaagcaaacccaccgcttctgcaatccgggccgaaacctttcctcgaacgcaagaagaaccccaacccccgagccggcgatggcgacggtggcgatggacatctcgaagcccacgccggcggcgtccggcgacgaggccgcggcggcggcggcggcgaaggggaggagcggcggcgggggcgagggcctccgccagtactacctccagcacatccacgacctgcagctccagatccggcagaagacccacaacctcaaccgcctcgaggcccagcgcaacgacctcaactcccgagttagaatgctcagggaagagctgcagttgcttcaagagcctgggtcatatgttggtgaggtggtgaaggtcatgggcaaatctaaggttctggtgaaggtgcatccagaaggcaaatatgttgtggatattgataagagcattgatattacgaagatcacaccttcaacaagagttgctcttcgaaatgacagctatatgctccatctgatcctgccaagcaaagttgatccattggtcaatctcatgaaggttgagaaggttcctgactctacttatgatatgattggaggccttgaccagcaaattaaagagatcaaagaggtcatcgagcttccaatcaaacatcctgagctgtttgagagcctcggaattgcccagccaaagggtgtcctcctttatggacctccaggcacaggaaagactttgctggcacgtgcagttgctcatcacactgattgcaccttcatcagggtttctggttctgagctggttcagaagtatattggtgagggctcccgtatggttcgtgaactattcgttatggccagggaacacgcaccgtccattatatttatggacgaaatagattctattggatctgctagaatggagtcgggaactggcaacggtgatagtgaagtgcagcgtaccatgcttgagcttctgaaccagcttgatggttttgaagcatcaaacaaaattaaggttctgatggcaacgaacagaatcgacatcttggatcaagcccttctgaggcctggtcgcatagacaggaagattgaatttccaaatcccaatgaggattcacgtttcgatatcttgaagattcattcaagaaaaatgaacttgatgcgtggtattgatttgaaaaagatcgcagggaagatgaatggagcctcaggagctgagctgaaggcggtctgcacagaagctggcatgtttgcccttcgtgagagaagggtacacgttacacaggaggacttcgaaatggcggtcgctaaggtgatgaagaaagacacggagaagaacatgtccctgcgcaagctctggaagtgaggttcatgccagagatgtcccacaaccttcacagcctcgccaaagctcgctccttcatatcccgagctttttccgccttgccatagcagtggaatggtcacagcatgctccggaccttcaccatgtgtttttttctttaactttatgccgtgcatgcatatgtttaaagttttctgataacagatgtagtatgttgttgcaaagttaaaatttatggatggatcagctagatacaggataatgcattgttcgctcgtgatgtaccacgttacaatgcctacttggtttgcagtttgccggcccactcgtaatctggtctggttatccatggatgtttttgtcttcggatggtgccaagtggcacccatatgtttgtgaatatgcgtagacaccatgtcctgatccattcc

SEQ ID NO: 4130 - DNA, 1574 bp, Hordeum vulgare
aaaagccagaagcgaaccaaacgtgccggaaaagaaagctcccctcgaacccgagcagactcgagccacctacagagcggcggagcagacgagggtgccccgatggcggcggtggcgatggacatcgcgaagccctcggcgcttccggcgagcgtcgacgacccgtcggcggcgtcggccaagggcagggccggcggcggggaggggctgcgccagtactacctgcagcacatccacgacctgcagctccagatccggaccaagacgcacaacctcaaccgcctcgaggcccagcgcaacgacctcaactctcgcgttagaatgctccgggaagagttgcagctgcttcaagaaccgggctcatatgttggcgaggttgtgaaggttatgggcaagtcaaaggttctagtcaaggttcatccagaaggcaaatatgtcgttgatcttgataaaagtattgatattacaaagataaccccttcaacaagagttgctcttcggaacgacagctacatgcttcaccttatcctgcccagcaaagtcgatccactggttaatcttatgaaggtggagaaggttcctgactctacctacgatatgattggtgggcttgatcagcaaattaaagagatcaaggaggtgattgagcttcccattaagcatcctgagctgttcgagagtctcggaattgcccaaccaaagggcgtccttctatacgggcctccaggtacggggaaaacattacttgctcgtgcagttgctcatcacaccgactgcaccttcatcagggtgtcaggttctgagttggttcagaagtatattggagagggttcccggatggtccgtgaactctttgtgatggctagggagcatgcaccatccattatatttatggatgaaatagactctattggatctgctagaatggagtcaggatccggcaacggtgatagcgaggttcagcgtactatgcttgagcttctgaaccaacttgatggttttgaagcatcgaacaaaattaaggttcttatggcaacaaataggatagacatattggatcaagctcttctaaggcctggtcgtatcgataggaagatcgaatttccaaatcctaatgcagattcccgtggtgatattttgaagattcattcaaggaaaatgaacttgatgcgtggcattgatctgaaaaaaattgccgagaagatgaacggagcatcaggagcagagctaaaggcggtctgcacagaagctggaatgtttgcgctccgtgagagaagggtgcacgtcacccaggaggatttcgagatggctgtggcgaaggtgatgaagaaggatactgagaagaacatgtcgctgcggaagctatggaagtgaggccctcgttttagcgtccctgctttcgccggcatgtacccgtggtttaagcttatagcggcacatttgccagatgagctgcggatttcttgaattgtgtcgagaactgtaacttgcagtgccgtgcagctgcctcatcaaggttaaatttctttattgggttattatgagatgtgagagggaaccgttcgcttgcttgt

SEQ ID NO: 4131 - DNA, 1880 bp, Zea mays
gaacacggtttaacaaacaccctacccaaaggggcggaaaccaagccgccctgaccgccagacccaagccaacaagcaagagcattactactgcttccgaccgaaacctttcttggaacgcaagaaggatccccaccccgaccgacctaccctaatcggcgatggcgacggtggcgatggacatctcgaagcccactccagtggcgtccggcgacgaggccgcggcggcggccaaggggaggagcggcggagggggcgaggggctgcggcagtactacctgcagcacatccacgacctgcagctccagatccggcagaagacccacaacctcaaccgtctcgaggcccagcgcaatgacctcaactcccgagttagaatgctcagggaagagttgcagttgcttcaagagcctggctcatatgttggtgaggtggtgaaggtcatggggaaatcaaaggttctggtgaaggtacaccccgaaggcaaatatgttgttgatatagataagagcattgatatcacaaagatcacaccttcaacaagagtcgctcttcgtaatgatagctatatgctccatctgatcctaccaagcaaagttgatccattggtcaatctcatgaaagttgagaaggttcctgattctacatatgatatgattggaggccttgaccagcaaattaaagagatcaaagaggtcattgagcttccaatcaaacatccggaactatttgagagccttggaattgcccaaccaaagggtgtcctcctttatggacctccaggcacaggaaagacattgctggcacgtgcggttgctcatcacactgactgcaccttcatcagggtgtctggttctgaattggttcagaagtatattggtgaaggttcccggatggttcgggaactctttgttatggccagggaacatgcgccatccattatatttatggatgaaattgactctatcggatctgctagaatggagtctggaactggcaacggtgatagtgaagtgcagcgtaccatgcttgaacttctaaaccagcttgatggttttgaagcttcaaacaaaattaaggttttgatggcaacaaacagaatagacattttggatcaagcccttttgaggcctggccgcatagacaggaagattgagtttccaaatcctaacgaggactcacgtttcgatattctgaagatccattcaaggaaaatgaacttgatgcgtggtatcgatctgaaaaagatcgcagaaaagatgaatggggcctcaggagctgagctcaaggccgtctgtacagaggctggaatgtttgctctccgtgagagaagggtgcacgttacacaggaggacttcgagatggcagtggccaaggtgatgaagaaagacacggagaagaacatgtccctgcgcaagctctggaagtgaggctcatgccttgatgtacccaccgccacctttcacggcctctccctgaacggtgtaacggcatgctacggaccttttgcgacgtgccttgcatgcctgtgtttaaaggtttccttataacggttctaatatgttgttgccaagttgaattcatcagatcagctaggttacggtgaaccctgcataatagttactgctctcgtgtgtagcatgcattgcgatgtcgtggcccacacccaaattctcgtgtgtagcgaggggatggtgatagattttgccatcgagtggagccttgccgacaacgcgaatagaggaaaaagagagcgcgcaccggtagctcaggttttgaacggtgaacagttgctcgacctttgcttgaatgattgatagcaaaaagatagatgatttgaaatgtatggaaactcagtttgacaaaactcactgaaaact

SEQ ID NO: 4132 - DNA, 1751 bp, Panicum virgatum
agcaaacccaccacttctgcatccgggccgaaacctttcctcgaacgcaagaaagaagaacccccccgcaccgacccacccccgagccggcgatggcgacggtggcgatggacatctcgaagcccacgccggcggcgtccggcgacgaggccgcggcagcggcgaaggggaggagcagcggcggaggcgagggcctccgccagtactacctgcagcacatccacgacctgcagctccagatccggcagaagacccacaacctcaaccgcctcgaggcccagcgcaacgacctcaactcccgagttagaatgctcagggaagagctgcagttgcttcaagagcctggatcatatgttggtgaggtggtgaaggtcatgggcaaatcaaaggttctggtgaaggtgcacccagaaggcaaatatgttgtggatattgataagagcattgatattacgaagatcacaccttcaacaagagttgctcttcgaaatgacagctatatgctccatctgatcctgccaagcaaagttgatccattggtcaacctcatgaaggttgagaaggttcctgattctacttatgatatgattggaggccttgaccagcaaattaaagagatcaaagaggtcatcgagcttccaatcaaacatcctgagctgtttgagagccttggaattgcccagccaaagggtgtcctcctttatggacctccaggcacaggaaagacattgctggcacgtgcagttgctcatcacactgattgcaccttcatcagggtttctggttctgagctggttcagaagtatattggtgagggctcccgtatggttcgtgaactattcgttatggccagggaacacgcaccgtccattatatttatggatgaaatagattctattggatctgctagaatggagtctggaactggcaacggtgatagtgaagttcagcgtaccatgcttgagcttctgaaccagcttgatggttttgaagcatcaaacaaaattaaggttctgatggcaacgaacagaatcgacatcttggatcaagcccttctgaggcctggacgcatagacaggaagattgaatttccgaatcccaatgaggattcacgtttcgatatcttgaagattcattcaagaaaaatgaacttgatgcgtggtattgatctgaaaaagattgcagaaaagatgaatggagcctcaggagctgagctgaaggcggtctgcacagaagctggaatgtttgcccttcgcgagagaagggtacacgttacacaggaggactttgagatggcggtggccaaggttatgaagaaagacacggagaagaacatgtccctgcgcaagctctggaagtgaggttcatgccaaagatgccccacaaccttcacagcctcaccaaagctcgtgccttcaaatcctgagctttttccgccttgccatatagcagtggaatggtgtaactgcatgctccggaccttcgccatgtgtctttttttttaataactttatgccgtgcatgcctatgtttaaagttttctgataacagatgtagtatgttgttgcaaagttaaaatttatggatcggctagatacgggataattcattgctagctcgcgatgtaccacgttacaatgcctacttggtttgcagtttgccggccgtagtgaaactgcctactggtctggtgttttgtcttcagatggtgccaaatggtgccctgcaacatggtagctgaatttagtatt

SEQ ID NO: 4133 - DNA, 1678 bp, Triticum aestivum
ccctcgaacccgagcagactcgagccaaccccagagcggcggagcagacgagggggaatcccgatggcggcggtggcgatggacatcgcgaagccctcggcgctgccggcgagcgtcgacgacccgtcggcggcgtcggccaagggcagggccggcggcggggaggggctgcgccagtactacctgcagcacatccacgacctgcagctccagatccggaccaagacgcacaacctcaaccgcctcgaggcccagcgcaacgacctcaactctcgagttagaatgcttcgggaagagttgcagcttcttcaagaaccgggctcatatgttggcgaggttgtgaaggttatgggcaagtcaaaggttctagtcaaggttcatccagaaggcaaatatgttgtagatcttgataaaagtattgatattacaaagataaccccttcaacaagagttgctcttcggaacgacagctacatgcttcaccttatcctgcccagcaaagtcgatccactggttaatcttatgaaggtggagaaggttcctgactctacctatgatatgattggtggtcttgaccagcaaattaaagagatcaaggaggtgattgagcttcccatcaagcatcctgagctgtttgagagtcttggaattgcccaaccaaagggtgtccttctttacgggcctccaggtacagggaaaacattacttgctcgtgcagttgctcatcacacggactgcaccttcatcagggtgtcagggtctgagttggttcagaagtatattggagagggttcccggatggttcgtgaactctttgtgatggctagggagcatgcaccatccattatatttatggatgaaatagactctattggatctgctagaatggagtcgggatccggcaacggtgatagcgaggttcagcgtacaatgcttgagcttctgaaccaacttgatggttttgaagcatcgaacaaaattaaggttcttatggcaacaaataggatagacatattggatcaagctcttctgaggcctggtcgtatcgataggaagatcgaatttccaaatcctaatgcagattcccgtggtgatattttgaagattcattcaagaaaaatgaacttgatgcgtggcattgatctgaaaaaaattgctgagaagatgaacggtgcatcaggagcagagctaaaggcggtctgcacagaagctggaatgtttgccctccgcgagagaagggtgcacgtcacccaggaggatttcgagatggccgtggcgaaggtgatgaagaaggataccgagaagaacatgtcactgcggaagctatggaagtgaggccctcgttttagcatctcagcttttgccggcatgtatcggtggtttaaacttatagcggcacatttgccagatgagctgcgggtttcatgaaccgcgtcgacaactgtaacttgcagtgccttgcagctgcctcttcagggttaaatttctttattgggttattatgagatgggaaccgttcgtttgcttgtaatgtatgttgctttgtcgactagattggttagccttgctgtgctgagaacggtgaccgcaatggtgtgttgttttacttgaatgttgcaaatgttatttctagagaagccattcttcattgttctcttttgtccatccaaaggaaaat

SEQ ID NO: 4134 - DNA, 1713 bp, Triticum aestivum
ccctcgaacccgagcggactcgagccacccccagagcggcggagcagacgagggggaatcccgatggcggcggtggcgatggacatcgcgaagccctcggcgctgccggcgagcgtcgacgacccgtcggcggcgtcggccaagggcagggccggcggcggggagggcctgcgccagtactacctgcagcacatccacgacctgcagctccagatccggaccaagacgcacaacctcaaccgcctcgaggcccagcgcaacgacctcaactctcgagttagaatgctccgggaagagttgcagctgcttcaagaaccgggctcatatgttggcgaggttgtgaaggtcatgggcaagtcaaaggttctagtgaaggttcatccagaaggcaaatatgttgtagatcttgataaaagtattgatattacaaagataaccccttcaacaagagttgctcttcggaacgacagctacatgcttcaccttatcctgcccagcaaagtcgatccactggttaatcttatgaaggtggagaaggttcctgactctacctatgatatgattggtggtcttgatcagcaaattaaagagatcaaggaggtgattgagcttcccatcaagcatcctgagctgtttgagagtctcggaattgcccaaccaaagggtgtccttctttacgggcctccaggtacagggaaaacattacttgctcgtgcagttgctcatcacaccgactgcaccttcatcagggtgtcaggttctgagttggttcagaagtatattggagagggttcccggatggttcgtgaactctttgtgatggctagggagcatgcaccatccattatatttatggatgaaatagactctattggatctgctagaatggagtcgggatctggcaatggtgatagcgaggttcagcgtactatgcttgagcttctgaaccaacttgatggttttgaagcatcgaacaaaattaaggttcttatggcaacaaataggatagacatattggatcaagctcttctaaggcctggtcgtatcgataggaagatcgaatttccaaatcctaatgcagattcccgtggtgatattttgaagattcactcaaggaaaatgaacttgatgcgtggcattgatctgaaaaaaattgccgagaagatgaacggagcatcaggagcagagctaaaggcggtctgcacagaagctggaatgtttgccctccgcgagagaagggtgcacgtcacccaggaggatttcgagatggccgtggccaaggtgatgaagaaggataccgagaagaacatgtcgctgcggaagctatggaagtgaggccctcgttttagcatctcagctttcgccggcatgtatcggtggtttaagcttatagcggcacatttgccagatgagctgcgggtttcttgaaccgtgtcgacaactgtaacttgcagtgccttgcagctgcctcatcagggttaaatttctttattgggttatattatgagacgggagatgggaaccgttcgcttgcttgtaatgtatgttgctttgtcgactagattggtagcctcgctgtgctgagaagggtgaccgcaatggtgtgctgttttacttgaatgtggcaaatgttatttctagggaaactcttcttcagtccttagctatttgttctcttttgtccatccgaagggaaataagaaaagggaactc

SEQ ID NO: 4135 - DNA, 1551 bp, Secale cereale
ccactccgcttccgggccgagaaaaaggctttcttcttccgccgccgcaagaagaggcagagggaacaaaagctttcgtcgaccgcaaggagaagaaaccaaccaaaccccagctccatggcgacggtggcgatggacatctcgaagccccctccggccgcgtccggcgaagagtcgaccaagggcgcgcgcggcggaggcgaggggctgcggcagtactacctgcagcacatccacgacctgcagctccagattcgccagaagacccacaacctcaaccgcctcgaggcccagcgcaacgacctcaactcccgagttagaatgcttagggaagagctacagttactccaagaacctggctcttatgttggtgaggtggtgaaggtcatgggcaaatcaaaggttctagttaaggtgcatccagaaggcaaatatgtagtagatattgataagagcatcgatatcacaaaaatcacaccttcaacaagagttgctcttcggaatgatagctatatgcttcatttggtccttccaagcaaagttgatccactggtcaatcttatgaaagttgagaaggtcccagattctacatatgatatgattggaggtcttgatcagcaaatcaaggagatcaaagaggtcatcgagcttcctatcaaacatcctgagttatttgagagccttggaattgcccagccaaagggtgtcctcctttatggaccaccagggacaggcaaaacattactggcacgtgctgttgctcatcacaccgactgtaccttcatcagggtatctggttctgagttggttcagaaatatattggtgagggctcccggatggttcgtgaactctttgttatggctagggagcatgcaccatctattatattcatggatgaaatagactccattggatctgctagaatggagtctggaactggcaacggtgatagtgaagtgcaacggaccatgcttgagcttctaaaccaacttgatggttttgaagcatcaaacaaaattaaggttctgatggcaacaaaccggatcgacatcttggatcaagcccttttgaggccaggccgcatagacaggaagattgaatttccaaatcctaatgaggattcacgaggtgatatcttgaagattcattcaagaaggatgaacttgatgcgtggaattgatctgaaaaagattgcgggaaagatgaatggcgcttcaggagccgagctaaaggcggtctgcaccgaagccggaatgtttgctctccgcgagagaagggtgcacgtaacgcaggaggacttcgagatggcggtggccaaggtgatgaagaaggacaatgagaagaacatgtccttgcggaagctgtggaagtgaggatcagagctttctccgccttgctgaggctgtggaagtgtgtaactgcacgttgctggacttgtatttttaacttatgtcgttccatggttaacagagtttttaagatacgcatgtggtagcataattaactacgtataatgtttgataatcgaactcgttgaattagctacgcaa

SEQ ID NO: 4136 - DNA, 1673 bp, Hordeum vulgare
cctctccgcttccggcccgaggagaaaaaaaaaactttcttcttccgccgcaagaagaagaggccgaggaataaagctttcgtcgagcgcagggagaagaaacccaaccaaaccccggggatggcgacggtggcgatggacatctcgaagcccccgccggccgcgtccggcgacgagtcggccaagggcgcgcgtggcggaggggaggggctgcggcagtactacctgcagcacatccacgacctgcagctccagatccgccagaagacccacaacctcaaccgcctcgaggcccagcgcaacgacctcaactcccgagttagaatgctcagggaagagctacagttgctccaagagcctggctcttatgttggtgaggtggtgaaggtcatgggcaaatcaaaggttctagtcaaggtgcatccagaaggcaaatatgtagtagatattgataagagcatcgatattacaaaaatcacaccttcgacaagagttgctcttcggaatgatagctatatgcttcatttggttctaccaagcaaagttgatccactggtcaaccttatgaaagttgagaaggtcccggattccacgtatgatatgattggaggtcttgatcagcaaatcaaggagatcaaagaggtcattgagcttcctatcaaacatcctgagttatttgagagccttggaattgcccagccaaagggtgtcctcctttatggaccaccagggacaggcaaaacattactggcacgtgcagtcgctcatcacaccgactgtaccttcatcagggtatctggttccgagttggttcagaagtatattggtgagggctcccggatggttcgtgaactctttgttatggctagggagcatgcaccatctattatattcatggatgaaatagactccattggatctgctagaatggagtctggaactggcaacggtgatagtgaagtgcaacggaccatgcttgagctgctaaaccaacttgatggttttgaagcatcaaacaaaattaaggttctgatggcaacaaaccggatagacatcttggatcaagcccttttgaggcctggccgcatagacaggaagattgaatttccaaatcctaatgaggattcacgaggtgacatcttgaagattcattcaaggaggatgaacttgatgcgtggaattgatctgaaaaagattgcgggaaagatgaatggcgcttcaggagctgagctaaaggcggtgtgcaccgaagccggaatgtttgctctccgcgagagaagggtgcacgtaacgcaggaggactttgagatggcggtggccaaggtgatgaagaaggacaatgagaagaacatgtccttgcggaagctgtggaagtgaggacccgagctttctccgccttgctgaagctgtgaaagcgtgtaactgcacgttgctggacttgtattttttaacttgtgtcgttccatggttaacaaagtttttaagatccgcatgtggtagcataattaactacgtataatgtttgatgatcgaactagttgaattagctacgcaatctgcctgcctatggtcgtttctcttaccacgcgtatagacgtacgagttgcagccgtggctgtgttgtgaacctgtttgtttatttatttattccctccgtatgagtttgttagcaa

SEQ ID NO: 4137 - DNA, 1480 bp, Brachypodium distachyon
aacctctctcaaaaaaaaagtgaacaggaacaaaagctttcgtcgaccgcaggaagagaaccaaaccaaacccagctcccccagccgacgatggcgacggtggcgatggacatctcgaatcccctaccggtcgcgtccggcgaggacgcggcgaagggcgcgcgcggcggaggggaggggctgcggcagtactacctgcaacacatccacgacctgcagctccagatccgccagaagacccacaacctcaaccgcctcgaggcccagcgcaacgatctcaactcccgagttagaatgcttagggaagagttacagctgcttcaagaaccaggctcttatgttggtgaggtggtgaaggtcatgggcaaatcaaaggttctagtgaaggtgcatccggaaggcaaatatgtggtagatattgataagagcatcgatattacgaaaataacaccttcaacaagagttgcgctccggaatgatagctatatgctccatttgatcctgcctagcaaagtcgatccattggtcaatcttatgaaagttgaaaaggttccagattctacttatgatatgattggaggtcttgaccagcaaatcaaggagatcaaagaggtcattgagcttcccatcaaacatcctgagctatttgagagccttggaattgcccagccaaagggtgtcctcctttacggacctccaggcactggaaaaacattactggcgcgtgcagttgctcatcacactgactgtaccttcatcagggtatctggttctgaattggttcagaagtatattggtgagggatcgcggatggtccgtgaactctttgtaatggctagggagcacgcaccatccattatattcatggacgaaatagactctattggatctgctagaatggagtctggaactggcaacggtgatagtgaagtgcagcgcaccatgcttgagcttctaaaccaacttgatggttttgaagcatcaaacaaaattaaggttctgatggcaacaaaccggatagatatcttggaccaagcccttctgaggcctggccgcatagacaggaaaatcgaattcccgaaccctaatgaggattcacgaggtgatatcttgaagattcactcaagaagaatgaacttgatgcgtggaattgatctgaaaaagatcgctggaaagatgaatggagcttcaggagccgagctaaaggcggtctgcaccgaagcgggaatgtttgctctccgggagagaagagtgcacgtaacccaggaagactttgagatggcggtggccaaggtgatgaagaaggacaacgagaagaacatgtccctgcggaagctgtggaagtgaagacgcccccgtctcaaaaccccacccaaaagcttttgccgcttgctgaagctgcggaagcctgtaactgcacgttgttggacttgtattttaagttatgccgttccatgtttaaaacaaaggtttaagattc

SEQ ID NO: 4138 - DNA, 1986 bp, Brachypodium distachyon
atgcctgtcctggctcaaaattttgtcgtgccgggcccaaggccgggatttttcccatacctccgaccggcccagaaaagcccggtccgatggccagcaagcggtggaccagacacaaacccaacaagcaaccctctcaaaagaaaaaaggaaaacaatccactctgcggcttgcttaaaaaaaaagggagcaacctctctcaaaaaaaaagtgaacaggaacaaaagctttcgtcgaccgcaggaagagaaccaaaccaaacccagctcccccagccgacgatggcgacggtggcgatggacatctcgaatcccctaccggtcgcgtccggcgaggacgcggcgaagggcgcgcgcggcggaggggaggggctgcggcagtactacctgcaacacatccacgacctgcagctccagatccgccagaagacccacaacctcaaccgcctcgaggcccagcgcaacgatctcaactcccgagttagaatgcttagggaagagttacagctgcttcaagaaccaggctcttatgttggtgaggtggtgaaggtcatgggcaaatcaaaggttctagtgaaggtgcatccggaaggcaaatatgtggtagatattgataagagcatcgatattacgaaaataacaccttcaacaagagttgcgctccggaatgatagctatatgctccatttgatcctgcctagcaaagtcgatccattggtcaatcttatgaaagttgaaaaggttccagattctacttatgatatgattggaggtcttgaccagcaaatcaaggagatcaaagaggtcattgagcttcccatcaaacatcctgagctatttgagagccttggaattgcccagccaaagggtgtcctcctttacggacctccaggcactggaaaaacattactggcgcgtgcagttgctcatcacactgactgtaccttcatcagggtatctggttctgaattggttcagaagtatattggtgagggatcgcggatggtccgtgaactctttgtaatggctagggagcacgcaccatccattatattcatggacgaaatagactctattggatctgctagaatggagtctggaactggcaacggtgatagtgaagtgcagcgcaccatgcttgagcttctaaaccaacttgatggttttgaagcatcaaacaaaattaaggttctgatggcaacaaaccggatagatatcttggaccaagcccttctgaggcctggccgcatagacaggaaaatcgaattcccgaaccctaatgaggattcacgaggtgatatcttgaagattcactcaagaagaatgaacttgatgcgtggaattgatctgaaaaagatcgctggaaagatgaatggagcttcaggagccgagctaaaggcggtctgcaccgaagcgggaatgtttgctctccgggagagaagagtgcacgtaacccaggaagactttgagatggcggtggccaaggtgatgaagaaggacaacgagaagaacatgtccctgcggaagctgtggaagtgaagacgcccccgtctcaaaaccccacccaaaagcttttgccgcttgctgaagctgcggaagcctgtaactgcacgttgttggacttgtattttaagttatgccgttccatgtttaaaacaaaggtttaagattcacatgtggtagcataatgttgcatagttaaacttatggtgtttggcttatccggtacaccagtacctccatacaagtttggagtcgtgccttccagtcctctgaggaggcgggcgtgcacccactgaaaaatactccctccgatccatgtctcaaatttgtccaaatatagatttatttttgtctaaaaagcgtttagatacgtgtaatatcttttgtctaaaaagcgtttagatacgtgtaatatttcgacaattaatatagatcggagggagtacgatggatatgaattcaaagatgtgattgttatgtcac

SEQ ID NO: 4139 - DNA, 1796 bp, Leymus cinereus x Leymus triticoides
  misc_feature (8)..(10): n is a, c, g, or t
  misc_feature (46)..(47): n is a, c, g, or t
  misc_feature (51)..(51): n is a, c, g, or t
  misc_feature (54)..(54): n is a, c, g, or t
  misc_feature (56)..(56): n is a, c, g, or t
  misc_feature (59)..(59): n is a, c, g, or t
  misc_feature (63)..(63): n is a, c, g, or t
  misc_feature (87)..(87): n is a, c, g, or t
  misc_feature (97)..(97): n is a, c, g, or t
  misc_feature (1619)..(1619): n is a, c, g, or t
  misc_feature (1621)..(1621): n is a, c, g, or t
  misc_feature (1625)..(1625): n is a, c, g, or t
  misc_feature (1636)..(1636): n is a, c, g, or t
gacccccnnnaacaacccaccccgctaccgggccgtgaaaaaagcnntctnctncngcngcangaagaagaggccgaggaataaagntttcgtcgancgcaaggagaagaaacaaaccaaaccaaaccccagctccatggcgacggtggcgatggacatctcgaagcccccgccggccgcgtccggcgacgagtcggccaagggcgcgcgtggcggaggtgaggggctgcggcagtactacctgcagcacatccacgacctgcagctccagatccgccagaagacccacaacctcaaccgcctcgaggcccagcgcaacgacctcaactcccgagttagaatgcttagggaagagttacagttgctccaagagcctggctcttatgttggtgaggtagtgaaggtcatgggcaaatcaaaggttctagtcaaggtgcatcccgaaggcaaatatgtagtagatattgataagagcatcgatatcacaaaaatcacaccttcaacaagagttgctcttcggaatgatagctatatgcttcatttggtattaccaagcaaagttgatccactggtcaatcttatgaaagttgagaaggtcccagattccacatatgatatgattggaggtcttgatcagcaaatcaaggagatcaaagaggtcatcgagcttcctatcaaacatcctgagttatttgagagccttggaattgcccagccaaagggtgtcctcctttatggaccaccagggacaggcaaaacattactggcacgtgcagttgctcatcacaccgactgtacctttatcagggtatctggttccgagttggttcagaagtatattggtgagggctcccggatggttcgtgaactctttgttatggctagggagcatgcaccatctattatattcatggatgaaatagactccattggatctgctagaatggagtctggaactggcaacggtgatagtgaagtgcaacggaccatgcttgagcttctaaaccaacttgatggttttgaagcatcaaacaaaattaaggttctgatggcaacaaaccggatagacatcttggatcaagcccttttgaggcctggccgcattgacaggaagattgaatttccaaatcctaacgaggattcacgaggtgacatcttgaagattcattcaagaaggatgaacttgatgcgtggaattgatctgaagaagatcgcgggaaagatgaatggtgcttcaggagctgagctaaaggcggtctgcactgaagccggaatgtttgctctccgggagagaagggtgcacgtaacacaggaggactttgagatggcggtggccaaggtgatgaagaaggacaatgagaagaacatgtccttgcggaagctgtggaagtgaggactccccacttcccaagacccgagctttctccgccttgctgaggctgtggaagcgtgtaactgcacgttgttttacttgtatttttttttttgcgggggttttacttgtattttaacttatgtcattccatggttaaagtttttaagatgcgcatgtggtagcataattaactataatatttcatagtcgaactcgttgaattagctacgcaatctgcctgccnanggtngtttttcttanccggtacctacgtacgagtttatgtatactagcaaaagagtccgtgcgttgtaacgggtgaaaaaaaaataccacatttccctaacccaataatcatgactctagactctaataggttcacgtcctttatttcaatacatggtatcccatttgtgtgcca

SEQ ID NO: 4140 - DNA, 1389 bp, Pennisetum glaucum
cccccggcgctgccggcggccgacgacaagtcggctgcggcgaaggggcgtggcgcggggaaggggttgggacggtactacaatcagcacatccacgacgtcgccctcgagttcctgcagaagaccgaagacctccaccgccaggaggcccagcgcaacgtcatcaactcccgagttaaattttgccgggatgagttgcgtctgcttcaagaaccggcttcacatgttggtgaggttgtgaaggtgatgagcaagtcaaaggttttagtgaaggtgcatccagaaggcaaatacgtcgtagatgttgataaaaacatagatattgcaaagctcacaccctccacaagagttgctcttcgagacggaagctatactcttcatgttatcctgcccagtaaagtcgatccattggttaatcttatgaaggttgagaaggttcctgattctacttatgatatgattggtggtcttgatcagcaaattaaagagatcaaagaggtgatcgagcttccaattaaacatcctgagttgtttgagagtcttggcattgcacaaccgaagggtgtcattctatatggccctccaggtacaggaaaaacattacttgcacgtgcggttgctcatcacacagactgcaccttcattagggtctcaggttctgagctggttcagaagtacattggagagggttcccggatggttcgcgaactttttgtgatggctagggaacatgcaccatccattatatttatggacgaaatagactccataggatctgctaggatggggtcacgcggtggtgacagtgaggttcagcgaaccatgcttgagcttctaaatcagcttgatggttttgaagcatcaaacaagattaaggttcttatggcaacaaacaggatagacatactggatcaagccctcctgaggcctggccgcattgacaggaagattgaatttccaaatccaaatgaaacttctcgctttgatattttgaagatccactccagaagaatgaacttgatgcgtgacattgatctgaagaagattgctgcaaagatgaatggagcatcaggagcagagttgaaggctatttgcacagaagcgggaatgtttgcccttcgtgagagaagagtgcacgtcacccaggaggatttcgatatggctgtagcgaaggtgatgaagaaggatacggagaagaacatgtcactgcggaaactctggaagtgaggtggtcacctggcgtgtcatggccaatgcttccgtgccgagactgctgaaggcctgaagcgaatggccgtgcgttgtcggatgaactgttgcaagattcagagaatgtttgtcaaacctgtcaatgaagtgtacttgtgtaacagctttataagttataaa

SEQ ID NO: 4141 - DNA, 1709 bp, Triticum aestivum
gaccaagacccaacccaaacaacccactccgcttccgggccgagaaaaaaaaagctttcttcttccgccgcaagaagaaagaggccgaggaataaagctttcgtcgaccgcaagcagaagaaaccaaaccaaaccccagctccatggcgacggtggcgatggacatctcgaagcccccgccggccgcgtccggcgacgagtcggccaagggcgcgcgtggcggaggcgaggggttgcgccagtactacctgcagcacatccacgacctgcagctccagatccgccagaagacgcacaacctcaaccgcctcgaggcccagcgcaacgacctcaactcccgagttagaatgcttagggaagagctacagttactccaagagcctggctcttatgttggtgaggtggtgaaggtcatgggcaaatcaaaggttctagttaaggtgcatccagaaggcaaatatgtagtagatattgataagagcatcgatatcacaaaaatcacaccttcaacaagagttgctcttcggaatgatagctatatgcttcatttggtccttccaagcaaagttgatccactggtcaatcttatgaaagttgagaaggtcccagattctacatatgatatgattggaggtcttgatcagcaaatcaaggagatcaaagaggtcatcgagcttcctatcaaacatcctgagttatttgagagccttggaattgcgcagccaaagggtgtcctcctttatggaccaccagggacaggcaaaacattactggcacgtgcagttgctcatcacaccgactgtaccttcatcagggtatctggttctgagttggttcagaagtatattggtgagggctcccggatggttcgtgaactctttgttatggctagggagcatgcaccatctattatattcatggatgaaatagactccattggatctgctagaatggagtctggaactggcaatggtgatagtgaagtgcaacggaccatgcttgagcttctaaaccaacttgatggttttgaagcatcaaacaaaattaaggttctgatggcaacaaaccgcatagacatcttggatcaagcccttttgaggcctggccgcatagacaggaagattgaatttccaaatcctaatgaggattcacgaggtgatatcttgaagattcattcaagaaggatgaacttgatgcgtggaattgatctgaaaaagattgcgggaaagatgaatggcgcttcaggagctgagctaaaggcggtctgcaccgaagccggaatgtttgctctccgtgagagaagggtgcacgtaacacaggaggacttcgagatggcggtggccaaggtgatgaagaaggacaatgagaagaacatgtccttgcggaagctgtggaagtgaggacccgagctttctccgccttgttgaggctgtggaagcgtgtaactgcacgttgctggacttgtattcttaacttatgtcgttccatggttaacaaagtttttaagatacgcatgtggtagcataattaactacgtataatgtttgataatcgaactcgttgaattagctacgcaatctgcctgcatatggtctgttttcttaccacgtataggagtatctacgtacgagttgcagccgtgcctgtgctgtgaatgttaataacttctttgtataaactttgaagagtttgactcaagaaacctaata

SEQ ID NO: 4142 - DNA, 1747 bp, Secale cereale
gactcgcccgtccagcccagagaaccagaagagagaagcgaaccaaacgtgccggaaaagaagctcaccctcgaacccgagcgaccagactcgagccaaccccagagcggcggagcagacgaggggaaatcccgatggcggcggtggcgatggacatcgcgaagccctcggcgctgccggcgagcgtcgacgacccttcggcggcgtccgccaagggcagggccggcagcggggaggggctgcgccagtactacctgcagcacatccacgacctgcagctccagatccggaccaagacgcacaacctcaaccgcctcgaggcccagcgcaacgacctcaactctcgagttagaatgctccgggaagagttgcagcttcttcaagaaccgggctcatatgttggcgaggttgtgaaggttatgggcaagtcaaaggttctagtcaaggtccatccagaaggcaaatatgttgtagatcttgataaaagtattgatatcacaaagataaccccttcaacaagagttgctcttcgaaacgacagctacatgcttcaccttatcctgcctagcaaagtcgatccactggttaatcttatgaaggtggagaaggttcctgactctacctatgatatgattggtggtcttgatcagcaaattaaagagatcaaggaggtgattgagcttcctatcaagcatcctgagctgtttgagagtctcggaattgcccaaccaaagggtgtcctcctttacgggcctccaggtacagggaaaacattacttgctcgagcagttgctcatcacaccgactgcaccttcatcagggtgtcaggttcggagttggttcagaagtatattggagagggttcccggatggttcgtgaactctttgtgatggctagggagcatgcaccatccattatatttatggatgaaatagactctattgggtctgctagaatggagtcgggatccggcaacggtgatagcgaggttcagcgtaccatgcttgagcttctgaaccaacttgatggttttgaagcatcgaacaaaattaaggttcttatggcaacaaataggatagacatattggatcaagctcttctgaggcctggtcgtatcgataggaagatcgaatttccaaatcctaatgcggattcccgtggtgatattttgaagattcactcaaggaaaatgaacttgatgcgtggcattgatctgaaaaaaattgccgagaagatgaacggagcatcaggagcagagctaaaggcggtctgcacagaagctggaatgtttgccctccgcgagagaagggtgcacgtcacccaggaggattttgagatggccgtggcaaaggtgatgaagaaggataccgagaagaacatgtcgctgcggaagctatggaagtgaggcccccgttttagcatctcagcttttgccggcatgtatgggtggtttaagcttatagcggcacatttgccagatgggctgcgggtttcttgaaccgtgtcgacaagtgtaacttgcagtgccttgcagctgcctcatcagggttaaatttctttattattgggttatattatgagacgtgagatgggaaccgttcgcttgcttgtaatgtatatgttgctttgtcgactagattggtagcctcgctgtgctgagaacggtgaccgcaatggtgtttttttttacttgaatgtggcaaatgttatttctagggattcattgttcccttttgtccatccaaa

SEQ ID NO: 4143 - DNA, 1724 bp, Secale cereale
gaaaagaagctcaccctcgaacccgagcgagcagactcgagccaaccccagagcggcggagcagacgaggggaaatcccgatggcggcggtggcgatggacatcgcgaagccctcggcgctgccggcgagcgtcgacgacccttcggcggcgtccgccaagggcagggccggcagcggggaggggctgcgccagtactacctgcagcacatccacgacctgcagctccagatccggaccaagacgcacaacctcaaccgcctcgaggcccagcgcaacgacctcaactctcgagttagaatgctccgggaagagttgcagcttcttcaagaaccgggctcatatgttggcgaggttgtgaaggttatgggcaagtcaaaggttctagtcaaggtccatccagaaggcaaatatgttgtagatcttgataaaagtattgatatcacaaagataaccccttcaacaagagttgctcttcgaaacgacagctacatgcttcaccttatcctgcccagcaaagtcgatccactggttaatcttatgaaggtggagaaggttcctgactctacctatgatatgattggtggtcttgatcagcaaattaaagagatcaaggaggtgattgagcttcctatcaagcatcctgagctgtttgagagtctcggaattgcccaaccaaagggtgtcctcctttatgggcctccaggtacagggaaaacattacttgctcgagcagttgctcatcacaccgactgcaccttcatcagggtgtcaggttcggagttggttcagaagtatattggagagggttcccggatggttcgtgaactctttgtgatggctagggagcatgcaccatccattatatttatggatgaaatagactctattgggtctgctagaatggagtcgggatccggcaatggtgatagcgaggttcagcgtaccatgcttgagcttctgaaccaacttgatggttttgaagcatcgaacaaaattaaggttcttatggcaacgaataggatagacatattggatcaagctcttctgaggcctggtcgtatcgataggaagatcgaatttccaaatcctaatgcggattcccgtggtgatattttgaagattcactcaaggaaaatgaacttgatgcgtggcattgatctgaaaaaaattgccgagaagatgaacggagcatcaggagcagagctaaaggcggtctgcacagaagctggaatgtttgccctccgcgagagaagggtgcacgtcacccaggaggatttcgagatggccgtggcaaaggtgatgaagaaggatactgagaagaacatgtcgctgcggaagctatggaagtgaggccctcgttttagcatctcagcttttgccggcatgtatgggtggtttaagcttatagcggcacatttgccagatgagctgcgggtttcttgaaccatgtcgacaagtgtaacttgcagtgccttgcagctgcctcatcagggttaaatttctttattgggttatattatgagacgtgagatgggaaccgttcgcttgcttgtaacgtatatgttgctttgtcgactagattggtagcctcgctgtgctgagaacggtgaccgcaatggtgtgttgttttacttgaatgtggcaaatgttatttctagggaagccattcttcattgttctcttttgtccatccaaaggaaaataagaaaagggaactcaaaa

SEQ ID NO: 4144 - DNA, 1510 bp, Pseudoroegneria spicata
agctttcgtcgagcgcaaggagaagaaaccaaaccaaaccccagctccatggcgacggtggcgatggacatctcgatgcccccgccggccgcgtccggcgacgagtcggccaagggcgcgcgtggcggaggcgaggggctgcggcagtactacctgcagcacatccacgacctgcagctccagatccgccagaagacgcacaacctcaatcgcctcgaggcccagcgcaacgacctcaactcccgagttagaatgctcagggaagagctacagttgctccaagagcctggctcttatgttggtgaggtggtgaaggtcatgggcaaatcaaaggttctagtcaaggtgcatccagaaggcaaatatgtagtagatattgataagagcatcgatatcacaaaaatcacaccttcaacaagagttgctcttcggaatgatagctatatgcttcatttggtcctaccaagcaaagttgatccactggtcaatcttatgaaagttgagaaggtcccagattccacatatgatatgattggaggtcttgatcagcaaatcaaggagatcaaagaggtcatcgagcttcctatcaaacatcctgagttatttgagagccttggaattgcccagccaaagggtgtcctcctttatggaccaccagggacaggcaaaacattactggcacgtgcagttgctcatcacaccgactgtaccttcatcagggtatctggttccgagttggttcagaaatatattggtgagggctcccggatggttcgtgaactctttgttatggctagggagcatgcaccatctattatattcatggatgaaatagactccattggatctgctagaatggagtctggaactggcaatggtgatagtgaagtgcaacggaccatgcttgagcttctaaaccaacttgatggttttgaagcatcaaacaaaattaaagttctgatggcaacaaaccggatagacatcttggatcaagcccttttgaggcctggccgcatagacaggaagattgaatttccaaatcctaatgaggattcacgaggtgacatcttgaagattcattcaagaaggatgaacttgatgcgtggaattgatctgaaaaagatcgcaggaaagatgaatggtgcttcaggagccgagctaaaggcggtctgcaccgaagccggaatgtttgctctccgtgagagaagggtgcacgtaacgcaggaggacttcgagatggcggtggccaaggtgatgaagaaggacaatgagaagaacatgtccttgcggaagctgtggaagtgaggacccgagctttctctgccttgccgaggctgtagaagcgtgtaactgcacgttgctggacctgtatttttaacttatgtcgttccatggttaacaaagtttttaagatacgcatgtggtagcatataattaactacgcataatgtttgataatcgaactcgttgaattagctacgcaatataaatacctatgataattttttca

SEQ ID NO: 4145 - DNA, 1429 bp, Triticum aestivum
gcacgagccccgaccgacctaccctaatcggcgatggcgacggtggcgatggacatctcgaagcccactccagtggcgtccggcgacgaggccgcggcggcggccaaggggaggagcggcggagggggcgaggggctgcggcagtactacctgcagcacatccacgacctgcagctccagatccggcagaagacccacaacctcaaccgtctcgaggcccagcgcaatgacctcaactcccgagttagaatgctcagggaagagttgcagttgcttcaagagcctggctcatatgttggtgaggtggtgaaggtcatggggaaatcaaaggttctggtgaaggtacaccccgaaggcaaatatgttgttgatatagataagagcattgatatcacaaagatcacaccttcaacaagagtcgctcttcgtaatgatagctatatgctccatctgatcctaccaagcaaagttgatccattggtcaatctcatgaaagttgagaaggttcctgattctacatatgatatgattggaggccttgcccagcaaattaaagagatcaaagaggtcattgagcttccaatcaaacatccggaactatttgagagccttggaattgcccaaccaaagggtgtcctcctttatggacctccaggcacaggaaagacattgctggcacgtgcggttgctcatcacactgactgcaccttcatcagggtgtctggttctgaattggttcagaagtatattggtgaaggttcccggatggttcgggaactctttgttatggccagggaacatgcgccatccattatatttatggatgaaattgactctatcggatctgctagaatggagtctggaactggcaacggtgatagtgaagtgcagcgtaccatgcttgaacttctaaaccagcttgatggttttgaagcttcaaacaaaattaaggttttgatggcaacaaacagaatagacattttggatcaagcccttttgaggcctggccgcatagacaggaagattgagtttccaaatcctaacgaggactcacgtttcgatattctgaagatccattcaaggaaaatgaacttgatgcgtggtatcgatctgaaaaagatcgcagaaaagatgaatggggcctcaggagctgagctcaaggccgtctgtacagaggctggaatgtttgctctccgtgagagaagggtgcacgttacacaggaggacttcgagatggcagtggccaaggtgatgaagaaagacacggagaagaacatgtccctgcgcaagctctggaagtgaggctcatgccttgatgtacccaccgccacctttcacggcctctccctgaacggtgtaacggcatgctacggaccttttgcgacgtgccttgcatgcctgtgtttaaaggtttccttataacggttct

SEQ ID NO: 4146 - DNA, 1708 bp, Brachypodium distachyon
cagacccgtccagcgcccaagaaccagaagcaaagcaaacttgctggaaaagaagctctctctcgttgaaggtgatcccgagtcgactcgcccgaacaaacaaagcgccggaggttcgatggcggcggtggagatggcaatctcgaagccctcgactctgccgggcgtcgacgacccggcgtcgtcggcggcgaaggggagggccggcggcggggaggggctgcgccagtactaccagcagcacatccacgacctgcagctccagatccggcagaagacccacaacctcaaccgcctcgaggcccagcgcaacgacctcaactcccgagttagaatgctccgggaagagttgcagctacttcaagaaccgggctcatacgttggagaggttgttaaggttatgggcaagtcgaaggttctagtgaaggtgcacccagaaggcaaatatgttgtagatctcgataaaagtatcgatattacaaagataaccccttcaacgagggttgcccttagaaatgacagctacatgcttcaccttatcctgcccagcaaagtcgatccactggttaatctgatgaaggtggagaaggttcccgactctacctacgatatgattggtggtctggatcagcagatcaaagagatcaaggaggttattgagcttcccattaagcatcctgaactgtttgagagccttggtattgcccaaccaaagggcgtgcttctttatgggcctccgggtacaggaaaaacattacttgcacgtgcagttgctcatcacactgactgcaccttcattagggtgtctggctctgagttggttcagaagtatattggagagggttcccgaatggttcgggaactcttcgtgatggctagggaacatgcgccgtcgattatatttatggatgaaatagactctattggatctgctagaatggagtcaggaactggcaacggtgatagtgaggttcaacgtactatgcttgagcttctaaaccaacttgatggttttgaagcatcaaacaaaattaaggttcttatggcaacaaataggatagacatattggatcaagctctcctgaggccaggtcgtattgacaggaagattgagtttccaaatcctaacgcagattcccgtggtgatatcttgaagattcattcaagaaaaatgaacttgatgcgcggcattgatctgaaaaagattgccgagaagatgaacggagcatcaggggcggagctaaaggcggtctgcacagaagctggaatgtttgccctccgtgagagaagggtgcatgttacccaggaggatttcgagatggcagtggcgaaggttatgaagaaggatacagaaaagaacatgtcgctgcggaagctctggaagtgaagcattcgggcttgcttcccagctttgaacgccatgcaatcactttaagcttatagcggcactctgccagatgagctgcgaaactcaagtatctcaagatttgtaacttgcaatctggcgcagcagccaccaggttaaatttctttattgggttattatcaagggatgtgagatgtaaaccgttcacctgctgttaatgtaacttttgtccactatatttgtacgacgagctcgcttgcgctcatactaaacctcgctagagggtggaaagaatgagccgataacatgattacatgaagaagtttaaaccgtgatacagaa

SEQ ID NO: 4147 - DNA, 1675 bp, Avena sativa
gcccccgagccggggatggcgcaggaagaggcgcccgacgaatcgagctctcgtcgaccgcaagcagaagaaaccgaacagagcccagctcctgacccggaggagatggcgacggtggcgatggacgtctccaagcccacgccgggcgacgagtcggcggccaagggcgcgcgcggcggaggggaggggctgcggcagtactacctgcagcacatccacgacctgcagctccagatccggacgagcacccacaacctcaaccgcctcgaggcccagcgcaacgacctcaactccaaagttagagctcttagggaagagctacagttgcttcaagaacctggctcttatgtaggtgaggtggtgaaggtcatgggaaagtcaaaggttctagtcaaggtgcatccggaaggcaaatatgtcgtagatattgataagagcatcgatattacaaaaatcacaccttcaacaagagttgctcttcggaatgatagctatatgctccacttgatcctgccaagcaaagttgacccgttggtcaatcttatgaaagttgagaaggtcccagattctacatatgatatgattggaggtcttgatcagcagatcaaggagatcaaagaggttattgagcttcctatcaagcatcccgagttatttgagagccttggaattgcccagcccaagggtgttctcctttatggaccaccaggcacaggaaaaacattactggcacgtgcagttgctcatcacaccgactgtaccttcatcagagtatctggttctgagttggtccaaaagtatattggtgagggctcccggatggtccgtgagctctttgttatggctagggagcatgcaccatccattatattcatggacgaaatagactccattggatctgctagaatggagtctggaactggcaacggtgatagtgaggtgcaacgcaccatgcttgagcttcttaaccaacttgatggttttgaagcttcaaataaaattaaggttctgatggcaacaaaccggatagacattctggatcaagcccttttgaggcctggccgcatagacaggaagatcgaatttcctaatcctaatgaggattcacgaggtgatatcctgaagattcattctagaagaatgaacttgatgcgtggaattgatctgaaaaagattgcgggaaagatgaatggtgcttcaggagctgagctaaaggcggtttgcaccgaagctggaatgtttgctcttcgtgagagaagggtgcatgtgacgcaggaggacttcgagatggcggtggccaaggtgatgaagaaggataatgagaagaacatgtccttgcggaagctgtggaagtgaggaagtgcacctcctaaaactttcgctgccttgccgaggttgcggaagcctgtaactgcatgttgctggacttgtacttttaacgctatgtattttccctggttgccaatgtttttaagatacgcatctggtagcataatgatatgattacatagttaaattaaactcgttgaattggctacacaatctgccttcctactggttggctacgcaatccgtcttcctactggttgttttgcatatctgctatgtagctgtggctgtgacgaacttgttgatctgcctgttatattctccagatcgaagtgttatattctcc

SEQ ID NO: 4148 - DNA, 1683 bp, Avena sativa
gtaacccagcccccgagccggggatggcgcaggaagaggcgcccgacgaatcgagctctcgtcgaccgcaagcagaagaaaccgaacagagcccagctcctgacccggaggagatggcgacggtggcgatggacgtctccaagcccacgccgggcgacgagtcggcggccaagggcgcgcgcggcggaggggaggggctgcggcagtactacctgcagcacatccacgacctgcagctccagatccggacgagcacccacaacctcaaccgcctcgaggcccagcgcaacgacctcaactccaaagttagagctcttagggaagagctacagttgcttcaagaacctggctcttatgtaggtgaggtggtgaaggtcatgggaaagtcaaaggttctagtcaaggtgcatccggaaggcaaatatgtcgtagatattgataagagcatcgatattacaaaaatcacaccttcaacaagagttgctcttcggaatgatagctatatgctccacttgatcctgccaagcaaagttgacccgttggtcaatcttatgaaagttgagaaggtcccagattctacatatgatatgattggaggtcttgatcagcagatcaaggagatcaaagaggttattgagcttcctatcaagcatcccgagttatttgagagccttggaattgcccagccaaagggtgttctcctttatggaccaccaggcacaggaaaaacattactggcacgtgcagttgctcatcacaccgactgtaccttcatcagagtatctggttctgagttggtccaaaagtatattggtgagggctcccggatggtccgtgagctctttgttatggctagggagcatgcaccatccattatattcatggacgaaatagactccattggatctgctagaatggagtctggaactggcaacggtgatagtgaggtgcaacgcaccatgcttgagcttcttaaccaacttgatggttttgaagcttcaaataaaattaaggttctgatggcaacaaaccggatagacattctggatcaagcccttttgaggcctggccgcatagacaggaagatcgaatttcctaatcctaatgaggattcacgaggtgatatcctgaagattcattctagaagaatgaacttgatgcgtggaattgatctgaaaaagattgcgggaaagatgaatggtgcttcaggagctgagctaaaggcggtttgcaccgaagctggaatgtttgctcttcgtgagagaagggtgcatgtgacgcaggaggacttcgagatggcggtggccaaggtgatgaagaaggataatgagaagaacatgtccttgcggaagctgtggaagtgaggaagtgcacctcctaaaactttcgctgccttgccgaggttgcggaagcctgtaactgcatgttgctggacttgtacttttaacgctatgtattttccctggttgccaatgtttttaagatacgcatctggtagcataatgatatgattacatagttaaattaaactcgttgaattggctacacaatctgccttcctactggttggctacgcaatccgtcttcctactggttgttttgcatatctgctatgtagctgtggctgtgacgaacttgttgatctgcctgttatattctccagatcgaagtgttatattctcc

SEQ ID NO: 4149 - DNA, 1664 bp, Avena sativa
gagaacaagagaggcgaagtagacctgcttgcttgcgaggaaagaagctctcctctcacgcgacgcgaacccgagccgactccagaacatacatatagagcggcgatggcggcggtggcgatggacatcgcgaagccctcggcggttccggagaacgtcgaggacccggcgaaggggagggccggcggcggcggggaggggctgcgccagtactacctgcagcacatccacgacctgcagctccagatccggcagaagacccacaacctcaaccgcctcgaggcccagcggaacgacctcaactcccgagttaggatgctccgggaagagttgcagcttctgcaagaaccaggctcatatgttggggaggttgtgaaggttatgggaaagtcaaaggttctagtcaaggtgcatccagaaggcaaatatgttgtagatcttgataaaagcatcgacattaacaagattactccttcaacaagagttgctctacgaaacgacagctatatgcttcaccttatcctgcccagcaaagtcgatccactggttaatcttatgaaggtggagaaggttcctgactctacctatgatatgattggtggtcttgatcaacagatcaaagagatcaaggaggtgattgagcttcccattaagcatccagagctgtttgagagtctcggaattgcccaaccaaagggtgtccttctttacgggcctccaggtacaggaaaaacattacttgctcgtgcagttgctcatcacaccgactgtactttcatcagggtgtcaggttccgagttggttcagaagtatattggagagggttcccggatggttcgtgaactctttgtgatggctagggagcatgcaccatcaattatatttatggacgaaattgactccattggatctgctagaatggagtcaggaaccggcaatggtgacagtgaggttcagcgcactatgcttgagcttctaaaccaacttgatggttttgaagcatcgaacaaaattaaggttcttatggcaacaaataggatagacatattggatcaagctctcctgaggcctggtcgtattgacaggaagatcgaatttccgaaccctaacgcagattcccgtggtgatattttgaagattcattcaagaaagatgaatttgatgcgtggcattgatctgaaaaagattgctgagaagatgaatggagcatcgggagcagagctgaaggctgtctgcacagaagctggaatgtttgccctccgtgagagaagggtgcatgtcacccaggaggatttcgagatggctgtggcaaaggtgatgaagaaggataccgaaaagaacatgtctctgcggaagctctggaagtgaagcactcattttagcatcccagccatcgcagtcctgtatcattttaagcttatacctgcatgctgtcggatgagctgtggaattcttgagtatctcagcaactgtaacttacagtatcatgcagcagccttcaggttaaatttctttattggttatcaggagatgtgagatggaattgttcacttgcttgtaatgtatggtactttgtccactggattggtcggcttgttctcctgagaacggcgaccacaatactgtcttgtgctttactgatcatctgatactctttggatgtg

SEQ ID NO: 4150 - DNA, 1664 bp, Avena sativa
gagaacaagagaggcgaagtagacctgcttgcttgcgaggaaagaagctctcctctcacgcgacgcgaacccgagccgactccagaacatacatatagagcggcgatggcggcggtggcgatggacatcgcgaagccctcggcggttccggagaacgtcgaggacccggcgaaggggagggccggcggcggcggggaggggctgcgccagtactacctgcagcacatccacgacctgcagctccagatccggcagaagacccacaacctcaaccgcctcgaggcccagcggaacgacctcaactcccgagttaggatgctccgggaagagttgcagcttctgcaagaaccaggctcatatgttggggaggttgtgaaggttatgggaaagtcaaaggttctagtcaaggtgcatccagaaggcaaatatgttgtagatcttgataaaagcatcgacattaacaagattactccttcaacaagagttgctctacgaaacgacagctatatgcttcaccttatcctgcccagcaaagtcgatccactggttaatcttatgaaggtggagaaggttcctgactctacctatgatatgattggtggtcttgatcaacagatcaaagagatcaaggaggtgattgagcttcccattaagcatccagagctgtttgagagtctcggaattgcccaaccaaagggtgtccttctttacgggcctccaggtacaggaaaaacattacttgctcgtgcagttgctcatcacaccgactgtactttcatcagggtgtcaggttccgagttggttcagaagtatattggagagggttcccggatggttcgtgaactctttgtgatggctagggagcatgcaccatcaattatatttatggacgaaattgactccattggatctgctagaatggagtcaggaaccggcaatggtgacagtgaggttcagcgcactatgcttgagcttctaaaccaacttgatggttttgaagcatcgaacaaaattaaggttcttatggcaacaaataggatagacatattggatcaagctctcctgaggcctggtcgtattgacaggaagatcgaatttccgaaccctaacgcagattcccgtggtgatattttgaagattcattcaagaaagatgaatttgatgcgtggcattgatctgaaaaagattgctgagaagatgaatggagcatcgggagcagagctgaaggctgtctgcacagaagctggaatgtttgccctccgtgagagaagggtgcatgtcacccaggaggatttcgagatggctgtggcaaaggtgatgaagaaggataccgaaaagaacatgtctctgcggaagctctggaagtgaagcactcattttagcatcccagccatcacagtcctgtatcattttaagcttatacctgcatgctgtcggatgagctgtggaattcttgagtatctcagcaactgtaacttacagtatcatgcagcagccttcaggttaaatttctttattggttatcaggagatgtgagatggaattgttcacttgcttgtaatgtatggtactttgtccactggattggtgggcttgttctcctgagaacggcgaccacaatactgtcttgtgctttactgatcatctgatactctttggatgtg

SEQ ID NO: 4151 - DNA, 1471 bp, Phalaenopsis aphrodite
cagtcgacaatcggcgacgagaaatggctacgcaagttctgccgcagccggaggcggacggagagatccgatcgccgtcgacgaagacgagaggaggcggaggagaggggcttaggcagtactatctgcagcacatacacgatctgcagcttcaggttcggcagaagtcccacaatctcaaccgtctcgaggcgcagcgcaacgatctcaacgcgaaagttagagcattgagagaagagttgcaattgctgcaagagccaggatcatacgtcggtgaagttgtgaaagttatgggaaagtccaaggttttagtcaaggttcatccagaaggaaaatatgttgttgatgtggataagaatattgacataacaaagatcacgccatcaaccagagttgctcttcgcaatgatagctatgtgcttcacttgattttacctagcaaagtagatcctttggttaatcttatgaaagtcgagaaggttcctgattctacttatgatatgattggtggccttgaccaacaaatcaaagagataaaagaggttatcgagctccctatcaaacatccggagttgtttgaaagtcttggaatagcgcaaccaaagggagttttgttgtatggaccacctggtactggaaagacgttactggcaagggctgtcgctcatcatactgattgcaccttcattcgggtatctggctctgaattggttcagaagtacattggagaaggctctagaatggttcgcgaactctttgttatggcaagggaacatgctccttcgatcatcttcatggatgaaattgatagtattggttctgctagaatggaatctggatctggcaatggggacagtgaggtgcagaggactatgctcgaacttctcaatcagttggatggatttgaagcttcaaataagataaaagttcttatggccactaataggattgatattttggatcaagctctgctcaggcctggtcgtatcgatagaaaaattgagtttcctaaccccaacgaagagtcccgctgggatattctgaaaattcattcaaggaagatgaacttgatgcgtggaattgatctaaagaaaattgctgagaaaatgaatggtgcttctggtgcggagctcaaggctgtctgcacagaagcaggaatgtttgccctgagagagaggagagtgcacgttacgcaggaggattttgagatggcggtggccaaagtcatgaagaaggagactgaaaagaacatgtccctcagaaaattgtggaagtagttttctctgttttctttgtgtggatgctctgttttcttttgcttacaaggggaaaaggtaactgctgctttgctgggcttaatggagtacttctgaagttattgggcacttcgaataacaaacatatcttttgtatttttataatgttagtgcgtttgttaaggttaatcgaggagatcctgaaagccgatgca

SEQ ID NO: 4152 - DNA, 1490 bp, Phalaenopsis aphrodite
ttactaggaaaattatggccactggacaatagaatatatatatattcatattcgttgttccgctgcattttctcgtgatccttgcatgcgggctgggtccgacgaagccacgatctataaaagtctggtcaatctacatacagtcggcaatcggcaaggagatggcttccgtaaagatccaagttctgcctcagccggaggcggaagaagagtttcgatcgccgccgacgaagactagaggaggcggagaagggcttaggcagtactatctgcaacacatacacgatctgcagcttcaggttcggcagaagtcccacaatctcaaccgtctcgaggcgcagcgcaacgacctcaacgccaaagtcagagcattgagagaagagttgcaattgctgcaagagccaggatcatacgtcggtgaagttgtcaaagttatgggaaagtccaaggttttagtcaaggttcatccagaaggaaaatatgttgttgatgtggataagactattgacataacaaagatcacgccgtcaaccagagtggctcttcgcaatgatagctatgtgcttcacttgattttacctagcaaagtagatcctttggttaatcttatgaaagttgagaaggttcctgattctacttatgatatgattggtggccttgatcagcaaatcaaagagataaaagaggttatagagctccccatcaaacatccggagttgtttgaaagtcttggaatagcgcaaccaaagggagtattattgtatggaccacctggtactggaaagactttactggcaagagctgtcgcccatcatactgattgtaccttcattcgggtttctggctctgaattggttcagaagtacattggagaaggctctagaatggttcgcgaactctttgttatggcaagggaacatgctccttccatcatcttcatggatgaaattgacagtattggttccgctagaatggaatctggatctggcaatggtgacagtgaggttcagaggactatgctcgaacttctcaatcagttggatggatttgaagcttcaaataagataaaagttcttatggccactaataggattgatattctggatcaagctctgctcaggcctggtcgtatcgatagaaaaatcgagtttcctaaccccaacgaagagtcccgctgggatattctgaaaattcattcaaggaagatgaacttgatgcgcggaattgatctaaagaaaattgctgagaaaatgaatggtgcttccggtgcagagctcaaggctgtctgtacagaagcaggtatgtttgcacttagagagaggagagtgcacgttacacaggaggattttgagatggcagtggccaaagtgatgaagaaggagactgaaaagaacatgtccctcagaaaattgtggaagtaatcttttctttaaagcctattgtgtggggatgctctgtttttttatttgcttatgaggggaaaatgtaac

SEQ ID NO: 4153 - DNA, 1686 bp, Aristolochia fimbriata
gtgcaaaatttattaaaaagggtacagcccagtcggtggagagccagacccttccctccgagagaagaaaccactgaaactgaaaacaatggcgacggcgatcgagacaaagcaggcagaagtagcagctgaagagatgtgctctgcaaaggctggaaaacagggtgagggactcagacaatactatcttcagcacattcatgatctccagctgcaggtccgccagaaaactcacaatctcaatcgtctggaggcgcaacggaatgatctcaattccagagtgaggatgctgagagaggagttacagcttcttcaggagcctggttcatatgttggcgaggttgtgaaagttatggggaaatcaaaggtcttggtaaaggttcaccctgaagggaagtatgttgttgatattgacaagaacattgatatcacaaagattactccttcaactagagttgctctgcgaaatgatagttatgtccttcacttgattttaccaagcaaagttgatccactggtcaatcttatgaaagtggaaaaggttcctgattctacatatgatatgattggtggacttgatcagcagattaaagaaataaaagaggtcattgaactcccaatcaagcatcctgagttgtttgagagtcttgggattgcacagccaaaaggagtcttgctctatggacctcctggaacagggaaaactttactggcaagagctgtggctcatcatactgactgcacattcatccgggtttctgggtctgaattggttcaaaaatacattggtgagggttctagaatggtccgggaactgttcgttatggcaagggaacatgctccttccatcattttcatggatgaaattgatagtattggatctgcaaggatggaatctggaactggtaatggtgacagtgaggtccagcgtactatgcttgagcttctcaatcagctagatggttttgaagcatcaaataagatcaaagtgttgatggctacaaatcgtattgatattctggatcaagcacttctcagacctggccgaattgaccgaaaaattgagtttcccaatcccaatgaagagtcccggttggatatcttgaagatacattcaagaaagatgaacctgatgcgtggaattgatttaaagaaaatagctgaaaagatgaatggtgcttcaggtgcagagcttaaggctgtatgtacggaagcaggcatgtttgccctgagggaaagaagagttcacgtgacacaggaggattttgagatggcagttgccaaggttatgaagaaggagaccgaaaagaacatgtctctaagaaagctatggaagtaggatccttttttctgtaatttgatcacagtaaatcaagaacaacacgtccataattcctttgaatactgtgatatacttgtgcaagtacatgtagaatactcagcagcatctgcccattctactcaagtgtgaagagctgttgatttaagtgaaaaaatagcttgaatttttgctcgacatttcttcagtttcatgaaaaatagagaacttaaactgcatctgtactcaatttattcaagatgttttatgcacttggaagctcctctgtttgatgccaaacaaaggatttgagccccaagatttaccgcgtggaatgaggcggatgttataattaattgagagggcat

SEQ ID NO: 4154 - DNA, 1687 bp, Vitis vinifera
gaagaaagaaatcgaagagacttgcacagaaagaaatcacactggacaggtagcctccgtttggttgaggagaaaatggcgacagcttcaacggagaggtcactggcggagcccatggcggaggagaggtgtacggcgaagacgaagcaacaaggcgagggactcaagcagtactatctgcaacacattcacgatctccagctccaggtccgccagaaggctcacaatctcaaccgccttgaagcccaacgcaatgatctcaattctcgagtgaggatgcttagagaagagttgcaacttcttcaggagcctggatcatatgttggtgaagttgtcaaagttatggggaagtcaaaggtcttagttaaggtacatccagaagggaagtatgttgtagatattgacaagaacatagatatcacaaagatcacaccatcaactagagttgctttacggaatgatagctatgtgctccatttgatcttgccaagtaaagtagatcccctcgtaaaccttatgaaagttgaaaaagttccagactccacatatgacatgattggtggtcttgaccagcaaattaaagaaataaaagaggtcattgagcttccaattaaacaccctgaactgtttgagagtcttggaatagctcaaccaaagggagtcctgctgtatgggccacctggtacagggaaaactttgcttgcaagggcagtagctcatcatactgactgtactttcatcagggtttctggttctgaattggttcagaagtacattggtgaaggctccagaatggttagagaacttttcgtgatggctagggagcatgcaccatcaataatctttatggatgagattgacagtattggatctgctcgtatggaatcaggaagtggcaatggtgatagtgaagtccagcggactatgctggagcttctcaatcaactggatggatttgaagcatccaacaagataaaagttttaatggctacaaatcgaattgatattcttgaccaagccctcctcaggccaggacggattgacaggaagattgagtttccaaatcccaatgaggagtctcgctgggatattttaaaaatacactcgaggaaaatgaatttgatgcgtgggatcgatctgaagaagattgcagagaagatgaatggtgcatctggtgcagagctcaaggcggtatgcacagaagcagggatgtttgctttgagggagaggagggttcacgtaacacaggaagatttcgagatggctgtagccaaagtgatgaagaaggagacggagaaaaacatgtccttgaggaaactttggaagtagacactattcatttgttttatttgttgcccttttccctctcatgaagcaaatacccaccaacctatatgaagttataacccatcatgtctaggggcttcacttttcttattggtctcctgctctctctctctctatctatctatttgaatgtgctttggaaaggaatgaaaacacacatgattcctctttgaatttcagcagttcatcataacaattgcatgcctgaatgctatgacaactcacacaaagtgatttcattttcagaagattctatagttgtagcagaagctgtggaaatatcatgaaaaccatgtactaatttcttttgaaattcaaattgactacattgggttgtgct

SEQ ID NO: 4155 - DNA, 1426 bp, Ambrosia trifida
agccctcaacactccatccatcctcttgtcttgcacaaaaagaccaatcaaacaacacaacacaacaaatcgcaacctattactctctgcaagattgtgcaatggcaagtgtcgatgtagcaatgaaaccatctgatccaacggacagaactgaaaactgttcatcaaaatcagcaaaatcaggtgaaggattgaggcaatattatttgcaacatatccacgatgcccaactgcaggttcgacagaagacccataatcttaatcggcttgaagctcagcgtaacgagctcaattcacgagtcaggatgcttaaggaagagctgcagctgcttcaagagccagggtcttatgttggtgaagttgttaaagtgatggggaagtccaaagtactagtcaaggtgcacccagagggcaaatatgtagttgatatagacaaaagcattgatattactaagatcactccatcaaccagagtagcccttcgtaatgacagctatgttcttcatttggttttaccaagcaaagttgaccctcttgttaaccttatgaaagtcgaaaaagtccctgattctacgtatgacatgattggtgggcttgaccagcaaattaaagagattaaagaggttattgaacttccgatcaaacatccagagttatttgagagtctcggaattgctcaaccaaagggagttctgttatacgggccacctggcacagggaagaccttgttggcaagagcagtggctcatcatactgattgtactttcatcagggtttctggttctgaactggtacagaaatatattggagagggatctcgaatggtcagagaactttttgttatggcgagggaacatgctccatctatcatatttatggatgaaatagacagtattggatctgctcggatggaatctggaagtgggaatggtgacagtgaagtacaacgaactatgctcgagcttcttaatcagctcgacggatttgaggcatcaaacaagatcaaggttctgatggctacaaaccgtattgacatcctggatcaggctcttctcaggcccgggagaattgataggaaaattgaattcccgaaccccaacgaggattcacggttcgatattctgaaaattcattcaagaaagatgaacttaatgcgtggcattgatctgaagaagatagctgagaagatgaatggggcctcgggtgctgagcttaaggcggtttgtactgaagctggaatgtttgcattgagggaaaggagagtccatgtgacacaagaagattttgagatggctgtcgctaaggttatgaagaaggacaccgagaaaaacatgtctctgcgcaagctttggaagtaatcaatcaagccaacgcgttttctatcttgtattgttttcaaacgtttaaacgtgacatcccttatgtg

SEQ ID NO: 4156 - DNA, 1484 bp, Gossypium hirsutum
aaagaaaacctcattgttaaagtccctgaatgcgattgtagtagccaaaaaggaagaaccaaaaagaaatcaagagtcatggcgacggtgagtgtcgagaggaagcaaccggcaacggcggaagagatgtgcactgccaagagcggcgccaagcaaggggaaggcctccgccaatactatctccaacacatccacgagctccagctcaacctccgccaaaaaacccacaatctcaatcgtctcgaagcccagcgcaatgagctcaattctcgagtgagaatgcttagagaggaactgcagctgcttcaagagcctggatcctatgttggtgaggtcgtgaaagttatgggtaaaaacaaagttctagtcaaggttcatcctgaaggaaaatatgttgtcgatattgataagagtattgatatcacaaaaatcacgccatcaacaagagttgctcttcgcaatgacagctatgtcttgcatctgatcttaccaagcaaagttgatcccttggttaatcttatgaaagttgaaaaagttccagattctacatatgacatgattggtgggcttgaccagcaaattaaagagataaaagaggtcatagaacttcctattaaacatcctgaattgtttgaaagtcttggaatagcccagcccaagggtgttctgctgtatggaccacctggtacaggaaaaactctgttggctagagctgtggcccatcatactgattgtactttcatcagggtttctggttctgaattagttcagaaatacattggtgaaggctctcgaatggttagagagcttttcgtcatggccagggagcatgctccatcaatcatatttatggatgagatagacagtatcggatctgctcgaatggaatctggaagtggcaatggtgacagtgaggtgcagaggaccatgttggagcttctcaaccagctggatggatttgaagcatctaacaagatcaaggttctgatggctacaaatcgaattgatatcttggatcaagctcttcttaggccaggccgaattgacaggaagattgaatttccaaacccgaacgaggagtctcgtcaggacatcttaaaaatacattctagaagaatgaatttgatgcgggggattgacctaaagaagattgctgagaagatgaatggtgcttctggtgcggagcttaaggcggtttgcacagaagcagggatgtttgctttgagggaaaggagggtccacgtaacacaggaagattttgagatggcagtggcgaaggtgatgaagaaggagactgagaaaaacatgtccttacgaaagctgtggaagtgattaagctttattttcattattgtgctttgctttctttgttacgggcaaaaatggatggaacatgtaaaactagacttatacaatgacattataataccgtgcgcctgttttctttgacaaaagcctgtccgaaatttttaggtgaaggactt

SEQ ID NO: 4157 - DNA, 1628 bp, Gossypium raimondii
accgccacaaagcccatgaattccgcgaacactgagagagacttcgtgtatataaacccaaaattgaatttgtttttattcggaattccgcgacccctttcttcaaaatccccgggatttgtagtacagtacaaaagaaataactaagaagcatcaatactcaatggcgacggtggatatcgagaggaagcaagcggcatcggcggaagagatatgcaccgccaagagcggcgccaagcaaggggaagggctccggcaatactatatccaacacatccacgagcttcagctcaacctccgccaaaaaacccacaatctcaaccgtcttgaagcccaacgcaacgagctcaattcccaagtgagaatgcttagagaggaactgcagctgcttcaggaacctggatcctatgttggtgaggttgtgaaagttatgggtaaaaacaaggtcttagtcaaggttcatccagaaggaaaatatgttgtcgatattgataagaatattgatatcacaaaaatcacaccatccactagagttgctcttcgcaatgacagctatgttctccatctgatcttaccgagcaaagtagatcccttggttaatcttatgaaagttgaaaaagtaccagattctacgtatgacatgattggtggtcttgaccaacaaattaaagagataaaagaggttatagaacttccaattaaacaccctgaattgtttgaaagtcttggaatagctcagccaaagggtgttctgttgtatggaccaccgggtacaggaaaaactctattggctagagctgtggcccatcatactgattgcacttttatcagggtttccggttctgaattagttcagaaatacattggagagggctctcgaatggttagagaacttttcgttatggccagggagcacgctccgtcgatcatatttatggatgagatagacagcattgggtccgctcgaatggaatctggaagtggcaatggcgacagtgaggtgcagagaacaatgttggagcttctcaaccagcttgatggatttgaagcatctaacaagatcaaggttctgatggccaccaatcggatcgatatcttggatcaagctcttcttaggccaggacgaattgacaggaagattgaatttccaaatcctaatgaggagtctcgtttcgacatcttaaaaatacattctagaagaatgaatttgatgagagggattgatctaaagaagattgctgagaagatgaacggtgcttctggtgcagagcttaaggctgtgtgcacggaatcaggaatgtttgctttgagggaaaggagagtccacgtaacacaagaagatttcgagatggcggtggcgaaagtaatgaagaaggagagcgagaaaaacatgtccttacggaagctatggaagtgattatgttttattatttattgtgctttcgcggttttggggtaaattcaaacatggaaacccgatttaatatatgaacaatgtatagaatattatattatttgcctggctagtactacacacgtctacttttctagacaaggtaagaggacattttatgaaatcatatttgctaagttttggattcatgagagtgtcattggcaaaactgaaa

SEQ ID NO: 4158 - DNA, 1515 bp, Olea europaea
tatgaatgatgagaaattaaacagagctgcagagcatatacgtgttcaaagataacttgagagagacgaaatcctgtagttccgatttgatcagaataccatacttcgactgtatattcgaatggcgacggtggcgatagaaactcggcaggcggatgaggcgaagaaccaccaccaccaaagcgcgtcgggcggcggagaagggcttcggcaatactatcagcaacgcatacaggatctgcagctactagtccgccagagagaccacgatcttcagcgtcttgaagcccagcgcaacgatctcaatgcccgagtgagatcactgaaggaggagctgcagcttcttcaggagcctggatcatatgttggggaagttgtcaaagttatgggaaaatcaaaggtcttggtcaaggtccatcctgaagggaaatacgttgttgatattgacaagaacatagatattaccaagatcactccctcgatgagggttgccttacgcaatgatagttatgtgctccacttaatcttgcctagtaaagttgatccattggtgaaccttatgaaagttgaaaaagtcccagactctacatatgacatgattggtggtcttgatcagcaaattaaagagataaaggaggtgattgaacttccaataaaacatccagaattgtttgagagtcttggaattgcccaacccaagggagtcttgctctacgggcctccaggaacaggtaaaacactgcttgcaagggctgtggctcaccacactgactgcacttttattcgagtttcgggctctgaattagtccagaagtacattggagaaggctcaaggatggttagagaactttttgtaatggccagagagcatgctccatcaatcatttttatggatgaaattgatagcataggatctgctcgcatggaatctggaagtggcaacggggatagtgaggttcagagaactatgctggagcttctcaatcagctggatggatttgaagcatctaacaagataaaagtattgatggcaaccaatagaattgacattctggatcaagcccttcttaggcctggaagaatagataggaaaattgagttcccaaatcccaatgaagagtcccggtttgacatcttgaagatacactcaaggaaaatgaatttgatgagagggattgatctgaagaaaattgctgagaagatgaatggtgcgtctggtgcagaacttaaggctgtttgcacagaagccgggatgtttgctttgagagagaggagggttcatgtgactcaggaggacttcgaaatggctgttgctaaggtcatgaagaaggaaacagataagaacatgtctttgaggaagctttggaagtaatagaataaatttccatttggcaatgagtccaaacactaactgtgcacaaaatatttgcctgaatttgtactgtttgtttttctttgttcgtaactagaatgtctatttatatggcccgatttggaactcaatgcatgattaaa

SEQ ID NO: 4159 - DNA, 1575 bp, Platanus occidentalis
gctgttagcaaggcaaagaaaaggtttcatctttaagaagggaagccttgattgcgaagaaaaagctttcgaagatctttctaagggcaaacatggcgactgcagcgatcgaaacgaagcaagcggaagccgtagcagctgaggagatgtgctctgcgaaggcgatgaagcaaggagagggtctcagacagtactaccttcaacacatccatgatcttcagctccaggtccgccagaagactcacaatctcaatcgcctcgaagctcagcgtaatgatctcaattctagagtgaggatgcttagagaagaactgcaactgctgcaggagcctggatcatatgttggagaagtggtgaaagttatggggaaatcgaaggttttagttaaggttcacccagaagggaagtatgttgttgatattgataagaacattgatatcacgaaaattacgccatcaaccagagttgctcttcgtaatgatagctatgtacttcacttgatcttgcccagcaaagtggatcctctggtcaaccttatgaaagttgaaaaagttcccgattctacatatgatatgattggtggtcttgaccagcaaatcaaagagataaaggaggtcattgagcttccaatcaaacatcctgaattatttgagagtcttggaatagctcaacctaagggagtcttgctttatgggccacctggtacgggaaaaacgttactggcaagggcagtggctcatcatactgactgtacgttcatcagggtttctggttctgagttagtccaaaaatacatcggtgaagggtctagaatggtcagagaactttttgttatggccagagaacatgctccgtctatcatttttatggatgaaattgacagtattggatctgctcgaatggaatctggtactggcaatggtgacagtgaagttcagcggacaatgctggagcttctcaatcagctggatggatttgaagcttcaaacaagattaaagttttaatggctacaaatcggattgatattctggatcaagctcttcttaggcctggaaggattgacaggaagattgagtttccaaatcctaatgaagagtctcgttttgatatcctaaaaatacactcgagaaaaatgaacttgatgcgtggaattgatctgaagaagattgctgagaagatgaatggtgcatctggtgcagaactcaaggcggtgtgcacagaagcagggatgtttgctctaagggagaggcgagttcatgtaacccaggaggactttgagatggcagtagccaaggtcatgaagaaggagacggagaagaacatgtctctgagaaaactatggaagtaattgtttctttcatttcattttgttctttaccttggattggacatggaaaagagatttggttctattacctttatttgaagttttatttactgggaagcattggctcactggttgtgccttatctttcttattcccttttaagtgtatttaactgataatctcttcttttagcttatctcgacttgaaagttaaatttattcaaacatatgaatcaccatctggtta

SEQ ID NO: 4160 - DNA, 1587 bp, Gossypium hirsutum
accgccacaaagcccatgaattccgcgaacactgaggggagactttgtgtatataaacccaaaatggaatttgttttattcggaattccgcgacccctttcttcaaaatccccgggatttgtagtacagtacaaaaaaataactaagaagcatcaatactcaatggcgacggtggatatcgagaggaagcaagcggcatcggcggaagagatatgcaccgccaagagcggcgccaagcaaggggaagggctccggcaatactatatccaacacatccacgagcttcagctcaacctccgccaaaaaacccacaatctcaaccgtcttgaagcccaacgcaacgagctcaattcccaagtgagaatgcttagagaggaactgcagctgcttcaggaacctggatcctatgttggtgaggttgtgaaagttatgggtaaaaacaaggtcttagtcaaggttcatccagaaggaaaatatgttgtcgatattgataagaatattgatatcacaaaaatcacaccatccactagagttgctcttcgcaatgacagctatgttctccatctgatcttaccgagcaaagtagatcccttggttaatcttatgaaagttgaaaaagtaccagattctacgtatgacatgattggtggtcttgatcaacaaattaaagagataaaagaggttatagaacttccaattaaacaccctgaattgtttgaaagtcttggaatagctcagccaaagggcgtcctgttgtatggaccaccgggtacaggaaaaactctattggctagagctgtggcccatcatactgattgcacttttatcagggtttccggttctgaattagttcagaaatacattggagagggctctcgaatggttagagaacttttcgttatggccagggagcacgctccgtcgatcatatttatggatgagatagacagcattgggtccgctcgaatggaatctggaagtggcaatggcgacagtgaggtgcagagaacaatgttggagcttctcaaccagcttgatggatttgaagcatctaacaagatcaaggttctgatggccaccaatcggatcgatatcttggatcaagctcttcttaggccaggacgaattgacaggaagattgaatttccaaatcctaatgaggagtctcgtttcgacatcttaaaaatacattctagaagaatgaatttgatgagagggattgatctaaagaagattgctgagaagatgaacggtgcttctggtgcagagcttaaggctgtgtgcacggaatcaggaatgtttgctttgagggaaaggagagtccacgtaacacaagaagatttcgagatggcggtggcgaaagtaatgaagaaggagagcgagaaaaacatgtccttacggaagctatggaagtgattatgttttattatttattgtgctttcgcggttttggggtaaattcaaacatggaaacccgatttaatatatgaacaatgtatagaatattatattatttgcctggctagtactacacacgtctacttttctagacaaggtaagagcacattttatgaaatcatatttgct

SEQ ID NO: 4161 - DNA, 1586 bp, Gossypium hirsutum
ccgccacaaagcccatgaattccgcgaacactgaggggagactttgtgtatataaacccaaaatggaatttgttttattcggaattccgcgaccctttcttcaaaatccccgggatttgtagtacagtacaaaagaaataactaagaagcatcaatactcaatggcgacggtggatatcgagaggaagcaagcggcatcggcggaagagatatgcaccgccaagagcggcgccaagcaaggggaagggctccggcaatactatatccaacacatccacgagcttcagctcaacctccgccaaaaaacccacaatctcaaccgtcttgaagcccaacgcaacgagctcaattcccaagtgagaatgcttagagaggaactgcagctgcttcaggaacctggatcctatgttggtgaggttgtgaaagttatgggtaaaaacaaggtcttagtcaaggttcatccagaaggaaaatatgttgtcgatattgataagaatattgatatcacaaaaatcacaccatccactagagttgctcttcgcaatgacagctatgttctccatctgatcttaccgagcaaagtagatcccttggttaatcttatgaaagttgaaaaagtaccagattctacgtatgacatgattggtggtcttgaccaacaaattaaagagataaaagaggttatagaacttccaattaaacaccctgaattgtttgaaagtcttggaatagctcagccaaagggtgttctgttgtatggaccaccgggtacaggaaaaactctattggctagagctgtggcccatcatactgattgcacttttatcagggtttccggttctgaattagttcagaaatacattggagagggctctcgaatggttagagaacttttcgttatggccagggagcacgctccgtcgatcatatttatggatgagatagacagcattgggtccgctcgaatggaatctggaagtggcaatggcgacagtgaggtgcagagaacaatgctggagcttctcaaccagcttgatggatttgaagcatctaacaagatcaaggttctgatggccaccaatcggatcgatatcttggatcaagctcttcttaggccaggacgaattgacaggaagattgaatttccaaatcctaatgaggagtctcgtttcgacatcttaaaaatacattctagaagaatgaatttgatgagagggattgatctaaagaagattgctgagaagatgaacggtgcttctggtgcagagcttaaggctgtgtgcacggaatcaggaatgtttgctttgagggaaaggagagtccacgtaacacaagaagatttcgagatggcggtggcgaaagtaatgaagaaggagagcgagaagaacatgtccttacggaagctatggaagtgattatgttttattatttattgtgctttcgcggttttggggtaaattcaaacatggaaacccgatttaatatatgaacaatgtatagaatattatattatttgcctggctagtactacacacgtctacttttctagacaaggtaagaggacattttatgaaatcatatttgct

SEQ ID NO: 4162 - DNA, 1778 bp, Quercus alba
gggaagctaacacagagctacccacccagattctatcaatagaaactcaaacaaagcgaacagtaacttcaaattcagatcccaaatcgaaaccctaaccctaactctcattccgacgatggcgactgtaggaatcgaagctgtggcggcgccggcggaggagacgtgctcggcgaaggcttcgaagcaaggcgaggggctcaggcagtactacctccaacacattcacgagcttcagctccaggttcgccaaaagactcacaatctcaaccgcctcgaggcccagcggaatgagctcaattctcgagtgagaatgcttagggaagaattacagctactccaggagcctggatcatatgttggtgaagttgtcaaagtaatggggaagaataaggttttagttaaggttcatcctgaagggaaatatgttgttgacattgataaaaatatcgatatcaccaagataactccatcaacaagagttgctctccgtaatgacagttatgtgcttcatttaatcttgccaagcaaagttgatccattggtcaacctcatgaaagttgaaaaggttccagattccacatatgacatgattggcggtcttgaccagcaaattaaagagataaaggaggtcattgaacttccaatcaaacatcctgagttatttgagagtcttggaatagctcaaccaaagggtgttctgctatatggcccacctggtacagggaaaacattgttggctagggccgtggctcatcatactgattgtactttcatcagggtttctggttcagaattagttcagaagtatattggagaaggttccagaatggttagggaactttttgtcatggccagggaacatgctccatcaatcatatttatggatgaaatagacagcattggatctgctcgaatggaatctggtagtggcaatggtgacagtgaagtgcagcggactatgctggagcttctcaaccagctggatggatttgaagcatcaaataaaataaaggttttgatggctaccaatcggattgatattctggatcaagctctccttaggccagggcgaattgacaggaagattgaatttcctaatcctaatgaggagtctcgttttgatattttaaaaatacattcaagaagaatgaacctgatgcgtgggattgatctgaagaaaatagccgagaagatgaatggtgcatctggtgcagagctcaaggctgtgtgcacagaagctgggatgtttgctctgagggagaggagggttcatgtaacacaagaagattttgagatggcagtggcaaaggtaatgaagaaggagactgagaaaaacatgtcattgcggaagctatggaagtagtgttcctatatgttaatgttttgtttcactccactctttgagccattgatccgtggctttgttcttcaaacacagccaacagttcagttctttgtatggatataaaaaacagggcgggggtgcctacacttgttgaagtttttaaaataccactggcatctctgtttattttgttaaatattcttttgtgatacatttttatgtaatatgtgttttacttcaagtatctgacaacaatgtcccttgacaatgactgtcaatcttttatcaatctattggttagacgaccagaatgataattaaaaatctgtgcttagtggacaagcacatgtggcttagttttctgggcatgtgtaactgtagcaacatagcactcagggatcaatcataacatgtagtgctagttgtgctc

SEQ ID NO: 4163 - DNA, 1520 bp, Amorphophallus konjac
agagaggggaaggtggtaaggggcatagagggttagagatggcggcgatggaggtggacacgaagcaggcggcatcggcatcgtctgccgagaacgagatgtgctcgccggcggtgaaggtccggggcggcggcggggaggggctgcggcagtactacctgcagcacatccatgatctgcagctgcaggtccggcagaagacccacaacctcaaccgtctagaggcccagcgcaacgatctcaattcccgagtcagaatgttacgagaggaactgcagctactccaagaaccaggatcatatgttggtgaggtagtgaaagtaatgggaaaatcaaaggtcttagttaaggttcatcctgaaggaaagtatgttgttgacattgacaagagcattgatataacaaagataacaccatcaaccagggtggctctccgcaatgatagctatgtcctccatttggtcttgcccagtaaagttgacccgctagtcaatcttatgaaagttgagaaggttcctgattccacttatgacatgattggtggacttgatcagcagatcaaagagataaaagaggttattgagcttccaatcaagcatccagagttatttgagagtcttggtattgctcaacccaagggtgtcttgctttatggcccacctggtactggaaaaactttgttggctagggctgtagcccatcacactgattgtaccttcattcgagtctctggttctgaattggttcagaaatacattggagaaggctctagaatggttcgagaactttttgttatggccagggaacatgccccatcaatcatattcatggatgagattgacagtataggatctgctagaatggaatcggggactggcaatggagacagtgaagtgcagcgtactatgcttgagcttctcaatcaacttgatggatttgaggcatcaaacaagattaaggttctgatggctactaacaggattgatattctggatcaagccctcctcaggcctggtcggatagacagaaaaattgagtttcctaatcctaatgaagagtctcgctttgatattctgaaaattcactcaagaaagatgaacttgatgcggggtatcgatttgaagaaaattgcggagaagatgaatggtgcctcaggtgctgaactgaaggcggtgtgcacagaagctggaatgttcgctctcagggagagaagggttcatgtaacccaggaggattttgagatggctgtggcgaaggtcatgaagaaagacacagagaagaacatgtctttgaggaagctatggaagtagatgaacatgtcttcctatttgttcctcggtacaaagactgaaaagaccaaattctttttccgcgtcttttataatgctcttactcaacttcgtggtagtccgagtgtgttgtatcagaaaaaactctctaaatgttacaagaagacatggattgttgtgttcagcatagtatttggatctactgcctgtattcgttaattgtcatatatt

SEQ ID NO: 4164 - DNA, 1684 bp, Euonymus alatus
cacacactggcttgattagaaagaaacatctcctccaacacttggaaaagaagaagaataagggttcgctggctatggcaactgtcggagtggaaatgaagcaaccggaattgacggtgacggaagagatgtgctcggcgaagggggctgcgaagcagggtgaggggctgagacagtactattatcaacacaaccataagctacagcttctcctacgacagaagacgcataatctgaatcgccttgaagcacagcgcaacgaccttaattccaaagtgaggatgcttagggaggaactgcagctgcttcaagagcctggatcgtatgttggtgaagttgtcaaagtaatggggaaaaacaaggttttggttaaggttcatccagaggggaaatatgttgttgatattgataaaaatattgatattacaaagatcactccatcgacaagagttgccctccgtaatgacagctatgttcttcatttgattttgccaagcaaagttgatcccttggtcaaccttatgaaggttgaaaaagttccagattctacctacgacatgattggtggtcttgaccagcaaattaaagagattaaagaggtcatagagcttccaattaaacatcctgaattgtttgagagtcttggaatagcccaaccgaagggtgtgcttctgtatggcccacctggtacagggaaaacactcttggctagggcggtggctcatcatactgattgtactttcatccgggtttctggttccgaattagtccagaagtacattggagaaggctctagaatggttagagaactttttgttatggcaagagagcatgctccgtcgattattttcatggatgaaatagacagcattgggtctgctcgaatggaatctggaagtggcaatggcgacagtgaggtgcagagaactatgttggagcttctcaatcagctggatggatttgaagcttctaataagatcaaggttttgatggccactaatcggattgatattcttgatcaagcactcctcaggccagggaggattgacagaaagatcgaatttccaaatcctaatgaagagtcacgtttcgatatcttgaaaattcattcaagaaggatgaatttaatgcgtgggattgatttgaagaaaattgcggagaagatgaatggtgcatctggtgcagagctaaaggcggtgtgcacagaggcgggaatgtttgctttaagagagaggagggtccatgtgacacaagaagactttgagatggcagtggccaaagtgatgaaaaaggagacagagaagaacatgtcattgcggaagctatggaagtaattgtctgtgtatttacattttaaggaaaacaatgttatgtgctacttctacgcgctgtatggaatcacagcacgatgccctttcctgatgacttcttaattgacgaggttacgaggtcccttaagatggttaaatcgttttgaaagaagttgggaatcaaccgtcctgtattatttagacatgtagttcctgcgtgggatatgttggcacagttttatcttctttgaattatgtctcagatgattgtctttttactcgacgcttgggaacattgtttgaatgatgactgaatgtgcttctattgagttttataatttgaacatcaatatttatcgattgaccttgtgaat

SEQ ID NO: 4165 - DNA, 1633 bp, Gossypium raimondii
tacatagaataaacacagccgaaaacatcttttttattggaatccaaatcaaaacttgttgttaaagaaaacctcattgataaagtccctgaatgcgattgtagtagccaaaaaggaagaaccaaaaagaaatcaagagtcatggcgacggtgggtgtcgagaggaagcaaccggcaacggcggaagagatgtgcactgccaagagcggcgccaagcaaggggaaggcctccgccaatactatctccaacacatccacgagctccagctcaacctccgccaaaaaacccacaatctcaatcgtctcgaagcccagcgcaatgagctcaattctcgagtgagaatgcttagagaggaactgcagctgcttcaagagcctggatcctatgttggtgaggtcgtgaaagttatgggtaaaaacaaagttttagtcaaggttcatcctgaaggaaaatatgttgtcgatattgataagagtattgatatcacaaaaatcactccatcaacaagagttgctcttcgcaatgacagctatgtcttgcatctgatcttaccaagcaaagttgatcccttggttaatcttatgaaagttgaaaaagttccagattctacatatgacatgattggtgggcttgaccagcaaattaaagagataaaagaggtcatagaacttcctattaaacatcctgaattgtttgaaagtcttggaatagcccagcccaagggtgttctgctgtatggaccacctggtacaggaaaaactctgttggctagagctgtggcccatcatactgattgtactttcatcagggtttctggttctgaattagttcagaaatacattggtgagggctctcggatggttagagagcttttcgtcatggccagggagcatgctccatcaatcatatttatggatgagatagacagtattggatctgctcgaatggaatctggaagtggcaatggtgacagtgaggtgcagaggaccatgttggagcttctcaaccagctggatggatttgaagcatctaacaagatcaaggttctgatggctacaaatcgaattgatatcttggatcaagctcttcttaggccaggccgaattgacaggaagattgaatttccaaacccgaacgaggagtctcgtcaggacatcttaaaaatacattctagaagaatgaatttgatgcgggggattgacctaaagaagattgctgagaagatgaatggtgcttctggtgcggagcttaaggcggtttgcacagaagcagggatgtttgctttgagggaaaggagggtccacgtaacacaggaagattttgagatggcagtggcgaaggtgatgaagaaggagaccgagaaaaacatgtccttacgaaagctgtggaagtgattaagctttattttcattattgtgctttgctttctttgttacgggcaaaaaatggatggaacatgtaaaactagacttatacaatgacattataataccgtgcgcctgttttctttgacaaaagcctgtcctacaaaatttgcaggtaaaggacttagatttttatgaaaaaagcttggttcggatttaatcattttcgagtggagcatgagcaattctcaaggttctaaatttttaa

SEQ ID NO: 4166 - DNA, 1703 bp, Vitis vinifera
aagaaggagaagcattgaagaaagaaatcgaagagacttgcacagaaagaaatcacactggacaggtagcctccgtttggttgaggagaaaatggcgacagcttcaacggagaggtcactggcggagcccatggcggaggagaggtgtacggcgaagacgaagcaacaaggcgagggactcaagcagtactatctgcaacacaatcacgatctccagctccaggtccgccagaaggctcacaatctcaaccgccttgaagcccaacgcaatgatctcaattctcgagtgaggatgcttagagaagagttgcaacttcttcaggagcctggatcatatgttggtgaagttgtcaaagttatggggaagtcaaaggtcttagttaaggtacatccagaagggaagtatgttgtagatattgacaagaacatagatatcacaaagatcacaccatcaactagagttgctttacggaatgatagctatgtgctccatttgatcttgccaagtaaagtagatcccctcgtaaaccttatgaaagttgaaaaagttccagactccacatatgacatgatcggtggtcttgaccagcaaattaaagaaataaaagaggtcattgagcttccaattaaacaccctgaactgtttgagagtcttggaatagctcaaccaaagggagtcctgctgtatgggccacctggtacagggaaaactttgcttgcaagggcagtagctcatcatactgactgtactttcatcagggtttctggttctgaattggttcagaagtacattggtgaaggctccagaatggttagagaacttttcgtgatggcaagggagcatgcaccatcaataatctttatggatgagattgacagtattggatctgctcgtatggaatcaggaagtggcaatggtgatagtgaagtccagcggactatgctggagcttctcaatcaactggatggatttgaagcatccaacaagataaaagttttaatggctacaaatcgaattgatattcttgaccaagccctcctcaggccaggacggattgacaggaagattgagtttccaaatcccaatggggagtctcgctgggatattttaaaaatacactcgaggaaaatgaatttgatgcgtgggatcgatctgaagaagattgcagagaagatgaatggtgcatctggtgcagagctcaaggcggtatgcacagaagcagggatgtttgctttgagggagaggagggttcacgtaacacaggaagatttcgagatggctgtagccaaagtgatgaagaaggagacggagaaaaacatgtccttgaggaaactttggaagtagacactattcatttgttttatttgttgcccttttccctctcatgaagcaaatacccaccaacctatatgaagttataacccatcatgtctaggggcttcacttttcttattggtctcctgctctctctctctctatctatctatttgaatgtgctttggaaaggaatgaaaacacacatgattcctctttgaatttcagcagttcatcataacaattgcatgcctgaatgctatgacaactcacacaaagtgatttcattttcagaagattctttagttgtagcagaagctgtggaaatatcatgaaaaccatgtactaatttcttttgaaattcaaattgactacattgggttgtgct

SEQ ID NO: 4167 - DNA, 1553 bp, Artemisia annua
ggaaaccctaacaataaattatcatcaaatcaatcaataatcaatcatggcgagtgtagatgtggcaatgaaatcatcatcagaatcagcaggggggattgaaagctgctcatcaaaaggtggtgggaaaacaggtgaaggattaagacaatactatctgcaacatattcatgatgctcagcttcaagtccgtcaaaagactcataatcttaatcgtcttgaggctcaacgtaacgaacttaattccagagtcaggatgcttaaggaagagttgcagctgcttcaagagcctggatcttatgttggtgaagttgtcaaagtaatgggaaagtctaaagtactagtcaaggtgcacccagagggtaaatatgtggttgatatcgacaaaagcattgatatcactaagatcactccgtcaaccagagtagccctccgcaatgacagctatgttcttcatttggttttgccaagcaaagttgatcctctggtcaatctaatgaaagtcgaaaaagttcctgattctacttatgatatgattggtgggcttgaccagcaaatcaaggagattaaggaggttattgaacttccaatcaaacatcctgagttattcgagagtcttggaattgctcaaccaaagggagttctgttatacggacctcctggtactgggaagaccttgttggccagagcagtggctcatcatactgattgtacctttatcagggtctctggttccgaactagtgcagaaatatattggagaagggtctcggatggtgagagaacttttcgtcatggccagagaacatgctccatctatcatatttatggatgaaatagacagtatcggatctgctcgtatggagtctggaagtgggaatggtgacagtgaagtgcaaagaactatgcttgagcttcttaatcagctggacggatttgaagcatcaaacaaaatcaaggttttgatggctaccaaccgtattgatatcttggatcaagctcttctcaggccagggagaattgataggaagattgaattcccaaaccccaatgaagattcacggtttgatattctgaaaattcattcaagaaagatgaacttaatgcgtggcatcgatctaaagaagattgctgagaagatgaatggcgcatcgggtgctgagcttaaggccgtttgcacagaagctggaatgtttgctttgagggaaaggagagtccatgtgacccaagaagattttgaaatggcagttgctaaggttatgaagaaggaaactgagaaaaacatgtctctacgcaagctatggaagtaatctgtttgtttactcgtgtttcactttctgtttatggaactctagtgaaccaatgttttttctacatagtatcgtcttcaatcctgcccaaactgtcgcacttatttcatttatgtacggattgtgttcgactacaagtagattgtactgaaccgcatattttatttatctttgcacccgaaacatactgaaatgttgttaaagtttttatgttaaagttaacaattaaagactagtggttgat

SEQ ID NO: 4168 - DNA, 1500 bp, Gossypium hirsutum
ttgttaaagaaaacctcattgataaagtccctgaatgcgattgtagtagccaaaaaggaagaaccaaaaagaaatcaagagtcatggcgacggtgggtgtcgagaggaagcaaccggcaacggcggaagagatgtgcactgccaagagcggcgccaagcaaggggaaggcctgcgccaatactatctccaacacatccacgagctccagctcaacctccgccaaaaaacccacaatctcaatcgtctcgaagcccagcgcaatgagctcaattctcgagtgagaatgcttagagaggaactgcagctgcttcaagagcctggatcctatgttggtgaggtcgtgaaagttatgggtaaaaacaaagttttagtcaaggttcatcctgaaggaaaatatgttgtcgatattgataagagtattgatatcacaaaaatcactccatcaacaagagttgctcttcgcaatgacagctatgtcttgcatctgatcttaccaagcaaagttgatcccttggttaatcttatgaaagttgaaaaagttccagattctacatatgacatgattggtgggcttgaccagcaaattaaagagataaaagaggtcatagaacttcctattaaacatcctgaattgtttgaaagtcttggaatagcccagcccaagggtgttctgctgtatggaccacctggtacaggaaaaactctgttggctagagcagtggcccatcatactgattgtactttcatcagggtttctggttctgaattagttcagaaatacattggtgagggctctcggatggttagagagcttttcgtcatggccagggagcatgctccatcaatcatatttatggatgagatagacagtattggatctgctcgaatggaatctggaagtggcaatggtgacagtgaggtgcagaggaccatgttggagcttctcaaccagctggatggatttgaagcatccaacaagatcaaggttctgatggctacaaatcggattgatatcttggatcaagctcttcttaggccaggccgaattgacaggaagattgaatttccaaacccgaacgaggagtctcgtcaggacatcttaaaaatacattctagaagaatgaatttgatgcgggggattgacctaaagaagattgctgagaagatgaacggtgcttctggtgcggagcttaaggcggtttgcacagaagcagggatgtttgctttgagggaaaggagagtccacgtaacacaggaagattttgagatggcagtagcgaaggtgatgaagaaggagaccgagaaaaacatgtccttaagaaagctgtggaagtgattaagctttattttcattattgtgctttgctttctttgttacgggcaaaaaatggatggaacgtgtaaaactagacttatacagtgacattataataccgtacgcctgttttctttgacaaaagcctgtcctacaaaatttgcaggtaaaggacttagatttt

SEQ ID NO: 4169 - DNA, 1503 bp, Gossypium hirsutum
ttattgttaaagaaaacctcattgataaagtccctgaatgcgattgtagtagccaaaaaggaagaaccaaaaagaaatcaagagtcatggcgacggtgggtgtcgagaggaagcaaccggcaacggcggaagagatgtgcactgccaagagcggcgccaagcaaggggaaggcctgcgccaatactatctccaacacatccacgagctccagctcaacctccgccaaaaaacccacaatctcaatcgtctcgaagcccagcgcaatgagctcaattctcgagtgagaatgcttagagaggaactgcagctgcttcaagagcctggatcctatgttggtgaggtcgtgaaagttatgggtaaaaacaaagttttagtcaaggttcatcctgaaggaaaatatgttgtcgatattgataagagtattgatatcacaaaaatcactccatcaacaagagttgctcttcgcaatgacagctatgtcttgcatctgatcttaccaagcaaagttgatcccttggttaatcttatgaaagttgaaaaagttccagattctacatatgacatgattggtgggcttgaccagcaaattaaagagataaaagaggtcatagaacttcctattaaacatcctgaattgtttgaaagtcttggaatagcccagcccaagggtgttctgctgtatggaccacctggtacaggaaaaactctgttggctagagcagtggcccatcatactgattgtactttcatcagggtttctggttctgaattagttcagaaatacattggtgagggctctcggatggttagagagcttttcgtcatggccagggagcatgctccatcaatcatatttatggatgagatagacagtattggatctgctcgaatggaatctggaagtggcaatggtgacagtgaggtgcagaggaccatgttggagcttctcaaccagctggatggatttgaagcatccaacaagatcaaggttctgatggctacaaatcggattgatatcttggatcaagctcttcttaggccaggccgaattgacaggaagattgaatttccaaacccgaacgaggagtctcgtcaggacatcttaaaaatacattctagaagaatgaatttgatgcgggggattgacctaaagaagattgctgagaagatgaacggtgcttctggtgcggagcttaaggcggtttgcacagaagcagggatgtttgctttgagggaaaggagagtccacgtaacacaggaagattttgagatggcagtagcgaaggtgatgaagaaggagaccgagaaaaacatgtccttaagaaagctgtggaagtgattaagctttattttcattattgtgctttgctttctttgttacgggcaaaaaatggatggaacgtgtaaaactagacttatacagtgacattataataccgtacgcctgttttctttgacaaaagcctgtcctacaaaatttgcaggtaaaggacttagatttt

SEQ ID NO: 4170 - DNA, 1676 bp, Vitis vinifera
ggaaaacctatataagcaagaaaccacgccaaacacccagatactttccccaatttctagggttttctttgtttcgcaaattatcaatctcctctcgagtcacaggttacaacaatggccacagcagtgaccgagctcagtcagtctggtccagccatggtcggggaggtctgcaccgccaaaacgacgtcgtctaagcaaggagatgggctgaggcagtactacctccaacacatccacgatctccagctacaggttcgccagaagagccataatctcaatcgccttgaagcccagcgcaacgatctcaattcccgagtgaggatgctcagagaagaattgcagctgcttcaagagcctggatcatatgttggtgaagtagtcaaagttatgggaaaatcgaaggttttggttaaggttcatccagaagggaagtatgttgttgatattgataagaacatagacatcactaagatcacaccttcaacccgagttgctcttcgcaatgacagctatgtgcttcacttgatattgcccagtaaagtagatccactggtaaaccttatgaaagttgaaaaagttccggattctacatatgatatgattggtggtcttgatcagcaaatcaaagagataaaggaggttattgagcttccaatcaagcatcctgaattatttgaaagtcttggtatagctcaaccaaagggagtcctgctttatggtcctcctggtacagggaaaacacttcttgcaagggcagtggctcatcacactgactgtacctttataagggtttctggctctgagttagttcagaagtatattggtgaagggtctcgaatggttagagaactgtttgttatggcaagggagcatgctccatcaatcatcttcatggatgaaattgacagtattggatctgctcgaatggaatctggaactggaaatggtgatagtgaagtgcagcgaactatgttggagcttctcaatcaactggatggatttgaagcctcaaacaagatcaaggttttgatggctacaaatcgcattgatattttggatcaagccctccttaggcctggacgaattgacaggaagattgagttcccaaatcccaacgaagagtcccgctttgatattttgaaaatccactcaagaaaaatgaacttaatgcgtgggattgatctgaagaagatagcagagaagatgaatggtgcatctggtgcagagcttaaggcggtatgcacagaagctggaatgtttgctctaagggagaggagagtacatgtgacacaagaagattttgagatggcagtggcaaaggtgatgaaaaaggagacagagaaaaacatgtccttgcggaagctgtggaagtaaacacttcctattgcttgtgttttgtactttaaacttgtaaaaggataaaatagttatcttccatccccgaaaaggacttgactctgtttcacactcgcctcacgaaattttagttgctggaaaacatctgcccatctgttgtcaattatattttccgcatttcaaatttatatgcatctagtttcctttttacctctgcataattttatgttcacccagctacttgcctaaaggatttataccaattgaattagaaaaactgaattttgttttccataataattaagttgagctaatag

SEQ ID NO: 4171 - DNA, 1509 bp, Vitis vinifera
agatactttccccaatttctagggttttctttgtttcgcaaattatcaatctcctctcgagtcacaggctacaacaatggccacagcagtgaccgagctcagtcagtctggtccagccatggtcggggaggtctgcaccgccaaaacgacgtcgtctaagcaaggagatgggctgaggcagtactacctccaacacatccacgatctccagctacaggttcgccagaagagccataatctcaatcgccttgaagcccagcgcaacgatctcaattcccgagtgaggatgctcagagaagaattgcagctgcttcaagagcctggatcatatgttggtgaagtagtcaaagttatgggaaaatcgaaggttttggttaaggttcatccagaagggaagtatgttgttgatattgataagaacatagacatcactaagatcacaccttcaacccgagttgctcttcgcaatgacagctatgtgcttcacttgatattgcccagtaaagtagatccactggtaaaccttatgaaagttgaaaaagttccggattctacatatgatatgattggtggtcttgatcagcaaatcaaagagataaaggaggttattgagcttccaatcaagcatcctgaattatttgaaagtcttggtatagctcaaccaaagggagtcctgctttatggtcctcctggtacagggaaaacacttcttgcaagggcagtggctcatcacactgactgtacctttataagggtttctggctctgagttagttcagaagtatattggtgaagggtctcgaatggttagagaactgtttgttatggcaagggagcatgctccatcaatcatcttcatggatgaaattgacagtattggatctgctcgaatggaatctggaactggaaatggtgatagtgaagtgcagcgaactatgttggagcttctcaatcaactggatggatttgaagcctcaaacaagatcaaggttttgatggctacaaatcgcattgatattttggatcaagccctccttaggcctggacgaattgacaggaagattgagttcccaaatcccaacgaagagtcccgctttgatattttgaaaatccactcaagaaaaatgaacttaatgcgcgggattgatctgaagaagatagcagagaagatgaatggtgcatctggtgcagagcttaaggcggtatgcacagaagctggaatgtttgctctaagggagaggagagtacatgtgacacaagaagattttgagatggcagtggcaaaggtgatgaaaaaggagacagagaaaaacatgtccttgcggaagctgtggaagtaaacactttctattgcttgtgttttgtactttaaacttgtaaaaggataaaatagttatcttccatccccgaaaaggacttgactctgtttcacactcgcctcacgaaattttagttgctggaaaacatctgcccatctgttgtcaattatattttccgcatttcaaattta

SEQ ID NO: 4172 - DNA, 1584 bp, Mimulus guttatus
gtgcaaacccaaactacaaactctaaacttggccaagacgaaatcccacaaattctccgatctgcttacagactatacggcggcgtatcaaatcgaatggcgacggcggctatagagactcggcgggcagatgaattgaagcagcagcaccagcaaggcgccgggaccggcggcggcgaagggctccggcagtactatcagcagcgcatacaggatatgcagctgttagtccgccagaaagatcacgatctccagcgcctcgaagctcagcgcaatgacctcaattcccgagtaagatcgctgaaggaagagttgcagcttcttcaggagcctggatcttatgttggtgaagttgtcaaagttatgggaaaatcgaaggtccttgtcaaggttcatcctgaggggaagtatgtagttgacattgacaaaagcattgacatcactaagattacaccttcgacaagggtcgctttacgtaatgatagctatgtgctccacctggtcctacccagtaaagtcgatccgctggtgaaccttatgaaagttgaaaaagttccagactccacttatgacatgattggtggtcttgaccagcaaatcaaagagataaaagaggtgattgaacttccgatcaagcatcctgaactgtttgagagtcttggaatagctcaacctaagggagttttgctatatggcccacctggcacgggtaagactttgcttgcaagggcagtggctcaccataccgactgcactttcattcgagtttcgggatctgaattggttcagaagtacattggagaaggttctagaatggtcagagaactttttgtgatggccagagagcacgctccatccatcatcttcatggacgaaattgatagtattggatcagctcgtatggaatccggaagtggaaatggggatagtgaagttcagcgaactatgcttgagcttctcaatcagctcgatggctttgaagcatctaataagataaaagtgctgatggccactaatagaattgacattctggaccaagctcttcttaggcctggaagaattgatagaaagatcgagttcccaaatcccaatgaagattctcgggctgacatcttgaaaatacactcgaggaaaatgaatttgatgcgagggattgatctgaagaagattgccgagaagatgaatggcgcatctggtgcagaacttaaggcggtttgcacggaagctggaatgtttgcactgagagagaggagagttcatgttactcaggaggactttgagatggctgttgctaaagtaatgaagaaggaaactgagaagaacatgtctttgaggaagctttggaagtagattctcttttttcgtttctattacatccacaactatctagacaagaaacaaacttttaaacattgaactttgttgtaccaggtaaacaaacatcgtcattttcattttcgttatttctatttcccgatatctgttttcagatttttattgccctgtatttttattttttattttttggtgaaaatcggtactatattttccgttgctataaactttctagtccattctcgtcct

SEQ ID NO: 4173 - DNA, 1644 bp, Prunus persica
gctctccaaaattcacaaatctcaggtttttgtcgcaagaaaaggatcgcaatggctgcagtaggagtcgagatcaagcacccggaggccgtgccggaggaggcctgctccgccaaggccaccaagcaaggcgaggggctcaggcagtactatctccagcacattcacgagcttcagctccaggtccgccagaagacccacaacctcaatcgtctcgaagctcagcgcaacgagctcaattcccgagtgagaatgctcagggaagaactacagctgcttcaggagcctggatcatatgttggggaagttgttaaagtgatggggaagaacaaggttttggttaaggttcatccagaagggaaatatgtcgttgatattgataaaaacattgatgtcacaaagatcacgccatcaacaagagttgctctccgcaatgacagctatgttcttcatttgatcttgcccagcaaagtagatcctttggttaaccttatgaaagttgaaaaagttccggattctacatatgatatgattggtggtcttgatcagcaaatcaaagaaataaaggaggtcattgaacttccaattaaacatcctgaattgttcgagagtcttggtatagctcagccaaagggcgtgctgctttatgggccacctggcactgggaaaacactgttggctagggctgtggcccatcacactgactgcacattcatcagggtttctggttcggagttagttcagaaatatattggggaaggctctagaatggttagagaacttttcgtcatggccagggaacacgctccgtctatcatttttatggatgaaatcgacagtatcggatctgctcgtatggaatctggtagtggcaatggtgacagtgaggtgcagcggactatgctggagcttctcaaccagttggatggatttgaggcatcaaacaagatcaaggttttaatggccacaaatcgtatcgatattctggatcaagccctccttaggccaggacgaattgacaggaagattgaattcccaaatcctaatgaagagtctcgttgggatatcttgaaaatccattcaagaagaatgaatttaatgcgtggaattgacttgaagaagattgcagagaagatgaatggtgcatctggtgcagaactgaaggctgtttgcacagaagcggggatgtttgctttgagggagagaagagttcatgtgacacaagaagattttgagatggcagttgccaaggtaatgaagaaggagaccgagaagaacatgtcattgcgcaagttgtggaagtaattatgcacactatcttggtgttcttgggaggcaatgtaggcgtaaaagacagatgtttaaagggcagtgaaattctaagacgaggatacatgcaagcatggccgtcttgcctttgttgctactatgctttgcattttgcttgcttggtgggggagtttttagttgcatacataccactttcctgatttacaagttaatagaactgtggacttgtggtattcgttttaaacttttaggtttatataaatattcttcacttgaaattattttttgtgttgcttgtggtgttaaatgcattggattagatttggggataatgattcacccgtgttccttcca

SEQ ID NO: 4174 - DNA, 2179 bp, Setaria italica
aaaatccagccgcggggagggaagcggcgaagcgaatcgcgcgatggcgacggtggcgatggacgtctcgcagccgtcggcgctgccggcggacggcgacaaggcggccgcggcgaaggggagtggcgtggggaaggggctggagcggtactacaagcagcagatccacgacgtggacctcgggctcctgcagaagatcaaagacctccgccgccaggaggcccagcgcaacgtcatcaactcccgagtcaaattttgccgggatgagttgcgtctgcttcaagaaccggcttcacatgttggtgaggttgtgaaggtgatgagcaaatcaaaggttctagtgaaggtgcatccagaaggcaaatacatcgtagatgttgataaaagcatagatattgcaaagctcatgccttccacaagagttgctcttcgaagcggcagctatatgcttcatgttatcctgcccagtaaagtcgatccattggttaatcttatgaaggttgagaaggttcctgattctacatacgatatgattggtggtcttgatcagcaaattaaagagatcaaagaggtgatcgagcttccaattaagcatcctgagttgtttgagagtcttggcattgcccaaccaacgggtgtcattctctatggccctccaggtacaggaaaaacattacttgcacgtgcggttgctcatcacacggactgcaccttcattagggtctcaggttctgagctggttcagaagtacattggagagggttcccggatggttcgcgaactttttgtgatggctagggaacatgcaccatccattatatttatggacgaaatagactccataggatctgctaggatggggtcaggaggtggtcgtggtgacagtgaggttcagcgaaccatgcttgagcttctaaaccaacttgatggttttgaggcaacacacaagattaaggttcttatggcaacaaacaggatagacatattggatcaagccctcctgaggcctggccgcattgacaggaagattgaatttccaaatccgaatgaaacttctcgctttgatattttgaagatccactccagaagaatgaacttgatgcgtgacattgatctgaagaagatcgctgcgaagatgaatggagcatcaggagcagagttgaaggctatttgcacagaagcgggaatgtttgcccttcgcgagagaagagtgcacgtcacccaggaggattttgatatggccgtggcaaaggcgctgccgaacacccagcccgtggactaccccagcttcaagctcgtcctcgtcggcgacggcggcaccgggaagacgaccttcgtgaagaggcacatcagtggggagttcgagaagcgatacgaaccaaccattggtgtggaggtgcggccgttggacttcaccacgagccatggcaagctgagattctactgctgggatacggccggccaggagaagtttggtggcctccgcgatggatactacatcaatggccagtgtgccatcatcatgttcgatgtcacctcaaggctcacttacaagaatgttcccacctggcacagggacatcagcagggtctgtgagaacatcccggttgtcctgtgtggcaacaaggtggacgtgaagaaccggcaggtgaaggccaagatggtgacctaccataggaagaagaaccttcagtactatgagatctccgccaagagcaactacaacttcgagaagcctttcctctaccttgcaaggaagctcgcagggaacatggacctcaggttcgaggcggagatcgcgctcgtccctgccgacgtgaccattgaccttgctgcacagaagaagattgaggaagagattacagctgcagcgtcgatgcccctgccggacgaggacgaagatatcatggactgagctgagctcagcaagatgctgtcaggctgccatagtttagttctaggtctactagttggtggttttaagagagacacctatctccgtttcagaattttagtcgtagcgtcaggtgaagctggtttaattctgtactagctagctatcgtcagtttcagtggttgccgatgtgaattccgtctcaaggatctactgtatttggatggtcaagctatttcttggtatattctggagaaatatatatatgtggtagttctacttggc

SEQ ID NO: 4175 - DNA, 1588 bp, Ambrosia trifida
attcatccaaataaacatagccctcaacactcctcttgtcttgcacaaaaagccatcaaacaacaccacaacaaatcgcctcttcttatacactcaacctattaacccattacgctcccaacccctctgatctaaaactacaagattgtgcaatggcaagtgtcgatgtagccatgaaaccatctgatccaacggacagaaatgaaaactgttcatcgaagtccacatcagcaaaatcaggtgaagggttgaggcaatattatttgcaacatattcatgatgcccaactgcaggttagacagaagacccataatcttaatcgccttgaagctcagcgtaacgagcttaattcacgagtcaggatgcttaaggaagagctgcagctgcttcaagagccagggtcttatgttggtgaagttgttaaagtgatggggaagtccaaagtactagtcaaagtgcacccagagggcaaatatgtagttgatatagacaaaagcattgatattactaagatcactccatcaaccagagtagcccttcgcaatgacagctatgttcttcatttggttttaccaagcaaagttgaccctctggttaaccttatgaaagttgaaaaagtcccggattctacatatgacatgattggtgggcttgaccagcaaatcaaagagattaaagaggttatcgaacttccaatcaaacatccagagttatttgagagtcttggaattgctcaaccaaagggagttctgttatacggaccacctggcacagggaagaccttgttggcaagagcagtggctcatcatactgattgtactttcatcagggtttctggttctgaactggtacagaaatatattggagagggatctcgaatggtcagagaactttttgttatggcgagagaacatgctccgtctatcatatttatggatgaaatagacagtattggatctgctcggatggaatctggaagtgggaatggtgacagtgaagtacaacgaactatgctcgagcttcttaatcagcttgatggatttgaagcatcaaacaaaatcaaggttttgatggctacaaaccgtattgatatcctggatcaggctcttcttaggcccgggagaattgataggaaaattgaattcccaaaccccaatgaagattcacggttcgatattctgaaaattcattcaagaaagatgaacttaatgcgtggcattgatttgaagaagatagctgagaagatgaatggagcctcgggtgctgagcttaaggcggtttgtactgaagctggaatgtttgctttgagggaaaggagagtccatgtgacacaagaagattttgagatggctgtcgctaaggttatgaagaaggataccgagaaaaacatgtctctgcgcaagctgtggaagtaatcaatcaagccaacgggttttctatctagtgtattgctttcagacgtttaaactttacatcctttatgtgcggattgtgttaagttacttttacctttgcatctaaaacatactaaagatcatcttaaagccgaacttctaaagacacacggttgatgttgatgttgattgaa

SEQ ID NO: 4176 - DNA, 1445 bp, Ambrosia trifida
caattaaacatagccctcaacactcctcctcttgtcttgcacaaaaagccatcaaacaacaccacaacaaatcgcctcttatacactcaacctattaacccaaaattactctctgcaagattgtgcaatggcaagtgtcgatgtagccatgaaaccatctgatccaacggacagaaatgaaaactgttcatcgaagtccacatcagcaaaatcaggtgaagggttgaggcaatattatttgcaacatatccacgatgcccaactgcaggttagacagaagactcataatcttaatcggcttgaagctcagcgtaacgaactcaattcacgagtcaggatgcttaaggaagagctgcagctgcttcaagagccagggtcttatgttggtgaagttgttaaagtaatggggaagtccaaagtactagtcaaggtgcacccagagggaaaatacgtagttgatatagacaaaagcattgatattactaagatcactccatcaaccagagtagcccttcgcaatgacagctatgttcttcatttggttttaccaagcaaagtcgaccctctggttaaccttatgaaagttgaaaaagtcccggattctacatatgatatgattggtgggcttgaccagcaaattaaagagattaaagaggttatcgaacttccaatcaaacatccagagttatttgagagtcttggaattgctcaaccaaagggagttctgttatacgggccacctggcacagggaagaccttgttggcaagagcagtggctcatcatactgattgtactttcattagggtttctggttctgaactagtacagaaatacattggagagggatctcgaatggtcagagaactttttgttatggcgagagaacatgctccgtctatcatatttatggatgaaatagacagtattggatctgctcggatggaatctggaagtgggaatggtgacagtgaagtacaacgaactatgctcgagcttcttaatcagcttgatggatttgaagcatcaaacaaaatcaaggttttgatggctacaaaccgtattgatatcctggatcaggctcttctcaggcctgggagaattgataggaaaattgaattcccaaaccctaacgaagattcacggttcgatattctgaaaattcattcaagaaagatgaacttaatgcgtggcatcgatctgaagaagatagctgagaagatgaatggggcttcgggtgctgagcttaaggcggtttgtactgaagctggaatgtttgctttgagggaaaggagagtccatgtgacacaagaagattttgagatggctgtcgctaaggttatgaagaaggataccgagaaaaacatgtctctgcgcaagctgtggaagtaatcaatcaagccaacgggttttctatctagtgtattgttttcagacatttaaactt

SEQ ID NO: 4177 - DNA, 2241 bp, Chelidonium majus
gaagcagaaccgacttcatcgacacgaaaaccccctctttctctctctaggttatttatctttctctctctaaacaagctctcttctaatggcgacagcagcagtggagattaagcaggcagaaacaggaggagttgagatttgtagcggatccaagaccatggcgaaacaaggtgaaggtcttagacagtactaccttcaacatatccacgatcttcagcttcaggtccgtcagaagacccacaatctcaatcgtcttgaagctcaaaggaacgatctcaattctagagtgaggatgctcagggaagaactacagttgctccaggaacccggatcgtatgttggagaagtggttaaagtcatggggaaatcgaaggttttagttaaggttcatccagaagggaagtacgttgtcgatattgataagagcatcgatatcacaaaaattacaccatcaaccagagttgctcttcgcaatgatagctatgtgcttcacttgattttgcccagcaaagtagaccctctggtcaacctcatgaaagtcgaaaaagttcccgactctacatatgacatgatcggtggtcttgatcaacaaatcaaagagataaaagaggtcattgagctgccaattaaacatcctgagttatttgagagtcttggaattgctcaaccaaagggagtcctgctgtatggaccacctggtactgggaaaactttgcttgcgagggcagtggctcatcatactgattgtaccttcatcagagtttctggttcagagttggttcagaaatacattggagaaggttccagaatggtcagagaacttttcgttatggcaagggaacacgccccctcaatcatttttatggatgaaattgacagtattggttctgcccgtatggaatctggaaccggtaatggtgatagtgaagtgcagcgaaccatgcttgagcttctcaatcagctggatggatttgaagcatcaaacaagatcaaagttctgatggctacaaatcggattgatattttggatcaagccctccttaggcccggaaggattgacaggaagattgagtttccaaatcccaatgaggagtcccgttgggatattttaaaaatacactcgaggaagatgaacttgatgcgtggaattgatctgaagaaaatagcggagaagatgcatggggcatctggtgcagagctcaaggctgtgtgcactgaagcaggtatgtttgcattgagggagaggagagtgcatgtgacacaggaagattttgagatggcagtggccaaggtaatgaagaaagagacagagaagaacatgtcactgcgaaagttatggaagtagatctctcatatacccaatgttttatcttgtttttcaatttggattcagtcatggaagccaaaccagagttgggttcttactctctgtatgatgatgaaagctttggattacttatctttcagttttatttatttctcaaacgattccttgaagatccaaatgttgttcttagaaatatatacctctttcagaacttaaaaaaaaaaaaaaacaaaaaaaatcattcattcattcttctccttgttcttcttgttttttacttctctttctcttattttgttctagtgttagaattcatttttcctgagtagaattcagaattctagagagagaaagaggcagagatggggaaatatgtggagatattggatttaggagtgagggtcgttgctaggtttcattctcactgcccacacacagctaggatgtactaccatcctcctgcagagcatcatggtgatatccacgagaaccaccaccaccaccaccagaacggcaactccacctcttctgcaaatggaacaactgagatatcttcttcttcttctggcatgatgggtggtagcagcagtgcaaatggtagctgtggaatcaaagcatttggtgggattgatactacagatttcatccttcactctgttatctaaacagaaattataactacaaaaaaataaaaaaagaaaaaaatacccaaatacgaagaattgaacaaatattgttacttttgaggtctttagatctgatattgtttggagatcatctccttttaattgtttctgttataagattttgagtacctccacaaattatcatctttagcttattgttgtttctctctttctctctctctctctatctctgattatttcgatctttgcatgaaatttattaaa

SEQ ID NO: 4178 - DNA, 1590 bp, Tabernaemontana elegans
gttcgttcttcttctctttctcgattgatcgctaggaagttcggtaaaaccaaagctataatctagaaaaatggcgacagcagagatcgagacaaaccggagcgaagctgagagaggagagacctgttcggcgaagggttcgatggtgaagcaaggcgaaggtttgaggcagtactatctgcaacacatccatgatctccagctccaggtccgtcagaaaacacacaatctcaatcgcctcgaagctcaacgtaacgagctcaattccaaagtgagaatgcttaaggaagagttacaattgcttcaagagcctggatcttacgtgggtgaagttgtcaaagtaatggggaagtcaaaggtgttagttaaagttcatccagaagggaaatatgttgtggatattgataaaagcattgatataacaaagatcactccatcaaccagagttgcccttcgcaatgatagctatgttcttcacttaattttgcccagcaaggtggatcctttagtcaacctcatgaaagttgaaaaagtacctgattctacctatgatatgattggtggccttgaccagcaaattaaagaaattaaggaggttattgagcttcctatcaaacaccctgaattatttgagagccttgggattgctcaacctaagggagttctgctttatgggcccccagggactggaaaaacattgttggctagggcagtggcacatcatactgattgtactttcatcagggtctctggttctgaactagtgcagaaatatatcggtgaaggttctcgaatggtgagggagcttttcgttatggccagggagcatgcaccatctatcatattcatggatgagatagacagtattggttctgctaggatggaatctggaagtggtaatggtgacagtgaagtgcaaagaacaatgcttgagcttctgaaccaacttgatgggtttgaggcatcaaataagatcaaggtattgatggccacaaatcgtattgatattttggatcaagccctccttaggcctggaaggattgataggaagattgaatttccaaatcccaacgaagattctcgctttgatatcttaaagattcattcaagaaaaatgaatttaatgcgtgggattgatttaaagaagattgcggagaagatgaatggtgcttcaggtgcagagctgaaggccgtgtgtacagaagctgggatgtttgccctgagggagagaagagttcatgtgacacaggaagattttgaaatggctgttgcaaaggtaatgaagaaggagactgagaagaatatgtccttaagaaagttgtggaagtaatttatctgcgtcctttgtttcccaaattaaatattacgtgaaaccagttaaatttgcgctcaatgttggttttacatggaggactggttcgtaccattttgcttctgtcgcaaactctttgtataactttgaatttactaagatgtgttgttcagctgaatttatttattttccccacgttgtttaacgtttaagactggaaaattttcgtgatatttcttttattcaaagcggggtactggcgagtcctcgattattaa

SEQ ID NO: 4179 - DNA, 1456 bp, Utricularia gibba
gtcggcggcgacggtggacgatcgtcctatggaggaaccgaagcagcaaagtcagcaaggtggaagcgcccgtggtggtgaagggctccggcagtattacaatcaacgcattcaggacatgcacctgcttgtgcgccaaaaagtatacgatctccagcgccttgaagctcagagaaacgatcttaatgctcgagtgcgatcactgaaggaggagctgcagcttcttcaagagccaggatcttatgttggcgaagttgtcaaagttatgggtaaatcgaaggtccttgtcaaggtacatcctgaagggaagtatgttgttgacgttgacaaaagcattgacatcactaagataactccttctacacgagttgctttgcgcaatgatagctatgttctgcatcttattcttcctagtaaagtcgatccgttggtgaatcttatgaaagtagaaaaagtacctgactcaacttatgacatgattggtggtcttgaccagcaaataaaagaaataaaagaggtgattgaacttcctatcaaacatcctgaattgtttgaaagccttggaatagctcaaccaaagggtgtcttgctgtatggacctcctggaaccgggaaaactcttctagctagagctgtggctcatcatacagactgtacgtttatccgagtctcaggttcagaattagttcagaagtacattggagaaggatcaaggatggtgagggagctttttgtgatggccagagagcatgctccctccatcatcttcatggatgaaattgatagcataggttcttctcgtatggaatctggtagtggtaatggggacagtgaagtgcagcgaacaatgctggagcttctcaaccaacttgatggttttgaagcctctaataagataaaggtgttgatggctacaaatcggatcgacattctagaccaagcacttctaaggccaggacgaattgatcgtaaaatcgagttcccaaatcccaacgaagattcacgatttgatatcttgaagatccactcaaggaaaatgaacttgatgcgagggattgatctgaagaaagttgcagagaaaatgaacggtgcatccggtgcagagttgaaggctgtttgcacagaagcagggatgtttgccctgcgtgagaggagagtccatgtgacccaggaggactttgagatggcggtggccaaggtcatgaagaaggacacagacaagaacatgtccctcaggaagctctggaagtaagtgtagttatttggctacgtcagcgcagtttccttctccacacaccatctgcttctggttcctagatgttcaaacccaaatcagattccgcataaacccacttctattattacatcttggttcttttttttttttcaattgggatctttccctgtaagaatgaatttggattcatcagaatgccctaggatttggggcttggcc

SEQ ID NO: 4180 - DNA, 1653 bp, Manihot esculenta
gtcttgttcccaaagaaattcctccaggcctaatacctgatttcacccaaagcttgtaaatcttgcatcaatggcgacggtaggggtggagatgaagcagccggaatcaattatggtggatgaaacatgctccgccaaggcggcggggaagcaaggggaggggctcaggcaatactatctacaacacatccatgagctccagctacaggtccgccagaagactcataatcttaatcgtctggaagctcagcgcaatgagctcaattccagagtgagaatgcttagagaagaactacagctgcttcaggagcctggttcatatgttggtgaagttgtcaaagtaatgggaaaaaataaggtgttggttaaggttcatccagaagggaaatatgttgttgatattgacaaaaatattgatatcacaaagatcactccatcaacaagggttgccctccgtaacgacagctatgtacttcacttgatcttgccaagcaaagtggatccattggtcaaccttatgaaagttgaaaaggttccagattctacatatgatatgattggtggtcttgaccaacaaattaaggagataaaggaggttattgaacttccaattaagcatcctgaattattcgagtctcttggaattgctcaaccaaagggtgttcttttgtatgggccacctggtactggaaagactctattagctagggctgtagcccatcatactgactgtactttcattagggtttctggctccgaattggttcaaaaatacattggtgaaggatctagaatggtcagagaactttttgtcatggcaagggaacatgctccatccatcattttcatggatgaaattgacagtattggatctgctagaatggaatctgggagtggaaatggtgacagtgaggtccagcggactatgctggagcttctcaatcagctggatggatttgaagcttcaaacaagatcaaggttttgatggcaactaatcggattgatattctggatcaagctctccttagacctggacggattgacaggaaaatagaatttccaaatcctaatgaagattctcgtctcgatatcttgaaaatccattcaagaagaatgaatttaatgcgtgggattgatttaaagaagattgcggagaagatgaatggtgcatctggtgcggagctcaaggctgtgtgcacggaggcaggaatgtttgccctaagggagaggcgggtccatgtaacacaagaagattttgagatggcagtagcaaaggtcatgaagaaggagacagagaagaacatgtcattgcgcaagctttggaaataaataaataaaatccatattttaatattttggttttctgaatcaaccaatgggaacacgaagaagaggaatcaaatagtttatccattggatttgatttttcctgcttggacttgggatcatgcatgtgctttctattcaaagggtggagggactctactaaagacatcatatattcatggtcaaggggccctgtagtctgtaagacacacagttggtgtcctctgtgttttaaacagaagccctggcctgtaattgtaggtttacttctctttgtaattccgagtattacttctcttgatttggttcctacacttctcgtatat

SEQ ID NO: 4181 - DNA, 1723 bp, Manihot esculenta
gatacagacggtggcaccgagaacataacatctcgtagaccatcagacttcttccggaagaaatccctcgagatcgaatatcttcttatcatttgaagtttccgagtccagtaatggcgacggtggggttggagacgaagcaagcggaatcaattatggcggaggagacatgctccgccaaggctgcagggaagcaaggggaggggctgaggcagtactatctacaacacattcatgagctccagctccaggtccgacaaaagacacacaatctcaatcgtcttgaagctcagcgtaatgagctcaattccagggtgagaatgcttagggaagaattacagctgcttcaggaacctggttcatatgttggtgaagttgtcaaagtaatgggaaaaaataaggtgttagttaaggttcacccagaaggcaaatatgttgttgatattgataaaaatattgatatcacaaagatcacaccatcaacaagggttgcccttcgtaatgacagctatgttcttcacttgatcttgccaagcaaagtggatccattggtcaaccttatgaaagttgaaaaggttccagattctacatatgatatgattggcggtcttgaccaacaaattaaggagataaaggaggttattgaactcccaattaaacatcctgaattgtttgaaagtcttggaattgctcaacccaagggtgttcttctgtatgggccacctggtactggaaagacacttttagctagggctgttgcacatcatactgactgtactttcattagggtttctggctctgaattggttcagaaatacattggtgaaggctctaggatggtcagagaactctttgtcatggcaagggaacatgccccatctatcattttcatggatgaaattgacagtatcgggtctgctagaatggaatctgggagcggaaatggtgacagtgaggtccagcgaactatgctggagcttctcaatcagctggatggatttgaagcatcaaacaagatcaaggttttgatggcaactaatcgaattgatattctggatcaagctctccttagacctggacgtattgacaggaaaatagaatttccaaatcctaatgaagagtcacgtctggatatcttaaaaatccattcaagaagaatgaatttaatgcgtgggattgatttaaagaagattgcagaaaagatgaatggcgcatctggggcagagctcaaggctgtatgcacggaggcaggaatgtttgctctaagggagaggagggtccacgtaactcaggaagattttgagatggcagtagcaaaggtcatgaagaaggagacagagaagaacatgtcattgcggaagctttggaaataaatgaattaaattcccattgggcatgtggagaatgtttgcaggactcgttaatgctggttggcaatcatgcatgtgcttttattcacagggtgaatggaccagtatttaagacatcataatcctagacgggtttcgtaagacggacagtttgtatcccctgttttaaacagaggatttggcctgtggattttctttgtaatcttggaatcttttattcataccgagtattacttctcttgattttccattgctttatccctgcttgcaaacgaaaattcgaacttgcatcctcttaccttcccgttcgatctatgtttcacctttgaatccgtaggtccctttgaaattta

SEQ ID NO: 4182 - DNA, 1411 bp, Gossypium hirsutum
tcaatactcaatggcgacggtggatatcgagaggaagcaagcggcatcggcggaagagatatgcaccgccaagagcggcgccaagcaaggggaagggctccggcaatactatatccaacacatccacgagcttcagctcaacctccgccaaaaaaacccacaatctcaaccgtcttgaagcccaacgcaacgagctcaattcccgagtgagaatgcttagagaggaactgcagctgcttcaggaacctggatcctatgttggtgaggttgtgaaaagttatgggtaaaaaacaaggtcttagtcaaggttcatccagaaggaaaaatatgttgtcgatattgataagaatattgatatcacaaaaaatcacaccatccactagagttgctcttcgcaatgacagctatgttctccatctgatcttaccgagcaaagtagatcccttggttaatcttatgaaagttgaaaaagtaccagattctacgtatgacatgattggtggtcttgatcaacaaattaaagagataaaagaggttatagaacttccaattaaacaccctgaattgtttgaaagtcttggaatagctcagccaaaggtgttctgttgtatggaccaccgggtacaggaaaaactctattggctagagctgtggcccatcatactgattgcacttttatcagggtttccggttctgaattagttcagaaatacattggagagggctctcgaatggttagagaacttttcgttatggccagggagcacgctccgtcgatcatatttatggatgagatagacagcattgggtccgctcgaatggaatctggaagtggcaatggcgacagtgaggtgcagagaacaatgctggagcttctcaaccagcttgatggatttgaagcatctaacaagatcaaggttctgatggccaccaatcggatcgatatcttggatcaagctcttcttaggccaggacgaattgacaggaagattgaatttccaaatcctaatgaggagtctcgtttcgacatcttaaaaatacattctagaagaatgaatttgatgagagggattgatctaaagaagattgctgagaagatgaacggtgcttctggtgcagagcttaaggctgtgtgcacggaatcaggaatgtttgctttgagggaaaggagagtccacgtaacacaagaagatttcgagatggcggtggcgaaagtaatgaagaaggagagcgagaaaaacatgtccttacggaagctatggaagtgattatgttttattatttattgtgctttcgcggtttttggggtaaattcaaacatggaaacccgatttaatatatgaacaatgtatagaaatattatattatttgcctggctagtactacacacgtctacttttctagacaaggt

SEQ ID NO: 4183 - DNA, 1579 bp, Ipomoea nil
gagcctgaatcaaaccaacccgacccgaattgaaactgttgaaggtcattccttctcaacttctcatcttctgaaaaactgtggattgtgattagaaaccctaaacccgcgatcaaagaatggcgacggtggaggtgagaaagagcacaaccgaatcagggagagaagatagctgttcagcgaagccgatgaagcaaggtgaaggcctgaagcagtactacatgcagcacatccacgatctccaactccaagtccgccaaaagggtcataatctcaatcggctcgaagcccagcgtaacgagctcaattctaaagtgagaatgttgaaggaagagttacaactgcttcaggagcctggatcttatgtcggtgaagttgtcaaagtgatggggaagtcaaaagttttggttaaagtacatcctgaaggcaaatatgttgttgacattgataagagcattgacataacaaagattactccatcaaccagggttgctcttcgcaacgatagctatgttctccatttgattttacctagcaaagtggatcctttagtcaaccttatgaaagttgaaaaagttcctgattctacttatgatatgattggtggtcttgatcaacaaatcaaggagattaaggaggttattgagcttcctattaaacaccctgaattatttgagagtcttggaattgcccaaccaaagggagtactgctttatggacctccaggaactgggaaacactgttggcaagagctgttgcacatcatactgattgtaccttcattagggtttctggctctgaactagtgcaaaaatatattggagaaggctctcgaatggtgagagaactttttgtaatggccagagaacatgctccgtctattatatttatggatgaaattgatagcattgggtcagctagaatggaatcaggaagtgggaatggtgacagtgaagtgcaacgcacaatgcttgagctccttaaccagcttgatggatttgaggcatcaaacaagatcaaggtattgatggccacaaaccgtatagatattctggatcaggcccttctcagaccaggaagaattgaccgaaaaattgaatttccaaatccgaatgaagagtctcgctgggatatcttgaagattcattctaggaaaatgaacttgatgcgtgggattgatctaaagaagatagcagaaaagatgaatggtgcttctggtgccgaacttaaggctgtttgtactgaagcggggatgtttgctctacgagaaaggagggtccacgtgacacaggaagattttgagatggcagtggcgaaggtgatgaagaaggatacagagaagaacatgtcattgcgcaagctatggaagtaagtaattgagacgtaggtcgtcccagttgtcatctggcaacaccgaatgcttgctagtttttgagtcagacttggaagaaattgtgtatgtttttacgatgcataacgcacgaatgtacccgtcctattaaatacagttttacacttcttgttaactgctcacaaaacaatcaaaacgttacgcaaatctgaaaagagaacgaagctc

SEQ ID NO: 4184 - DNA, 1931 bp, Malus domestica
gacaccaaccactgcaccaatcccacgtaaagaatcgcaatggctgccgccggagtcgagatcaagcacccggacgccgcgccggaggagacgtgctccgccaaggcctccaagcaaggcgagggactgaggcagtactacctccaacacatccacgagcttcagctccaggtccgccagaagactcacaacctcaatcgcctcgaagctcagcgcaacgagctcaattcccgagtgagaatgctcagggaagaactgcagctgcttcaggagcccggatcgtatgttggtgaagttgttaaagtaatgggaaagaacaaggttttggttaaggttcatccagaagggaaatatgtcgttgatattgataaaaacattgatatcacaaagatcacaccatcaacaagagttgctctccgtaatgacagctacgtgctacacttggtcttgccaagcaaagttgatcctttggtcaaccttatgaaagttgaaaaagttcccgattctacttatgatatgattggtggtctggatcagcaaatcaaagaaataaaggaggtcattgagcttccaattaagcatcctgaactgttcgagagtcttggtatagctcagccaaagggtgtgctgctttatggaccacctggcactgggaaaacacttttggctagggctgtggcccatcacaccgactgtacattcatcagggtttctggttcggagttggtccagaagtacattggggaaggatctagaatggtcagagaactttttgtcatggccagggaacatgcgccatctataatttttatggatgaaatcgacagtatcggatctgctcgtatggaatctggtagtggcaatggggacagtgaagtgcagcggaccatgcttgagcttctcaaccagcttgatgggtttgaggcatcaaacaagatcaaggtcttaatggctacaaatcgtattgatattctggatcaagctctccttaggcctggacgaattgacaggaagattgagtttccaaatcctagtgaagagtctcgttgggacatcttgaaaattcattcaagaagaatgaatttgatgcgtggaattgacctgaagaagattgcagagaagatgaatggtgcatctggtgcagaactgaaggccgtttgcacagaggctggaatgtttgcattgagggagagaagggttcacgtaacgcaagaagattttgagatggcagtggccaaggtaatgaagaaggagaacgagaagaacatgtcgttgcgcaagttgtggaagtaaattacgttgtcatggtgttgtttgagcaatgtaggcacaaaagacgatgtttatgatgatagatgcagacatgggcatcttgcctggcttctacttgcgtatattttactgcctggtggagggtttaaaccatgaggtttttactagcgaactatcaagtgtgcctcttatgttaaaatatatgtacactcttcaataccaaattatttttatgcttccttctagtgctaatgcatcaaattagactggcaatatgtatgtgttgaacaaatgaagggtcggttaaagtaacaaatgacattattatgaaaaatggacgccacattattgttaatggaggagtgactcctaagaaaaattatgttgaaagtcctaattttgtaacagaaaatctttgccagatatatgggtgtattgcgggacaaggtcgagagagatggatacaatgttcccatatgatggcaccaatcacaggtttgaaaccaccaatgcaggtacaagtacccatatggcatgctgctagctacggtggcatcttggaggaggaggagaatgtgcgtgcggtggttttatcatccatgaccgcgatggaggtctttaagtacgttttgcttcatacggcatgcggaaaatcctga

SEQ ID NO: 4185 - DNA, 1508 bp, Orobanche aegyptiaca
taacttggccaggacgaaaccctccttttattctccgatctccgaagaatcatatacaatggcaacggcagcgatagagacccggcaggtggatgaatccaaacaaactcatcagcaaggcgctggagccggaggcggcggcgaagggctccggcagtactatcagcagcggatacaggatatgcagttatcagtccgtcagaaggtacacgatctgcaacgattggaagctcagcgcaatgacctcaacgcccgagtgagatcactaaaggaagaactgcagcttcttcaagagcccggatcttatgttggtgaagttgtcaaagttatgggaaaatcgaaggtcctagttaaggtccatcctgaggggaagtatgtagttgacattgacaagagcattgacataactaagattacaccttcaacgagggttgctttacgtaatgatagctatgtgctccacttggtcctacctagtaaagttgatcctttggtgaatcttatgaaagtagaaaaggttccaaattccacttatgacatgattggtggtcttgaccagcaaattaaagagataaaagaggtgattgaacttccaatcaaacatccagagttgtttgagagtcttggaatagctcaacctaagggtgtgttgttatatggtcctcctggcacgggtaagactttgcttgctagggcagtggctcaccatacagactgcactttcatccgagtttcgggttctgaattagttcagaagtacattggggaagggtctagaatggtgagagaactttttgtgatggccagagagcatgctccatccatcatcttcatggatgaaattgatagcataggatctgctcgtatggaatctggcagtggaaatggggatagtgaagttcagagaactatgctggagctactcaatcaacttgatggatttgaggcatctaataagataaaagtattgatggccaccaatagaattgacattcttgaccaagctcttcttagaccgggaagaatcgataggaaaattgagtttccaaatcccaacgaggagtctcggtttgacatcttgaagatacactcgaggagaatgaatttaatgagagggattgatttaaagaaaattgccgagaagatgaatggtgcatctggtgcagaactcaaggctgtttgcactgaagctggaatgtttgccctgagagagaggagggtccatgttactcaggaggactttgagatggctgtcgccaaggtcatgaagaaggagaacgagaaaaatatgtctttgaggaagctctggaagtagatataaatactaattttaagttaacgttcgagaatgttgtggaacgggacttggtaatgataacccgtggactacatgtttttatgtatttgtacaattttttctgaacttctggaacataacgttttcagctttcatagaattgttctactttagtgtgtggtttggtttgatttaagagtcacggcttgaa

SEQ ID NO: 4186 - DNA, 1597 bp, Catharanthus roseus
gaaagcggcatcggaccaaacaccgacccttggcttatattgagagggtgaagcaattcttgttcttcttcccgatccattgctccaaaaaatctgattgaatcatcaaaagtttcagtccagaaaaaatggcgacagcagagatcgagacgaaccgtagcgaagctgagagagaagagagctgttcggcgaagggttcgatggtgaagcaaggcgaaggtttgaggcaatactatatgcaacatatccatgatctccaactccaggtccgtcagaaaacgcacaatctcaatcgtctcgaagctcaacgtaacgagctcaattctaaagtgagaatgcttaaggaagagctacaactgcttcaagagccgggatcttatgtaggtgaagttgtcaaagtgatggggaagtcaaaagttttggttaaagttcatccagaagggaaatatgttgtggatattgataagagtatcgatataacaaagattaccccatcaaccagggtcgcccttcgcaatgacagctatgttcttcatttgattttgcccagcaaggttgatcctttagtcaacctgatgaaagttgaaaaagtacctgattctacttatgatatgattggtggccttgaccaacaaattaaagagattaaggaggttattgagcttcctatcaaacaccctgaattattcgagagtcttggaattgcccagcctaagggagttctgctttatggccccccaggaaccgggaaaacattgttggctagggcagtggcacatcatactgattgtacttttatcagggtctctggttctgaactagtgcagaaatatattggtgaaggttctcgaatggtgagggaactttttgttatggccagggagcatgcaccgtctatcatattcatggatgagatagatagtattggttctgctaggatggaatcaggaagtggtaatggtgacagtgaggtgcagagaacaatgcttgagctgctgaaccaacttgatgggtttgaggcatcaaacaaaatcaaggtattgatggccacaaatcgcattgatattctggatcaagccctccttaggccaggaaggatagataggaagatagaatttccaaatcccaatgaagagtctcgctttgatatcttaaagattcattcaagaaaaatgaatttaatgcgtgggattgatttaaagaagattgcggagaagatgaatggtgcttcaggtgcagaattgaaggccgtgtgtaccgaagctgggatgtttgctttgagggagagaagagtccacgtgacacaggaagattttgaaatggccgttgcaaaggtaatgaagaaggagacggagaagaatatgtccttgagaaagttgtggaagtaattcatttgttttcacaaacccagttattaaattttccctcgttgttttacttggaagcatcgtggtgtggttggtttcctaatgttggtaatccttccttgttactactataagatataactggaattcacaaaatttgttgttatgctgaattaatacaatctcaactcttcattccaaaactatttattgcgacttcttcttttgtc

SEQ ID NO: 4187 - DNA, 1674 bp, Citrus sinensis
aagaaactataatgtataggtatatataacgcgctgcggtcacattacagcgactaaaaacaaaccaaacccgaacgagacttgatccgaaagacaattagattcgaacaaatcgaactcgttcactcggaaagaatggccgctgtaggaatcgaaacgaagcagccggaatcggcggcgccagaggaggtgtgtgcggcgaaaggagcatcgaaacaaggagagggattgaggcaatactacctccaacacattcacgaactccagctccaagtccgtcaaaaaacccacaatctcaatcgcctcgaagcccagcgtaacgaactcaattctagagtgcggatgcttaaagaagaattacagcttcttcaagagcctggatcctatgtcggtgaagttgttaaagttatgggaaaaaataaggttcttgttaaggttcatcctgaggggaaatatgttgttgatattgataaaagtattgatataaccaagatcactccgtcaacaagagttgcacttcgtaatgacagctatgttcttcatttgatcctgccaagcaaagtagatcccctggtcaaccttatgaaggttgaaaaggtccctgattctacatatgacatgattggtggccttgatcagcaaattaaggagatcaaggaggtcattgagcttcctatcaaacatcccgaattgttcgagtctcttggaatagctcaacccaagggtgtattgctatatggaccacctggtactggcaaaacactgttggctagagctgtggctcatcatactgattgtactttcatcagggtttctggttctgaattagtccagaaatacattggagaaggctccagaatggttagagaactttttgttatggcaagggaacatgctccgtctatcatttttatggatgaaattgacagtatcggatctgcccgaatggaatctggcagcggaaatggtgacagtgaggtgcagaggactatgctggagctgctcaaccagcttgatggatttgaagcatcaaacaaaattaaggttctcatggcgacaaatcgaattgatattctcgatcaagctcttctcaggccaggacgaattgacagaaagattgaatttccaaatcctaatgaagagtctcgtcttgatatcctaaaaattcattcaagaagaatgaatttaatgcgtggcattgatttgaagaagattgccgagaagatgaatggtgcatctggtgcggagcttaaggctgtgtgcacagaagccggtatgtttgctctaaagagagagaaggatccatgtaacacaggaagattttgagatggcagtggccaaggtcatgaagaaagaaacagagaagaacatgtccttgcggaagttgtggaagtaatcatttccatgtgctgtgctgtgtatttgcttattttctgagcaagattcaagtagtccttaacggcactcactcgtgttctgggacatttgcacgataggcccttttagcctgactgttgtcttttcttgcgctctagcctcttatgataaacaaatttgcaatctattttatctaaatttaaattcgcatgcaattctggaaacctcagtacctcactaataatggaaaagcccgtctgtgtcttgtaagcagcagtactatcatcggtttcctaa

SEQ ID NO: 4188 - DNA, 1491 bp, Malus domestica
tcgcacacgaacaatcgcaatggccgccgccggagtagagatcaagcacccggacgccgcgccggaggagacatgctccgccaaggcctccaagcaaggcgagggactgcggcaatactacctccagcacatccacgagcatcagcttcaggtccgccagaagacccacaacctcaatcgtctcgaagctcagcgcaacgagctcaattcccgagtgagaatgctgagggaagaactacagctgcttcaggagccgggatcatatgttggtgaagttgtcaaagtaatgggaaagaacaaggttttggttaaggttcatccagaagggaaatatgtcgttgatattgataaaaacattgatatcacaaagatcacgccatcaacaagagttgctctccgcaatgacagctatgtgctacacttggtcttgccaagcaaagttgatcctttggtcaaccttatgaaagttgaaaaagttcccgattctacttatgatatgatcggtggcctggatcagcaaatcaaggaaataaaggaggtcattgaacttccaattaagcatcctgaactgtttgagagtcttggtatagctcagccaaagggtgtgctgctttatggaccacctggcactgggaaaacacttttggccagggctgtagcccatcatactgactgtacattcatcagggtttctggttcggagttggtccagaaatacattggggaaggatctagaatggtcagagaactttttgtcatggccagggaacatgcgccatctatcatttttatggatgaaattgacagtatcggatctgctcgtatggaatctggtagtggcaatggtgatagtgaggtgcaacggactatgcttgagcttctcaaccagcttgatggatttgaagcgtcaaacaagatcaaggttttaatggccacaaatcgtattgatattctggatcaagctctacttaggccaggacgaattgacaggaaaattgagtttccaaatcctagtgaagagtctcgttgggatatcttgaaaattcattcaagaagaatgaatttgatgcgtggaattgacctgaagaagattgcagagaagatgaatggtgcatctggtgcagaactgaaggccgtttgcacagaagctggcatgtttgctttgagagagagaagggttcatgtaacgcaagaagattttgagatggcggtggccaaggtaatgaagaaggagaacgagaagaacatgtcgttgcgcaagttgtggaagtaaattacgttatcatggtgttcttggagcaatgcaagcacgaaagacgatgtttatgaggatatttgcaggcatgggcatcttgcctggcttctacttgcttgcattttacttaccgggtggagggtttaaaccatgttgtttttacttgcaaactgtcaagtgtgtgcctctatgttaaagttacatatatttttcaattccaaattatttttatgttt

SEQ ID NO: 4189 - DNA, 1620 bp, Cannabis sativa
ggggtatagttgtattttcatagtttatttagcgacttactttaagattgagtttagggaacgaaactcaaatctcagtctgaaacgaattacaccctttccaatggcaacagtgttcgtcgaatccaagcagccagaggcgatgatgccggaggagacttgctcctccatcgcagcaaagcaaggggaaggtcttaaacagtactacctccaacatatccatgatctacagctccaggtccgcctgaaaacccacaatcttaatcgtcttgaagctcagcgtaacgagctcaactctagagtgaggatgcttagggaagagctacagctacttcaggagcctggatcatatgttggagaagtagtcaaagtaatggggaaaaacaaggttttagttaaggttcatccagaaggaaaatacgttgttgatattgataaaagcattgatatcacaaaaattacaccatcgactagagttgctctccgaaatgatagctatgttcttcatttggtcttgccaagtaaagtagatcctttagttaaccttatgaaagttgaaaaggttccagattctacttatgatatgatcggtggacttgatcagcagatcaaagaaatcaaggaggtcattgaacttccaatcaaacatcctgaattgtttgagagtctcggaatagctcaaccaaagggtgtccttctctatgggccccctggtacagggaaaacacttttggctagggctgtggctcatcatactgattgtaccttcatcagggtttctggttctgaattagttcagaagtacattggagaaggctctagaatggttagagaacttttcgtcatggcgagggaacatgctccatctattatttttatggatgaaattgatagtattgggtctgctcgaatggaatctggaagtggcaatggagatagcgaggtgcagcggactatgttggagcttcttaaccagctggatgggtttgaagcatcaaacaagatcaaggttttgatggcaacaaatcgcattgatatacttgatcaagcactccttaggcccgggagaatcgacagaaagattgagtttcccaatcctaatggggagtctcgatttgacatcttgaaaattcattcgaggagaatgaatttaatgcgtgggattgatctaaagaagattgcagagaagatgaacggtgcatctggtgcagagctgaaggctgtgtgcacagaggcaggaatgtttgcattgagggagagaagggttcatgtaacacaggaggactttgagatggcagtggccaaggtaatgaagaaggacactgacaaaaacatgtcgttgcgcaagctatggaagtagttcttttcggatgtgctatgcaacttctagcttacattatacacagttggatgttttgaaatttacctagattcacgctgtattttttatttattgcatacccccaaaaaaatcacttttacactaagctgaaaaggaatttggtataaaaaaaaatggaaaaattgagattttattatgtttcagaacacgagtatataatttcaaataaaaactaaatcaattggtatgtgtgaaaaatctcaagcatcagcttataa

SEQ ID NO: 4190 - DNA, 1620 bp, Flaveria ramosissima
tatctaccagattcatttgaagaagccctcgaatactcctgtcttgcggagaaagacatcgaataacatcatcaaatccctctgatacacgaaatctgttggtttacaaattaacagatctaacaacagagcaagatcatcgaatggcgactgtagatgtagccatgaagccatcagattcagtggaccgagatgataactgttcatcaaggcctacaacggcgaaatcaggtgaaggtctgaggcaatactacttgcaacacatccacgatgctcaactacaggttcgccagaagacccataatctcaatcgccttgaagcgcagcgtaatgagcttaattctcgagtcaggatgcttaaggaagagttgcagctacttcaagaaccaggatcttatgttggtgaagtggttaaagtaatgggaaagtccaaagtactagtcaaggtgcatccagagggtaaatatgtagttgatatagacaaaagcatcgatattactaagatcactccatcaaccagagtagcccttcgcaatgacagctatgttcttcatttggttttaccaagcaaagttgaccctctggtcaacctcatgaaagttgaaaaagtcccagattctacatatgacatgattggtggactagaccagcaaattaaagaaattaaagaggttattgaacttccaattaaacatccagagttatttgagagtcttggaattgcacaaccaaagggagttttgttatatgggccacctggcacaggaaagaccttgttggcgagggcagtggctcatcatactgactgtactttcatcagggtttctggttctgaactagtacagaaatatattggagagggatctcgaatggtccgagaactttttgttatggccagggaacatgctccatctatcatattcatggatgaaatagatagtattggatctgctcgtatggaatctggaagtggaaatggtgacagtgaagttcaacgaactatgcttgagcttctcaatcagcttgatggatttgaagcatcaaacaaaatcaaggttctgatggctacaaaccgtattgatatcctggatcaggctcttctcaggcctgggagaattgataggaaaattgaattcccaaatcccaatgaagattcacggtttgatattttgaaaattcattcaagaaagatgaacttaatgcgtggcattgatttgaagaagatagccgagaagatgaatggggcttctggtgctgagctcaaggctgtttgtaccgaagctggaatgtttgctttgagggaaaggagagtccatgtcacacaagaagattttgagatggcggttgccaaggttatgaagaaggaaaccgagaaaaacatgtctctgcgcaagctttggaagtaagcaagctctaataagtcaacggatttgctacctagtatcgtttacaaagggtcgaggtttacatcttttatgtgcggagtgtgttcgactacaagtactttgttttaagtaaattttatcttttgcatctaaacatgttgttattatgttaatcccaaacttttaaggacaaatggttcatgttgatttaagcttattattatggtaatagcag

SEQ ID NO: 4191 - DNA, 1570 bp, Flaveria ramosissima
aagaagccctcgaatactcctgtcttgcggagaaagaaatcgaataacaacatcaaatccctccgatacacgaaagctgttggatcacaaattatcagatctaacaacagagcaagatcatcgaatggcgactgtagatgtagccatgaagccatcggattcagtggacagagatgataactgttcatcaaggcctacaacggcgaaatcaggtgaaggtttgaggcaatactacttgcaacacatccacgatgctcaactacaggttcgccagaagacccataatcttaatcgccttgaagcgcagcgtaacgagctcaattctcgagtcagaatgcttaaggaagagttacagctacttcaagaaccaggatcttatgttggtgaagtggttaaagtaatgggaaagtccaaagtactagtcaaggtgcatccagagggtaaatatgtagttgatatagacaaaagcatcgatattactaagatcactccatcaaccagagtagcccttcgcaatgacagctatgttcttcatttggttttaccaagcaaagttgaccctctagtcaacctcatgaaagttgaaaaagtccctgattctacatatgacatgattggtgggctagaccagcagattaaagaaattaaagaggttatcgaacttccaatcaaacatccagagttatttgagagtcttggaattgctcaaccaaagggagttttgttatatgggccacctggcacaggaaagaccttgttggcaagggcagtggctcatcatactgactgtactttcatcagggtttctggttctgaactagtacagaaatatattggagagggatctcgaatggtccgagaactttttgttatggccagggaacatgctccatctatcatattcatggatgaaatagatagtattggatccgctcgtatggaatctggaagtggaaatggtgacagtgaagtacaacgaactatgcttgagcttctcaatcagcttgatggatttgaagcatcaaacaaaatcaaggttctgatggctacaaaccgtattgatatcctggatcaggctcttctcaggcctgggagaattgataggaaaattgaattcccaaatcccaatgaagattcacggtttgatattttgaaaattcattcaagaaagatgaacttaatgcgtggcattgatttgaagaagatagccgagaagatgaatggggcttctggtgctgagctcaaggctgtttgtaccgaagctggaatgtttgctttgagggaaaggagagtccatgtcacacaagaagattttgagatggcggttgccaaggttatgaagaaggaaaccgagaaaaacatgtctctgcgcaagctttggaagtaagcaagctctaataagtcaacgaatttgctacctagtatcgtttacaaagggtcgaggtttacatcttttatgtgtggactgtgttcgactataagtactttgttttaagtaaattttatcttttgcatctaaacatactgatattatgttaatcccaatctttaaggacaaatggttcatgtt

SEQ ID NO: 4192 - DNA, 1515 bp, Flaveria ramosissima
cgaatactactgtcttgcggagaaagacatcgaataacaccatcaaatccctccgatacacgaaagcttttggatcacaaactctcagatctaacaacagagcaagatcatcgaatggcgacggtggatgtagcgatgaagccatcggattcagtggacagagatgataactgttcatcaaggcctacaacggcgaaatcaggtgaaggtctgaggcaatactacttgcaacacatccatgatgctcaactacaggttcgccaaaagacccataatctcaatcgccttgaagcgcagcgaaacgagctcaattctcgagtcaggatgcttaaggaagagttgcagctacttcaagaaccaggatcttatgtcggtgaagtggttaaagtaatgggaaagtccaaagtactagtcaaggtgcatccagagggtaaatatgtagttgatatagataaaagcatcgatattactaagatcactccatcaaccagagtagcccttcgcaatgacagctatgttcttcatttggttctaccaagcaaagttgatcctctggtcaacctcatgaaagttgaaaaagtccctgattctacttacgacatgattggtgggctagaccagcaaattaaggagattaaagaggttatcgaacttccaatcaaacatccggagttatttgagagtcttggaatagctcaaccaaagggagttctgttatatgggccacctggcacaggaaagaccttgttggcgagggcagtggctcatcatactgactgtactttcatcagggtttctggttctgaactagtacaaaaatatattggagagggatctcgaatggtcagagaactttttgttatggccagggaacatgctccatctatcatattcatggatgaaatagatagtattggatccgcgcgtatggaatcgggaagtggaaatggtgacagtgaagtacaacgaactatgcttgagctactcaatcagcttgatggatttgaagcatcaaacaaaatcaaggttctgatggctacaaaccgtattgatatcttggatcaggctcttctcagacctgggagaattgataggaaaattgaattcccaaatcccaatgaagattcacggttcgatattttgaaaattcattcaagaaagatgaacttaatgcgtggcattgatctgaagaagatagctgagaagatgaatggggcttcaggtgctgagcttaaggcggtttgtactgaagctggaatgtttgctttgagggaaaggagagtccatgtcacacaagaagattttgagatggcggttgccaaggttatgaagaaggaaaccgagaaaaacatgtctctgcgcaagctttggaagtaagcaaatgaaaactctaagtaagccaacggcttttctacctagtactgtcttcaaggactgtgttcaactatgagtactttgttttaaattaattttattcttttacctattctaaactattattagatatttatgtta

SEQ ID NO: 4193 - DNA, 1821 bp, Gossypium raimondii
aaaactacgaaaacgatcttaaaaaaaaatttaaaaataaaaaatcaggtgccgagtctttagtaatagaaaaaattgacaaggcccaactaccgcgaaacccattaatatttcacccaaaactgaggcaagactttgtaaattgcatatataaccccaaacaaaaacaccattttaattccaattccaaatcaaaacttgttgtcaaagaaaaatccccttgtaccaagtatctgagtgccattgtagtttccaaaatcaagaacctagaagcaaactcaaatggcgacggtcgctatcgagaggaagcaacaggcatctgcggaagagatgtgcaccgccaagagcggtgccaagcaaggggagggcctccgacaatactatcttcaacacatccacgagctccagctcaatctccgccaaaaaacccacaatttgaaccgactcgaagcccaacgcaacgagctcaattctcgagttagaatgcttagagaggaactgcagctgcttcaggagcctggatcctatgttggtgaggttgtgaaagttatgggtaaaaacaaggttttagtcaaggtccatccagaaggaaaatatgttgtcgatattgacaagaatattgatatcacaaaaatcacaccatcaacaagagttgctctgcgtaatgacagctatgttctccatctgatcttacctagcaaagtagaccctttggttaaccttatgaaagttgaaaaagttccagattctacgtacgatatgattggtggtcttgatcaacaaattaaagagataaaagaggttatcgaacttccaattaaacatcccgaattgtttgaaagccttggaatagcccagccaaagggtgtcctgctttatggaccacctggtacaggaaaaacactattggctagagctgtggcccatcatactgattgtacctttatcagggtttctggttctgaattagttcagaaatatatcggggagggttctcgaatggttagagaacttttcgttatggccagagagcatgctccatcaattatatttatggatgagatagacagtattggatctgctcgaatggaatctggaagtggaaatggtgatagcgaggtgcagcgtaccatgttggagcttctcaaccagcttgatggatttgaagcatctaacaagatcaaggttctgatggccacaaaccggatagatatcttggatcaagctcttcttaggccaggacggattgacaggaagattgaatttccaaatcccaatgaggagtctcgactggacatcttaaaaatacattctagaagaatgaacttgatgcgagggattgatctaaagaagattgcagagaagatgaatggtgcttctggtgcagagcttaaggcggtatgcacagaagcagggatgtttgcattgagggaaaggagagtccatgtaacacaagaagattttgagatggcagtggcgaaggtgatgaaaaaggagaccgagaaaaacatgtccttacggaagctttggaagtgattacatttttttgttttggggaaagatggaacatgtgtaaacctcatcccaatactcaaaaaacaatgtatcgactatttagtacacaatttgtcgttctgcttggtaccatgcatctgctttcttgacaaggctgtctttcagagttgctaggagaggattattattattatttttaaatgaacaacttggtttgacttgcagagttgtggataatacatacagcgcttggtttacaatggaggcaggcaactgactccgttaaagtagtaacataagattcta

SEQ ID NO: 4194 - DNA, 2138 bp, Lippia dulcis
tactatccgaacccaacgcagaagaaccctaaatttccaaatatccgatgacacaaatcaaagctgacaacctgacaatttgacacccgcaaaaaaaaacacgcccaattgccggattacacacacacaaaaaaaggtgatttatgagatcaaaacgattgtcctctttctcgtaaatggattagaaatacagattgaaaacaagaaatccctaacagatcaagaagtatacgaaacccttctccttggatattgttgattgattgaagttcttcgtggatccacacctcctagccctaaattgatcaaatttattcgtcaatactatagagggaaaaaggaatacaaagaagaagaagaagacatctacgaaagaacaggctccattggtacacaactggagtaactgggctaggcgcaagaagctcatgggaaatgaattggtatatttatagggatctatttccaatttagccatttttccattctctttttgcaattaaaataatatattgagatttcaaaatttcggggcataatgctaaaatatttataattacggggacaaattgatattttgagaaaatttggtgtgaaagtaaaatttctgagagataaaatccttatattcacagtatatatgaccgagcggaaataaagaaggaacagattgcagaaatataacttcgcgaagacgaaaatcgcctataatccgatctcctctgagaacaaattccggcgtatcgcatagtatggccacggcggcgatagagagtaggcaggcggatgactcgaagcaacagcaccggcaaggagctggttccggcggcggcgaagggctccggcagtactatcagcagcgcatacaggatatgcagctgctagtccgtcagaaagtccacgatctccagcggcttgaagctcagcgcaatgaccttaatggccgagtgagatcactaaaggaagagttacagcttcttcaagagcctggatcttatgttggtgaggttgtcaaagttatgggaaaatcaaaggtccttgtgaaggtccatcctgagggaaagtatgtagttgacatcgacaagagcattgacattacaaaaattacaccttcaacaagggtcgcgttacgtaatgatagctacgttctgcacttgatcctacccagtaaagttgatcccttggttaaccttatgaaggttgaaaaagttccagactctacgtatgacatgattggtggtctagaccaacaaattaaggagataaaagaggtgattgaacttcccatcaaacatcctgagttgtttgagagtcttggaatagctcaacctaagggagtcttgctatacggtcctcctggcacgggtaaaactttgcttgcgagggcagtagctcaccatactgactgtacttttatccgagtttcgggctctgaattagtccagaagtatattggagaaggctctagaatggtgagagaactttttgttatggccagagagcatgctccgtcaatcatcttcatggatgaaattgatagcatagggtctgctcgtatggaatctggaagtggaaatggggatagtgaagttcagcgaactatgctggagcttcttaaccaacttgatgggtttgaagcgtctaataagatcaaagtattgatggctaccaatagaattgacattctggaccaagctcttcttaggcctggaagaattgataggaaaattgaatttccaaatcccaacgaagagtctcggtttgacatcttgaagatccattcgagaaaaatgaatttaatgagagggattgatctgaagaaaattgctgagaaaatgaatggtgcatctggtgcagagctaaaggctgtttgcactgaagccggaatgtttgctttgagagagagaagggttcacgttactcaggaggactttgagatggctgttgccaaggtcatgaagaaggaaacagagaaaaatatgtctttgaggaagctttggaagtagattgtttagcagtgttctcgaactggaaagacaagagttgtcgaactcaaacctagtttagataactcatagcgaatatgttttttccgtatatctgtacgcgaatatgtttttcccgtatatctgtgctat

SEQ ID NO: 4195 - DNA, 1471 bp, Platanus occidentalis
gactgcagcgatcgaaacgaagcaagcggaagccgtagcagctgaggagatgtgctctgcgaaggcgatgaagcaaggagagggtctcagacagtactaccttcaacacatccatgatcttcagctccaggtccgccagaagactcacaatctcaatcgcctcgaagctcagcgtaatgatctcaattctagagtgaggatgcttagagaagaactgcaactgctgcaggagcctggatcatatgttggagaagtggtgaaagttatggggaaatcaaaggttttagttaaggttcacccagaagggaagtatgttgttgatattgataagaacattgatatcacgaaaattacgccatcaaccagagttgctcttcgtaatgatagctatgtacttcacttgatcttgcccagcaaagtggatcctctggtcaaccttatgaaagttgaaaaagttcccgattctacatatgatatgattggtggtcttgaccagcaaatcaaagagataaaggaggtcattgagcttccaatcaaacatcctgaattatttgagagtcttggaattgctcaacccaagggagtcttgctttatggaccacctggtacgggaaaaacactgctggcaagggcagtggctcatcatactgactgtaccttcatcagggtttctggttccgagttagtccagaaatacattggtgaagggtctagaatggtcagagaactttttgttatggccagggaacatgctccgtcgatcatttttatggatgaaattgacagtattggttctactcgaatggaatctgggactggcaatggtgacagtgaagtgcagcggacaatgctggagcttctcaatcaactggatgggtttgaagcctctaacaagattaaggttttaatggctacaaatcggattgatattctggatcaagcactccttagacctggaagaattgaccggaagattgagttcccaaatcctaatgaagagtctcgttttgatatcttaaaaatacactcaagaaaaatgaacttgatgcgtgggattgatctgaagaagattgcagagaagatgaatggtgcatccggtgctgaactcaaggcagtgtgcacagaagcagggatgtttgctttgagggagaggagagtccatgtaacacaggaagattttgagatggcggtggcgaaggtcatgaagaaggagactgaaaagaacatgtctctgagaaaactatggaagtagtccattcttgttgttcgttatggtctctaaaccaagatacagagcataagtgtgttacccaaatgaacaagaaaatatgctactctcagcataacaggcaagccattggttgatgacaatgttgcatagattctcctaaatgggtgaaatacctgctttggatgtgggttagactctgacacttacaaattctggtgggagaattctagatttcctttt

SEQ ID NO: 4196 - DNA, 1541 bp, Trigonella foenum-graecum
ttaacgtgtccaacattctatacctacacgactcgctttacgcttatcaccatcgcagattcgcagggatcgtcgttctcgtctgaattgcggaaagtgtttgattgtggaaatttgatctgatctatggctactgtgggagttgaagtgaagcatgccgagggtgcaccagaggagcattgctctgctaaaccaaccaaacaaggagagggtctacgccagtactatactcagcacatccatgagctacagctccttctccgccaaaagactcataatctaaatcgtcttgaggcgcaacgtaacgagctcaattctagggtgaggatgcttcgggaagaactgcagcttcttcaggagcctggttcatacgttggtgaagtagtcaaagttatgggcaagaacaaagtgttggtcaaggtccatccggaagggaaatatgttgttgatattgataaaaatattgacattacaaagattaccccgtctactagagttgctcttcgcaatgacagctatgtgcttcatttagttctgccaagcaaagttgatccattggtcaatctgatgaaagttgagaaagttcctgattctacatatgacatgatcggtggtttagaccaacaaatcaaagaaataaaagaggtcattgagcttccaattaaacaccctgagctgtttgaaagtcttggaatagctcaaccaaagggtgtcttgctctatgggccacctggtacaggaaaaacattgttggctagggcagtggcacatcatactgattgtacattcatcagggtgtctggttctgaacttgttcagaaatacataggagaaggttctagaatggttagggaactttttgttatggccagggagcatgctccatcaattatcttcatggacgaaattgacagtattggatctgctcggatggaatctggaagtggcaatggtgatagtgaggtgcagcgtactatgctggaacttctcaaccagttggatggattcgaagcttccaataagatcaaggttttgatggccaccaataggattgatatcctggatcaagcactcctgagacctggacggattgacaggaagattgaatttccaaatcctaatgaagagtctcgccgggatatcttgaaaatccattcaagaagaatgaatttaatgcgtgggattgacttgaagaagattgctgagaagatgaatggagcatctggtgctgagctcaaggctgtgtgcactgaagctggaatgtttgctttgagagagaggagggtgcatgtgacacaggaggattttgagatggctgtggccaaggtcatgaaaaaggagacagagaaaaacatgtcattgaggaagttgtggaaatgatttgtattttatgtttatggtgcacattgtcatgtgcagattatcatagaacacgccttaccgcactttcaatttatggtcactctggtgttcttgtttatgttgactaagttatgtagcaaatcatgatcctttcgtgtttaattgcacgttttattact

SEQ ID NO: 4197 - DNA, 1590 bp, Centaurea maculosa
  misc_feature (777)..(777): n is a, c, g, or t
  misc_feature (782)..(782): n is a, c, g, or t
  misc_feature (791)..(791): n is a, c, g, or t
  misc_feature (1473)..(1473): n is a, c, g, or t
  misc_feature (1530)..(1530): n is a, c, g, or t
  misc_feature (1536)..(1537): n is a, c, g, or t
cggcgggggtacccgactactgaaatcaaaatcgccattgaaacacaaatcttcaaagctttcttccaaaatcctccatctgataaacaccaatggcgacagcagatatcgcgatgaaagcagctgattcaggcgagaaacacgaaagctgttcatcgagggcgaaacaaggcgatggtctgaggcagtattacctgcaacatatccacgatgctcagctccaggttcgccagaagacccataatctcaatcgtcttgaagctcagcgtaatgagcttaattctcgagtaaggatgcttaaggaagagttgcagctccttcaagagcctggatcttatgttggtgaagttgtcaaagtaatgggaaaatcaaaagttctagtgaaggtgcacccagagggtaaatatgtggttgatattgataaaagcattgatattaccaagattacaccgtcaaccagggttgcgcttcgcaatgatagctacgttcttcatttagttttgccaagcaaagtagatcctttggtgaaccttatgaaggttgagaaggttcctgattctacatatgacatgattggtggacttgaccagcaaattaaagagatcaaggaggttattgaacttccaatcaaacatccagagttatttgagagtctgggaattgctcaaccaaagggagttctattgtatgggccaccaggtactgggaagactttgttggccagagccgtggctcatcatactgattgtactttcattagggtctctggatctgaantggtncagaaatanatcggagaaggctccagaatggttagagaactgtttgttatggccagggaacatgccccatcgatcatatttatggatgaaatcgatagtattggatctgctcggatggagtctggaagtgggaatggtgacagtgaagttcaacggacaatgctggagcttcttaatcaactggatggttttgaagcatcaaacaagatcaaggttttgatggctacgaatcgtattgatatcctggaccaggctcttctcaggccaggaagaattgacaggaagattgaattcccaaatccgaatgaagactcaaggtttgacatcctgaaaattcactcaagaaagatgaacttaatgcgtggcatcgatctgaaaaagattgctgagaagatgaacggtgcttcaggtgcagaacttaaggcggtatgcacagaggcagggatgtttgctttgagagaaaggagagttcatgtgacacaggaagatttcgagatggctgtggccaaggttatgaagaaggaaaccgagaaaaacatgtctctacgcaagctttggaagtaaattatttatctttttatggaggagatttctaggtcctgaaattgtgtgttgaccacgatatcacccttatcggacttttctcagttaatgcaatgtaatttctataaacatctgtttactggatgangatgatgaaaaagaaaagttgaattttccagcttgaaagaaagaagactgtaatttnactttnnatcaaccgaaattgctactagtatagcatttggccatggaatttgaatgaaat

SEQ ID NO: 4198 - DNA, 1602 bp, Citrus clementina
ctgaaagaaactataatgtataggtatatataacgcgctgcggtcacattacagcgactaaaaacaaaccaaacccgaacgagacttgatccgaaagacaattagattcgaacaaatcgaactcgttcactcggaaagaatggccgctgtaggaatcgaaacgaagcagccggaatcggcggcgccagaggaggtgtgtgcggcgaaaggagcatcgaaacaaggagagggattgaggcaatactacctccaacacattcacgaactccagctccaagtccgtcaaaaaacccacaatctcaatcgcctcgaagcccagcgtaacgaactcaattctagagtgcggatgcttaaagaagaattacagcttcttcaggagcctggatcctatgtcggtgaagttgttaaagttatgggaaaaaataaggttcttgttaaggttcatcctgaggggaaatatgttgttgatattgataaaagtattgatataaccaagatcactccgtcaacaagagttgcacttcgtaatgacagctatgttcttcatttgatcctgccaagcaaagtagatcccctggtcaaccttatgaaggttgaaaaggtccctgattctacatatgacatgattggtggccttgatcagcaaattaaggagatcaaggaggtcattgagcttcctatcaaacatcccgaattgttcgagtctcttggaatagctcaacccaagggtgtattgctatatggaccacctggtactggcaaaacactgttggctagagctgtggctcatcatactgattgtactttcatcagggtttctggttctgaattagtccagaaatacattggagaaggctccagaatggttagagaactttttgttatggcaagggaacatgctccgtctatcatttttatggatgaaattgacagtattggatctgcccgaatggaatctggcagcggaaatggtgacagtgaggtgcagaggactatgctggagctgctcaaccagcttgatggatttgaagcatcaaacaaaattaaggttctcatggcgacaaatcgaattgatattctcgatcaagctcttctcaggccaggacgaattgacagaaagattgaatttccaaatcctaatgaagagtctcgtcttgatatcctaaaaattcattcaagaagaatgaatttaatgcgtggcattgatttgaagaagattgccgagaagatgaatggtgcatctggtgcggagcttaaggctgtgtgcacagaagccggtatgtttgctctaagagagagaaggatccatgtaacacaggaagattttgagatggcagtggccaaggtcatgaagaaagaaacagagaagaacatgtccttgcggaagttgtggaagtaatcatttccatgtgctgtgctgtgtatttgcttattttctgagcaagattcaagtagtccttaacggcactcactcgtgttctgggacatttgcacgataggcccttttagcctgactgttgtcttttcttgcgctctagcctcttatgataaacaaatttgcaatctattttatctaaatttaaattcgcatgcaattctgga

SEQ ID NO: 4199 - DNA, 1627 bp, Lotus japonicus
cctttgttttcctcatcgacctatctaaagagtaaagggcttcgtcgaacaaagttgaaatctcaagagatccaatcgaatcgaatcgactcatggctacagtcggagtagaattgaaccacgcggcggaggcggcaccggaggagaattgctccgccaaacctaccaaacagggcgagggtctccgtcactactactctctccacatccatgaacttcagctcctcctccgccagaaaacccataacctcaaccgtctcgaggctcagagaaacgagctcaattctcgagtgaggatgctccgagaagaactgcagcttctacaggagcctggctcatatgttggtgaagttgttaaagttatgggcaagaacaaagttttggtcaaggtccatccagaagggaaatatgttgttgatattgataagaacattgacattacaaagattacaccatcaactagggttgcgctccgcaatgacagttatgtgcttcatttagttctgcccagcaaagttgatccattggtcaatctgatgaaagttgagaaagttcctgattctacatatgatatgattggtggtttagaccagcaaatcaaagaaataaaagaggtcattgagctaccaattaaacatcctgagctgtttgaaagtcttggaatagcacaaccgaagggtgttctgctctatgggccacctggtacaggaaaaacattgttggctagggcagttgcacaccatactgattgtacattcatcagggtgtctggatctgaattagttcagaaatacattggagaaggttctagaatggtcagggaacttttcgttatggcaagggagcatgcaccatcaattatcttcatggacgaaattgacagtatcggatctgctcggatggagtctggaagtggcaatggtgatagtgaagtgcaacgtactatgttggaacttctcaaccagttggatggatttgaagcttcaaataagatcaaggttttgatggccacgaatcggattgatatcctggatcaagcactccttagacctggacgaattgatagaaagattgaatttccaaaccctaatgaagagtctcggcaggatattttgaaaatccattctagaagaatgaatttaatgcgcggtattgatttgaagaagattgctgagaagatgaatggcgcatctggcgcagagcttaaggctgtgtgcacagaagctggaatgtttgctctaagagagaggagggttcatgtgacgcaggaggactttgagatggccgtggcaaaggtcatgaaaaaggagacggagaaaaacatgtcattgcggaagttgtggaaatgatttgtatttcatgtttctttcttgtgcacattatcctgcaaagatgagaaaagaacacaccttagggttgtttcaatttacagtcacgctggctttcattttgcttatgttgaccaagttatgtaccaaatcatgtttctttcctgtttttttccttggctgtctcttcagaatgtactctagatatatagatcatattttatttgagagattatctatctggggaaagaagataactaaagtctacttgcttgggaagtttttttatttttattacc

SEQ ID NO: 4200 - DNA, 1683 bp, Pennisetum glaucum
cggccgccgcgaaggggaggagcggcggcggaggggagggcctgcgccagtactacctgcagcacatccacgacctgcagctccagatccggcagaagacccacaacctcaaccgcctcgaggcccagcgcaacgacctcaactcccgagttagaatgctcagggaagagctgcagttgcttcaagagcctggatcatatgttggtgaggtggtgaaggtcatgggaaaatcaaaggttctggtgaaggtgcacccggaaggcaaatatgtggtggatattgataagagcattgatattacgaagatcacaccttcaacaagagttgctcttcgaaatgatagctacatgctccatctggtcttgccaagcaaagttgatccattggtcaacctcatgaaggttgagaaggttcctgattctacttatgatatgattggaggccttgatcagcaaattaaagagattaaagaggtcatcgagcttccaatcaagcatccggagctatttgagagcctgggaattgcccagccaaagggtgttctcctttatggacctcctggcacaggaaagacattgctggcacgtgcagttgctcatcacactgactgcaccttcatcagggtttctggttctgagttggttcagaagtatattggtgagggctcccgtatggtccgtgaactctttgtcatggccagggaacatgcaccatccattatatttatggatgaaatagactctatcggatctgctagaatggagtctggaaccggcaacggtgatagtgaagtgcagcgcaccatgcttgagcttctgaaccagcttgatggttttgaagcatcaaacaaaattaaggttctgatggcaacaaacagaatagacatcttggatcaggcccttctgaggcctggacgcatagacaggaagatcgaattcccaaatcccaatgaggattctcgttttgatatcttgaagattcattcaagaaaaatgaacttgatgcgtggtattgatctgaaaaagatcgcggaaaagatgaatggggcctcaggagctgagctgaaggcggtctgcacagaagctggaatgtttgccctgcgcgagagaagggtacatgttacccaggaggactttgagatggcggtggccaaggtgatgaagaaagacacagagaagaacatgtccctgcgcaagctctggaagtgaggtccataccttgatgtctgccccccgtccttcacggcctcgccaaagctcgtgccgccttcatctcccaagcttttctccgcctcgccaaagtgccaaagcagtggaacggtgtaaaccgcatgcatgctccggaccggaccttcgccatgtgccctttttaagtttacaccgcgcatgcctatgtttaaaagtttgctttctggtaacagttgtagtatgttgttgaaaagtttcagatttgtcggatcagctagatacgagataatgcgttgctccctcgcgatgtaccacgttacaatgcctactacttggtttgcagtttgccggccccttagtaggtcagggtagcagatacagagtgaaaaaaaggaccattgattgggctgaacgccgtgaccataacaaaacacagaaaatcatcagattctgcaggccatgagtttactccccacacctatccaacaaccattca

SEQ ID NO: 4201 - DNA, 1523 bp, Mimulus guttatus
ggaaacttggggaagacgaaagccagttattctacggttgattcagaaacctacaccgaaggattgcagggtagaaatggcgaccgcggcggtagagaatcggcaggtggaggatccgacggcgcaccgccaacaaggcggcggcgccggtggcggggaagggctccggcaatattatcagcagaggatacaggatatgcagctgcttgcccgtcagaaaaaccacgatctccagcgcctcgaagcccagcgcaacaacctcaatgctcgagttagatcattgaaagaagagttgcagctcctccaagaacccggatcgtacgttggtgaagttgttaaagtcatgggaaaatcaaaggtcctcgtcaaggtacatcctgaagggaaatatgttgtcgacattgataagagcattgacatcaccaaaatcactccttcaacaagagttgctttacgtaacgatagctatgtgcttcacttggttctgccgagtaaagttgatccattggtcaatcttatgaaagtagaaaaagttccagactctacttatgatatgattggtggtcttgaccagcaaatcaaagagataaaggaggtgatcgagcttccaatcaaacatcctgaattgtttgagagtcttggaatagctcaacctaagggagtcttgctatatgggccacccgggacaggtaaaacactgcttgctagggcagtggcccaccacactgactgcacttttatccgagtctcgggttctgaattagttcagaagtacattggagaaggctctagaatggttagggaactttttgtgatggcaagagagcatgctccgtcgattatcttcatggatgaaattgatagcataggatctgcccgaatggaatctggaagtggcaatggggatagtgaagttcagcgaactatgctcgaacttctcaatcagcttgatggttttgaagcatctaataagataaaagtgctgatggctaccaataggatcgacattctcgatcaggctcttcttaggccaggaagaattgacaggaaaattgagttcccaaatcccaatgaagattctcgattcgacatcttgaagattcactcgaggagaatgaatttgatgcgagggattgatctgaagaagatagctgaaaaaatgaatggagcatctggtgcagaactcaaggcggtctgcacagaagcaggaatgtttgctctgagagaaaggagagttcatgtgactcaagaagatttcgagatggctgttgccaaagtcatgaagaaggaaaccgagaaaaatatgtcattgaggaaactttggaagtagacttatatatacacacatacatacgtatatctcgcaagttaaatctctgttttttaacgtgggcgggtttacgaacaatgtgtgcacccaggtagaacataaaatgttcccacgcttgagagcttgtatgttctcatgaactcgggcgggtttgttattttcgtgggaagaagctatcgagttctgttcattg

SEQ ID NO: 4202 - DNA, 1757 bp, Tropaeolum majus
aattcaaaaaccacagtttttcatctctctctctcagcttctacacaaagaaacctattcttctctttctttcgaaaactcgagcggtgtcttttccttcttttgatcagagtttgtacgaatggcggccgttggaatcgacactaaacagccgggattggccgcgcctgaggagacgtgcttggcgaaggcgggctcgaagcaaggtgagggtctcaggcagtactatcaacagcacatcctcgagcttcaccgcttggtccgacagaagactcacaacctcaatcgcctcgaagctcagcgcaatgagctcaattcacgagtgagaatgcttagagaagaactgcagctccttcaggagcctggctcatatgttggtgaagttgtcaaggttatggggaaaaacaaggttttagttaaggttcacccggaaggcaaatatgttgttgatattgataaaaatattgatattaccaagatcactccatcaacaagagttgcactccgtaatgatagttatgttctccatttagtcttgccaagtaaagtagaccccttggttaatcttatgaaagttgaaaaggttccagattctacctatgacatgattggtggtcttgaccagcaaattaaagagataaaggaggtcattgagctgccaataaaacatcctgaactgttcgagtctcttggaatagctcaaccaaagggcgtcctgctatatgggccacctggaacggggaagacgctgttggctagggctgttgcccatcacacggattgtacctttattagggtttcaggctctgagttagttcagaagtacatcggtgaaggttctaggatggttagggaacttttcgttatggcaagggagcatgcaccatctattattttcatggatgaaatcgatagtattggatctgctagaatggagtctggaagtgggaatggtgacagtgaagtgcagcggactatgcttgagcttctgaatcagcttgatgggtttgaagcatcaaacaagatcaaggttttgatggccacaaatcggattgatattttggatcaagctcttctgaggccaggaaggattgataggaagattgagtttccaaatcctaatgaagagtctcgtcaggacatcttaaaaatacactctagaagaatgaacttaatgcgtggaattgacttgaagaagattgcggagaagatgaatggtgcatcaggtgccgagctgaaggcggtatgcacagaagcaggtatgtttgccctaagggagaggagggtacatgtaacacaagaagactttgagatggcggtggcaaaggtgatgaaaaaggagacagaaaagaacatgtcgttgcggaagctttggaagtgatttctgttttcttgttttcatatttaagtagtgaaattcactagtttggttatcccctatctataatgcctataagtcgatcattttaatgaatgctaaaacttaagaacatttttatataggggcaaacttcatttttgtccatttactagatgtttgaagtttttgtgtccattttcttaaaaaaacttgtttttaaccaaaacccattattgaggacaataatacccttctgacattatgtcattaattttccagaagagagagaaaaatgggcatttggtcatttaaagctaaaaacaaactttaatgtttgatttttgggctaaaaacaagtttgttttaaaatgtggatataaaaactttaaagtatgga

SEQ ID NO: 4203 - DNA, 1633 bp, Tropaeolum majus
taatgaaatggaaacttaattcaaaaaccacagtttttcatctctctctctcagcttctacacaaagaaacctattcttctctttctttcgaaaactcgagcggtgtcttttccttcttttgatcagagtttgtacgaatggcggccgttggaatcgacactaaacagccgggattggccgcgcctgaggagacgtgcttggcgaaggcgggctcgaagcaaggtgagggtctcaggcagtactatcaacagcacatcctcgagcttcaccgcttggtccgacagaagactcacaacctcaatcgcctcgaagctcagcgcaatgagctcaattcacgagtgagaatgcttagagaagaactgcagctccttcaggagcctggctcatatgttggtgaagttgtcaaggttatggggaaaaacaaggttttagttaaggttcacccggaaggcaaatatgttgttgatattgataaaaatattgatattaccaagatcactccatcaacaagagttgcactccgtaatgatagttatgttctccatttagtcttgccaagtaaagtagaccccttggttaatcttatgaaagttgaaaaggttccagattctacctatgacatgattggtggtcttgaccagcaaattaaagagataaaggaggtcattgagctgccaataaaacatcctgaactgttcgagtctcttggaatagctcaaccaaagggcgtcctgctatatgggccacctggaacggggaagacgctgttggctagggctgttgcccatcacacggattgtacctttattagggtttcaggctctgagttagttcagaagtacatcggtgaaggttctaggatggttagggaacttttcgttatggcaagggagcatgcaccatctattattttcatggatgaaatcgatagtattggatctgctagaatggagtctggaagtgggaatggtgacagtgaagtgcagcggactatgcttgagcttctgaatcagcttgatgggtttgaagcatcaaacaagatcaaggttttgatggccacaaatcggattgatattttggatcaagctcttctgaggccaggaaggattgataggaagattgagtttccaaatcctaatgaagagtctcgtcaggacatcttaaaaatacactctagaagaatgaacttaatgcgtggaattgacttgaagaagattgcggagaagatgaatggtgcatcaggtgccgagctgaaggcggtatgcacagaagcaggtatgtttgccctaagggagaggagggtacatgtaacacaagaagactttgagatggcggtggcaaaggtgatgaaaaaggagacagaaaagaacatgtcgttgcggaagctttggaagtgatttctgttttcttgttttcatatttaagtagtgaaattcactagtttggttatcccctatctataatgcctataagtcgatcattttaatgaatgctaaaacttaagaacatttttatataggggcaaacttcatttttgtccatttactagatgtttgaagtttttgtgtccattttcttaaaaaaacttgtttttaaccaaaaaccattattgaggacaataatacccttcat

SEQ ID NO: 4204 - DNA, 1598 bp, Citrus sinensis
ctgaaagaaactataatgtatatatataacgcgctgcggtcacattacagcgactaaaaacaaaccaaacccgaacgagacttgatccgaaagacaattagattcgaacaaatcgaactcgttcactcggaaagaatggccgctgtaggaatcgaaacgaagcagccggaatcggcggcgccagaggaggtgtgtgcggcgaaaggagcatcgaaacaaggagagggattgaggcaatactacctccaacacattcacgaactccagctccaagtccgtcaaaaaacccacaatctcaatcgcctcgaagcccagcgtaacgaactcaattctagagtgcggatgcttaaagaagaattacagcttcttcaagagcctggatcctatgtcggtgaagttgttaaagttatgggaaaaaataaggttcttgttaaggttcatcctgaggggaaatatgttgttgatattgataaaagtattgatataaccaagatcactccgtcaacaagagttgcacttcgtaatgacagctatgttcttcatttgatcctgccaagcaaagtagatcccctggtcaaccttatgaaggttgaaaaggtccctgattctacatatgacatgattggtggccttgatcagcaaattaaggagatcaaggaggtcattgagcttcctatcaaacatcccgaattgttcgagtctcttggaatagctcaacccaagggtgtattgctatatggaccacctggtactggcaaaacactgttggctagagctgtggctcatcatactgattgtactttcatcagggtttctggttctgaattagtccagaaatacattggagaaggctccagaatggttagagaactttttgttatggcaagggaacatgctccgtctatcatttttatggatgaaattgacagtatcggatctgcccgaatggaatctggcagcggaaatggtgacagtgaggtgcagaggactatgctggagctgctcaaccagcttgatggatttgaagcatcaaacaaaattaaggttctcatggcgacaaatcgaattgatattctcgatcaagctcttctcaggccaggacgaattgacagaaagattgaatttccaaatcctaatgaagagtctcgtcttgatatcctaaaaattcattcaagaagaatgaatttaatgcgtggcattgatttgaagaagattgccgagaagatgaatggtgcatctggtgcggagcttaaggctgtgtgcacagaagccggtatgtttgctctaagagagagaaggatccatgtaacacaggaagattttgagatggcagtggccaaggtcatgaagaaagaaacagagaagaacatgtccttgcggaagttgtggaagtaatcatttccatgtgctgtgctgtgtatttgcttattttctgagcaagattcaagtagtccttaacggcactcactcgtgttctgggacatttgcacgataggcccttttagcctgactgttgtcttttcttgcgctctagcctcttatgataaacaaatttgcaatctattttatctaaatttaaattcgcatgcaattctgga

SEQ ID NO: 4205 - DNA, 1631 bp, Tropaeolum majus
cggccgggggttttttgagatataaaagactagcttgattttctctctcttattctcaacttgttcccaaagaaacggtttttccttttctttttactccaaatctcaaccggcgacatactctttggatcgcaatttcaaaatatggccacagtaggggtagagaaaaagcagccaggatcggtggtgccagatgagacctgcttagcgagagggggctccaagcaaggcgaaggtcttaggcagtactatctccaacacatactcgaactcaaccgcttagtccgtcagaagactcacaacctcaatcgcctcgaagcccagcgaaatgagctcaattctagagtgagaatgcttcgagaagaactgcagctgcttcaagagccaggctcatatgtcggtgaagttgtgaaggttatggggaaaaacaaggttttagttaaggttcatcctgaagggaaatatgttgtcgatattgataaaagtatcgatatcacaaagatcactccgtcaacaagggttgcacttcgtaacgacagttacgtactccatttggtcttgccaagcaaagtagatcccttggttaatcttatgaaagttgagaaagttccagattctacatatgacatgattggtggtcttgaccagcaaataaaagagataaaggaggtcattgagcttccaataaaacaccctgaactcttcgagtcacttggaatagctcaaccaaagggtgttctgctatatgggccacctggtacagggaagacactgttggccagggccgttgcccatcacactgattgtactttcatcagagtttctggttctgaattagttcagaagtacattggggaaggttctagaatggttagagaactttttgttatggcaagggagcatgcaccatctattatctttatggatgaaatcgatagtattggatctgctagaatggagtccggaagtgggaatggtgacagtgaagtgcagcgaactatgctggagcttctcaatcagcttgatggatttgaagcatcgaacaagatcaaggtcctgatggccactaatcgaattgatatcctcgatcaagctcttctcaggccaggaagaattgataggaaaattgaatttccaaatcctaatgaagagtctcgtcaagatattttaaaaatacactcgagaagaatgaatttaatgcgtggaattgatttgaagaagattgccgagaagatgaatggtgcatctggtgcagagctgaaggcggtgtgcacagaagcagggatgtttgctctaagggagagaagggtacatgtaacgcaggaagattttgagatggcagttgctaaggtgatgaagaaagagaccgaaaagaacatgtcattgaggaagctgtggaagtaattgatttatgaaagaggcatcaagtatttgtttttttttttttaaatcataccatgaaacagagggcatgtaagccatatatttaatgaacatttctgatgcgcgatcatctgagaatttcatggtttaggagattatgaattcgagtgggttgatgtcgaattgtgaattctgctggttcaatcatttgttacgttttgcttttatgtttaagaagaattaaatgt

SEQ ID NO: 4206 - DNA, 1651 bp, Tropaeolum majus
cggccgggggattctcaacttgttcccaagaacggtttttccttttctttttactccaatctcaaccggcgacatactctttggatcgcaatttcaaaatatggccacagtaggggtagagaaaaagcagccaggatcggtggtgccagatgagacctgcttagcgagagggggctccaagcaaggcgaaggtcttaggcagtactatctccaacacatactcgaactcaaccgcttagtccgtcagaagactcacaacctcaatcgcctcgaagcccagcgaaatgagctcaattctagagtgagaatgcttcgagaagaactgcagctgcttcaagagccaggctcatatgtcggtgaagttgtgaaggttatggggaaaaacaaggttttagttaaggttcatcctgaagggaaatatgttgtcgatattgataaaagtatcgatatcacaaagatcactccgtcaacaagggttgcacttcgtaacgacagttacgtactccatttggtcttgccaagcaaagtagatcccttggttaatcttatgaaagttgagaaagttccagattctacatatgacatgattggtggtcttgaccagcaaataaaagagataaaggaggtcattgagcttccaataaaacaccctgaactcttcgagtcacttggaatagctcaaccaaagggtgttctgctatatgggccacctggtacagggaagacactgttggccagggccgttgcccatcacactgattgtactttcatcagagtttctggttctgaattagttcagaagtacattggggaaggttctagaatggttagagaactttttgttatggcaagggagcatgcaccatctattatctttatggatgaaatcgatagtattggatctgctagaatggagtccggaagtgggaatggtgacagtgaagtgcagcgaactatgctggagcttctcaatcagcttgatggatttgaagcatcgaacaagatcaaggtcctgatggccactaatcgaattgatatcctcgatcaagctcttctcaggccaggaagaattgataggaaaattgaatttccaaatcctaatgaagagtctcgtcaagatattttaaaaatacactcgagaagaatgaatttaatgcgtggaattgatttgaagaagattgccgagaagatgaatggtgcatctggtgcagagctgaaggcggtgtgcacagaagcagggatgtttgctctaagggagagaagggtacatgtaacgcaggaagattttgagatggcagttgctaaggtgatgaagaaagagaccgaaaagaacatgtcattgaggaagctgtggaagtaattgatttatgaaagaggcatcaagtatttgttgttttttttttttaaatcataccatgaaacagagggcatgtaagccatatatttaatgaacatttctgatgcgcgatcatctgagaatttcatggtttaggagattatgaattcgagtgggttgatgtcgaattgtgaattctgctggttcaatcatttgttacgttttgcttttatgtttaagaagaattaaatgtatgtctttgtgtttaaaatgaaaaattatccactgccttgtatcagaggaaggaggttgact

SEQ ID NO: 4207 - DNA, 1496 bp, Arnica chamissonis
ctaccgaaatcaatctccatcgaaacaaaattctgcaagcttcagaactgtacatctgacagacacgaatggcgacagcggagatagcgatgaaaccagcggattcagggcagaaagacgagagctgttcatctaaacacatggctgcgaaaccgggtgaaggtctgaagcagtattaccagcagcatatccacgattctcaactccaggctcgccagaagactcataacctcaatcgtcttgaggctcagcgtaacgagctaaattctcgagtaaggatgcttaaagaagagttgcagctgcttcaagagcctggatcttatgttggtgaagttgtcaaagtaatgggaaaatcaaaagttctagtgaaggtgcacccagagggtaaatatgtggttgatattgataaaagcattgatattactaaaatcacaccgtcaaccagggttgctcttaggaatgatagctatgttcttcatttggttttgccaagcaaagttgatcctctggtgaaccttatgaaagttgaaaaggttcctgactctacgtatgacatgattggtggactagaccagcaaattaaagagattaaggaggttattgaacttccgatcaaacatccggagttatttgagagtctgggtattgctcaaccgaagggagttctattatatggaccaccaggtactgggaagacactgttggccagagcagtggcacatcatactgattgtactttcattagggtttctggttctgaattagtacagaaatatattggagaaggttccagaatggttagagagctttttgttatggccagggaacatgcaccatcaattatatttatggatgaaattgacagtattggatcggctcgaatggagtctggaagcgggaatggtgatagtgaagtccaaagaacaatgctggagcttcttaatcaactggatggattcgaagcatcaaacaagatcaaggttttgatggctacaaatcgtattgatatcctggatcaggcccttcttaggccaggaagaattgataggaaaatcgaattcccaaatcccaatgaagactcgaggtttgatattttgaaaattcattcgagaagaatgaacttaatgcgaggcattgatctgaaaaaaattgccgagaaaatgaatggcgcttcaggtgcagaacttaaggccgtttgcacagaggcagggatgtttgcattgagagaaaggcgagtccatgttacacaagaagattttgagatggcagttgccaaagtcatgaaaaaggaaaccgaaaaaaacatgtcgcttcgcaagctctggaaataaaacgtcgtcatggactctttcgtatttataaccaagctagacgtctatgtgcttgagaggaaggtggtggcatagaggatgggtgttcgtggtaatcattgagaattcactttatatgatttttgataatttgatctgttcttttattcgatgttcgttttatca

SEQ ID NO: 4208 - DNA, 1532 bp, Brassica napus
gcgaagaagaagatgtcttgttggataagccaagattccaaattataagagggcattatttgctaaatgctctcgtcgtccctgtgatccgatccatcgtcgtctccaatactagatctctgtctcgctcgcgtcgataatttgtgataaaaatggcggccgtaggaatcgagacgaggcgtcctgagggtgcgatggaggaaacctgcaacgtgaagggagcacaaggagaggggcttaagcagtactatctccagcacatcgacgagctccagcgacttctccgccagaaaactaacaacctcaatcgcctcgaagctcagaggaacgatctcaactctcgagtacgaatgctgagagaagagttgcagctgcttcaggaacctgggtcctatgtgggtgaagtggtcaaagttatgggaaaaacaaggtcttggttaaggttcatccagaggggaagtatgttgttgatattgacaaaagtatagacataactaaacttaccccatctacaagagttgctctccgtaatgatagctatgttctccaccttgtcctgccaagtaaagttgatcccctggttaaccttatgaaagttgagaaggttcctgactccacttatgacatgattggtggtcttgaccagcaaattaaggaaattaaggaggtcattgagcttccaatcaagcatcctgaattgtttgagtctcttggaatcgctcagccaaagggtgtgttgttatatggtccacccgggactggaaagacacttttggctcgggctgtggcacatcacaccgactgtaccttcatcagagtttctggttcggagctggtccagaaatacattggagaaggttctagaatggtgagagaactttttgtgatggcaagggagcatgcaccatcaattatctttatggatgagatcgatagtatcgggtctgctcgtatggagtctggaagtggaaacggtgacagtgaggttcagcggactatgcttgagcttctcaatcaacttgacggtttcgaagcatcaaacaaaatcaaggttctgatggcgacaaatcgtattgatattctggatcaagctctcctcaggccaggaaggattgataggaaaatcgaattccctaatcctaatgaagattcacgttgtgatatcttgaagattcactcgaggaagatgaacttgatgcgtggtattgatctgaaaaagattgcagagaagatgaatggtgcttcaggtgccgaactgaaggctgtgtgcacggaggcgggaatgtttgctctgagggagaggagagtacacgtgacacaggaagactttgagatggcagtggcgaaggttatgaagaaagacacagagaagaacatgtctctgcgtaagctctggaagtaggaatctctctgttctgttctctgttatttccaagaatcttttctgtttgttctttaagcgtttgaaaacaattttttttactgcctaaaacggtagtgtgtacttgaatgtacgcataccagttccgagt

SEQ ID NO: 4209 - DNA, 1409 bp, Brassica napus
ccgaaatcgaaatacccagagacaccaatcactcacgatatggcggccgtaggagtcgaggcgaggcgtcccgagacagcgatggaggaaacctgcaacgccaagggagcggtggcgaaacaaggggaagggcttaagcagtactacctccagcacatccacgagctccagcgccagctccgccagaaaaccaacaacctcaatcgccttgaagctcagaggaatgaactcaattctcgagtacgaatgctcagagaagagttgcagctgcttcaggagcctggttcctatgtgggcgaagtggttaaagtgatgggaaaaaacaaggtcttggttaaggttcatcccgaggggaagtatgttgttgatattgacaaaagtattgacataaataagatcacaccatcaacaagagttgctctccgtaatgatagctatgttcttcacctggttctgccaagtaaagtagatccgctggtcaaccttatgaaagttgagaaggttcctgactccacatatgacatgattggtggtcttgaccagcaaattaaggaaatcaaggaggtcattgagcttccaatcaagcaccctgaattgtttgagtctcttggaattgcgcagccaaagggtgtgttgttatatggtccacctggaactgggaaaacactattagctcgggctgtggcacatcacactgactgtacgttcatcagagtttctggttccgagctggtccagaaatacattggagaaggttctagaatggtcagagagctttttgtgatggcaagggagcatgcaccatcaatcatcttcatggatgaaatcgacagtatcgggtctgctcgtatggaatctggaagtggaaacggtgacagtgaggtgcaacggactatgcttgagcttctcaatcaacttgacggattcgaagcatcaaacaaaatcaaggttttgatggcaacaaatcgtattgatattctggatcaagctcttctcaggccaggaaggattgataggaaaattgaattccctaatccaaatgaagattcacgttttgatatcctgaagattcactcgaggaaaatgaatttgatgcgtggaattgatctgaaaaagattgcagagaagatgaatggtgcgtcgggtgctgaactgaaggctgtgtgcacggaggcaggcatgtttgctctgagggagaggagagtacacgtgacacaggaagactttgaaatggctgtggcgaaggtaatgaagaaagacacagagaagaacatgtctctgcgtaagctctggaagtagggagtctctttgttgtctagacctgagatatcagagcctttctttactgtttgttggttctttctgaaatcttatcgttttgttgtctaaacgttctgaaaaacaaagtt

SEQ ID NO: 4210 - DNA, 1489 bp, Brassica napus
cgatccatcgtcgtctccaatactagatctctctctctctctcgctcgcgtcgataatttgtgataaaaatggcggccgtaggaatcgagacgaggcgtcctgagggtgcgatggaggaaacctgccacgtcaagggagcggtggcgaaacaaggagaggggcttaagcagtactatctccagcacatcgacgagctccagcgacttctccgccacaaaactaacaacctcaatcgcctcgaagctcagaggaacgatctcaactctcgagtacgaatgctgagagaagagttgcagctgcttcaggaacctgggtcctatgtgggtgaagtggtcaaagttatgggaaaaaacaaggtcttggttaaggttcatccagaggggaagtatgttgttgatattgacaaaagtatagacataactaaacttaccccatctacaagagttgctctccgtaatgatagctatgttctccaccttgtcctgccaagtaaagttgatcccctggttaaccttatgaaagttgagaaggttcctgactccacttatgacatgattggtggtcttgaccagcaaattaaggaaattaaggaggtcattgagcttccaatcaagcatcctgaattgtttgagtctcttggaatcgctcagccaaagggtgtgctgttatatggtccacccgggactgggaagacacttttggctcgggctgtggcacatcacactgactgtacgttcatcagagtttctggttcggagctggtccagaaatacattggagaaggttctagaatggtcagagaactttttgtgatggcaagggagcatgcaccatcaatcatctttatggatgagatcgatagtattgggtctgctcgtatggaatctggaagtggaaacggtgacagtgaagttcagcgtactatgcttgagcttctcaatcaacttgacgggttcgaagcgtcaaacaaaatcaaggttttgatggcgacaaatcgtattgatattctggatcaagctcttctcaggccaggaaggattgataggaaaatcgaattccccaatcctaatgaagattcacgttgtgatatcttgaagatccactcgaggaagatgaacctgatgcgtggaattgatctgaaaaagattgcagagaagatgaatggtgcttcaggtgccgaactgaaggctgtgtgcacggaggcgggaatgtttgctctgagggagaggagagtacacgtgacacaggaagactttgagatggcagtggcgaaggttatgaagaaagacacagagaagaacatgtctctgcgtaagctctggaagtaggaatctctctattctgttttctgttatttccaagaatcttttctgtttcttctttaagcgtttgaaaacaattttttttactgcctaaacgctagtgtgtacttgaatgttacgcataccagttccgagttcatcgtctttcaaactaagagagattatt

SEQ ID NO: 4211 - DNA, 1566 bp, Cicer arietinum
ctcactacaagactcatttttactcccaaaaataataacaactcaaaaaacgcaaagctgaacaagagaaccgaaggaagacgcaaagtgcttcgtggtctgaatttgttgagagaaaagtgtgattgatcaaggaaagttgatctgatctatggctgctgtgggagtagaagtgaagcatgcagagggtgcaccagaggagcattgctctgccaaaccaaccaaacagggagagggtctccgccagtactatactcagcacatccatgagttacagctcctcctccgccaaaagacccataacctcaatcgtcttgaggctcaacgtaacgagctcaattctagggtgaggatgcttcgagaagaactgcagcttcttcaagagcccggttcatatgttggtgaagttgtcaaagttatgggcaagaacaaagtgttggtcaaggtacacccagaagggaaatatgttgttgatattgataaaaatattgacatcacgaagattactccatctactagagttgctcttcgcaatgacagttatgtgcttcatttagttctgccaagcaaagttgatccattggtcaatttgatgaaagttgagaaagttcctgattctacatatgacatgattggtggtttagaccaacaaatcaaagaaataaaagaggtcattgagcttccaattaaacatcccgagctgtttgaaagtcttggaatagctcagccaaagggtgtcttgctctatggaccacctggtacaggaaaaactttgttggctagggcagtggcacatcatactgattgtacattcatcagggtgtctggttctgaactggttcagaaatacattggagaaggttctagaatggtcagggaacttttcgttatggccagggaacatgcaccatcaattatcttcatggacgaaattgacagtattggatctgctcgaatggaatctggaagtggcaatggtgatagtgaggtgcagcgtactatgctggaacttcttaaccagttggatggatttgaagcttcaaataagatcaaggttttgatggccacaaatcggattgatatcctggatcaagctctcctgagacctggacgtattgaccggaagattgaatttcctaaccctaatgaagagtctcgccgggatatcttgaaaatccattcaagaagaatgaatttaatgcgtgggattgatttgaagaagattgctgagaagatgaatggagcatctggtgccgagcttaaggctgtgtgcacagaagctggaatgtttgctttgagggagaggagggtacatgtgacacaggaggattttgagatggctgtggccaaggtgatgaaaaaggagacagagaaaaacatgtcattgaggaagttgtggaaatgatttgtattttatgtttgtagcgcacattgtcatgtgcaaatgaacagaaactacacctgaccgccctttcggtttacacaatcaaaacttttcatcttgcttatgttgaacaacttatgtgccaagttatgattttttcctgtttaattgcactttgttac

SEQ ID NO: 4212 - DNA, 1492 bp, Flaveria ramosissima
tactcctgtcttgcggagaaagacatcgaataacatcatcaaatccctctgatacacgaaatctgttggtttacaaattatcagatctaataacagaacaagatcatctaatggcgactgtagatgtagccatgaagccatcagattcagtggaccgagatgataactgttcatcaaggcctacaacggcgaaatcaggtgaaggtctgaggcaatactacttgcaacacatccacgatgctcaactacaggttcgccagaagacccataatctcaatcgccttgaagctcagcgtaatgagcttaattctcgagtcaggatgcttaaggaagagttgcagctgcttcaagaaccaggatcttatgttggtgaagttgttaaagtaatgggaaagtccaaagtactagtcaaggtgcatccagagggtaaatatgtagttggtatagacaaaagcatcgatattactaagatcactccatcaaccagagtagcccttcgcaatgacagctatgttcttcatttggttttaccaagcaaagttgaccctctggtcaacctcatgaaagttgaaaaagtccctgattctacatatgacatgattggtggactagaccagcaaattaaagaaattaaagaggttattgaacttccaatcaaacatccagagttatttgagagtcttggaattgcacaaccaaagggagttttgttatatgggccacctggcacaggaaagaccttgttggcgagggcagtggctcatcatactgactgtactttcatcagggtttctggttctgaactagtacagaaatatattggagagggatctcgaatggtccgagaactttttgttatggctagggaacatgctccatctatcatattcatggatgaaatagatagtattggatccgctcgtatggaatctggaagtggaaatggtgacagtgaagtacaacgaactatgcttgagcttctcaatcagcttgatggatttgaagcatcaaacaaaatcaaggttctgatggctacaaaccgtattgatatcttggatcaggctcttctcagacctgggagaattgataggaaaattgaattcccaaatcccaatgaagattcacggttcgatattttgaaaattcattcaagaaagatgaacttaatgcgtggcattgatctgaagaagatagctgagaagatgaatggggcttcaggtgctgagcttaaggcggtttgtactgaagctggaatgtttgctttgagggaaaggagagtccatgtcacacaagaagattttgagatggcggttgccaaggttatgaagaaggaaaccgagaaaaacatgtctctgcgcaagctttggaagtaagcaaatgaaaactctagtaagccaacggcttttctacctagtactgtcttcaaggaccgtgttcaactatgagtactttgtttaaattaatttatcttttccatctaaacatattgata

SEQ ID NO: 4213 - DNA, 1497 bp, Lippia dulcis
aggcggtgtagtgtgtagactgtgagagactccacattcaaggattgtgataccttttttagcttggcaaagacgaaaacccaattattctccgatctgcttcacacatcgaatggcgacggcggcgataatcgctcggcaggccgatgaagcgaagcgccaacaccaacagggtgccgcttccggcggcggtgaagggctccggcagtattaccagcagactatacaggatttgcagctgttgtcccgtcagaaacatcacgatctccagcgtctcgaagctcagcgcaatgaccttaatgctcgagtgagatcattaaaggaagagttgcagcttcttcaggagcctggatcatatgtaggcgaagttgtcaaagttatgggaaaatcaaaggtcctcgttaaggttcatcctgagggcaagtatgtagttgacattgacaagagcatcgatatcactaagattacaccgtcaacaagggttgctctgcgtaatgatagctatgtgctccacttggtcctgcctagtaaagttgatccgttggtgaatctcatgaaagttgagaaagttccagattccacttatgacatgattggtggtcttgaccagcaaattaaagagataaaagaggtgattgagcttccaatcaagcacccagaattgtttgagagtctaggaatagcccaaccaaagggagtgttgctatatggtcctcctggaactggtaagacactgctggcaagggcagtggctcaccatactgactgcactttcatccgagtttcgggctccgagctagttcagaagtacattggtgaagggtctaggatggttagagaactcttcgccatggccagagagcatgctccatccatcatcttcatggatgaaattgatagcattggatctgctcgtatggaatctggaagtggaaatggggatagtgaggttcaacgaactatgctggagcttcttaatcaacttgatggctttgaagcctctaacaagataaaagtattgatggctaccaatagaattgacattctggaccaagctcttcttaggcctggaagaattgataggaagattgagttcccaaatcccaatgaagagtctcggtgggatatcttgaagattcattcaaggaaaatgaatttaatgcgagggattgatctaaagaagattgctgagaagatgaatggagcatctggtgcagaacttaaggctgtttgcactgaagccggaatgtttgctctgagagagagaagggttcacgttactcaggaggactttgagatggcagttgcgaaggtcatgaagaaggaaaccgagaagaacatgtcgttgaggaagctctggaagtagattaatgatagaatacgacacattcctgttgatctgagcctcgacgatttaccaaatttatgataaaccagcagactcagtttgattcgatcaccgaatttatgataagccatttctgttgcaaaaaagaa

SEQ ID NO: 4214 - DNA, 1502 bp, Helianthus annuus
aacagaacccaaatcgcctgacacacgaaacctatagggttacaaatcctccgatctaaacctgcaaaattgtgaaaatggcgagtgtcgatgtagccatgaaaccatcggattcagttgacagagatgagaactgttcgtcaagatcctcaacggcgaaatcaggtgaaggattaaggcagtattacctgcaacatattcacgatgctcagcttcaggttcgccagaagactcataatcttaatcggcttgaagcgcagcgtaacgagctcaattctcgagtcaggatgcttaaggaagagttgcagctgcttcaagagccaggatcttatgttggtgaagttgttaaagtaatggggaaatccaaagtactagtcaaggtgcacccagagggcaaatacgtagttgatatagacaaaagcattgatattactaagatcactccatcaaccagagtagcccttcgcaacgacagctatgttcttcatttggttttaccaagcaaagttgaccctctggtcaaccttatgaaagttgaaaaagtccctgattctacatacgacatgattggtgggctagaccagcaaattaaggagatcaaagaggttatcgaacttccaatcaaacatccagagttattcgagagtctcggaatcgctcaaccaaagggagttttgttatacgggccacctggcacagggaagaccttgttggcaagagcagtggctcatcatactgattgtactttcattagggtttctggttctgaactagtacagaaatacattggagaggggtctcgaatggtcagagaactttttgttatggcgagggaacatgctccatctatcatatttatggatgaaatagacagtattggatctgctcggatggaatctggaagtgggaatggtgatagtgaagtacaacgaactatgctcgagcttcttaatcagcttgacggttttgaagcgtcaaacaagattaaggttttgatggctacaaaccgtattgatatcctggatcaggctcttctcaggcccgggagaattgataggaaaattgaattcccaaatcccaatgaagattcacggtttgatattctgaaaattcattcaagaaagatgaatttaatgcgtggcattgatctgaagaagatagctgagaaaatgaatggggcttcaggggctgagcttaaggcggtttgtactgaagctggaatgtttgctttgagggagaggagagtccacgtgacccaggaagattttgagatggcagtcgccaaggttatgaagaaggaaactgagaaaaacatgtcgttgcgcaagctttggaagtaatcaagtagacgtgttttctttctagtactcttttcaaacgtttaaaccttgcatcctttatgatgtgccgattgtgttatttacttttatcgtttgcatccgaaacatactaatattatgttaaagcccaacttttaaagactcttggttgatattgattga

SEQ ID NO: 4215 - DNA, 1607 bp, Vinca minor
gaattcgatagaaccaaaacctataatctacaatcaaagatggcgacagcacaaatcgagactaaccggagagaatctgagagagaagagagctgttcagcaaagggttcaatggctaagcaaggccaaggtttaaggcaatactatacgcaacacatccatgatctccaactccaggttcgtcagaaaacacacaatcttaatcgcctcgaagctcaacgtaacgacctcaattccaaagtaagaatgctcaaggaagagttgcaattgctccaagagcctggatcttacgtgggtgaagttgtcaaagtaatggggaagtcgaaagtattggttaaagttcacccagaaggaaaatatgtcgtggatattgataaaagtattgatataaccaagatcaccacatccaccagggttgcacttcgcaatgacagctatgttcttcatttaattttgcccagcaaggttgatcctttagtcaacctcatgaaagttgaaaaagtacctgattctacttacgatatgatcggtggccttgatcagcaaattaaagagattaaggaggttattgagcttccaatcaaacaccctgaattatttgaaagtcttggaattgctcaacctaagggagttctgctttatgggcccccaggaactggaaaaacattgttggctagggcagtggcacatcacactgattgtacttttatcagggtctctggttctgaactagtgcagaaatatattggtgaaggttctcgaatggtgagggagctttttgttatggccagggagcacgcaccgtctatcatattcatggatgagatagatagtattggctctgctagaatggaatctggaagtggtaatggtgacagtgaagtgcagagaacaatgcttgagcttctgaaccaacttgatgggtttgaggcatcgaataagatcaaggtattgatggccacaaatcgcattgatattctcgatcaagctctccttaggccgggaaggattgataggaagatcgaatttccaaatcccaatgaagagtctcgctttgatatcttaaagattcattctagaaaaatgaatttaatgcgtgggattgatttaaaaaagattgcggagaagatgaatggtgcttcaggtgcagagttgaaggctgtgtgtacagaagctgggatgtttgccctgagggagcgaagagttcatgtgacacaggaagattttgaaatggctgttgccaaagtaatgaagaaggatacagagaagaatatgtctttgagaaagttgtggaagtaaatttatttgtatcctctctttcctaaactaatacacactagagactgatgttgtttctgcatggaagaatgatggtgggggttgatactaatctgcttctgttggaaaatcctttgggtatgattggattgagtctcagtctgagattcctcatcttaatctcagactagtctcaagcccaaccaattttttttttatatgtattagtgcttgatgtttcattctcatactcaattcaaagagagtataaaatttgagtctcaaatttaaaccagactcaatcttattaatctcagtttgtattaagt

SEQ ID NO: 4216 - DNA, 1665 bp, Citrullus lanatus
aaagcgcaagaaaccaggaacacccacctccatttcaggacattgtttgatattgatacgacgaaatctcatattccagtttgctgatcttgtattcaaatctagataatctagtaaaacaagttcaatttacttctcttccaatggcgacaatggaggtcgagacccagcaaccgacgtcggcgtcgttcgatacttgttcggcgaaacaggcgacgaaacaaggtgagggtctgaggcagtactatctgcaacatattcacgagctccagctccaggtccgtcaaaagacccataatctgaatcgtcttgaagctcagcggaacgagctcaattcgaaagtacgcatgctccgggaagagctgcagctgcttcaagagccaggatcttatgttggtgaagttgttaaagtcatgggaaagaacaaagttttagttaaggttcatccagaagggaaatatgttgttgatattgacaaaagtatcgatatcacaaaaattacaccttcaactcgagtagctctccgtaatgacagctatgttcttcatttagtcttgccaagcaaagtagatccacttgttaatcttatgaaagttgaaaaggttcctgattcaacttatgatatgattggtggtctcgaccagcaaataaaagaaataaaagaggttattgaactccccattaagcatcctgaactttttgagagtcttggaatagctcaaccgaagggtgtcttgctatatggaccacctggtacggggaagacactgttggctagagcagtggctcaccatacagattgtactttcatcagggtttctgggtctgagttggtccagaaatatattggagaaggttcaagaatggtcagagagcttttcgtcatggccagggagcatgcaccttctatcattttcatggatgaaattgatagtattgggtctgctagaatggaatctgggagtggtaatggtgatagtgaggtgcagcgtactatgttggaacttcttaaccaacttgatggatttgaagcatcaaataagatcaaggttttaatggccaccaataggattgatattctggatcaagctctcctaaggccaggacgaattgacaggaagattgaattcccaaatcctaacgaggattcccggtttgatatcttgaaaatacattcccggaaaatgaatttgatgcgtgggattgatttgaagaaaattgctgagaagatgaatggcgcatctggtgcagagctcaaggctgtgtgtacagaagcagggatgtttgctttgagggaaagaagggttcacgtgactcaggaagattttgagatggctgttgccaaggtgatgaagaaggaatcagagaagaacatgtcgttacgaaagctttggaagtagaattgtcttatgaagcggccaaggcatggcgtggcaaattccaaatattgcttttcttttgttgtcgaattcttcacctcccccgagctgtgcttaaagatttgttgaactcagtttatttatcttgaatgatgctttctagttgtaactttttttatcttcacatggatcttgtaacttaaagctctctcatgccacatttcatttaccatctcctccagatttattgacaagtttgatggtagttgtaggatttccatcttat

SEQ ID NO: 4217 - DNA, 1521 bp, Arabidopsis thaliana
aatttaggtgatatcatataatgcttcgcgtgagggtttctgagattctgatcgacgaaaactaatctctctcctttttcttctcatctccttactagagatctctgtcttcgataatttgtttcaatcactgagaaaatggcggccgtaggagtagattcgaggcgtcctgagacagcgatggaggaaacctgtaacgtgaaaggagcggcggcgaaacaaggggaagggcttaagcagtactatctccagcacatccatgagctccagcgccagcttcgacagaagactaataacctcaatcgccttgaagctcaaaggaatgaactcaattctcgagtgagaatgctcagagaagagttacagctccttcaagaacctgggtcctatgtgggagaagtggtaaaagttatgggaaagaacaaggtcttggttaaggttcatccagaggggaagtatgttgttgatattgacaaaagtatagacattacgaaaatcactccatcaacgagagttgctcttcgtaatgatagctatgttctccacctggttctgccaagtaaagtagatcccttggttaaccttatgaaagttgagaaggttccagactccacctatgacatgattggtggtcttgaccagcagattaaggaaataaaggaggtcattgagctgccaatcaagcatcctgaattgtttgagtctcttggaattgcgcagccaaagggtgtgttgttatacggtccacctggaactgggaagacactattggctcgggctgttgcacatcacactgactgtactttcataagagtttctggttccgagcttgtccagaaatacattggagaaggttctagaatggtcagagaactttttgtgatggcaagggagcatgcaccatcaatcatcttcatggatgaaatcgatagtattgggtctgctcgtatggaatctggaagtggaaatggtgacagtgaggtgcaacggaccatgctcgagcttctcaatcaacttgacggttttgaagcgtcaaacaaaatcaaggttttgatggctacaaatcgtattgatattctggatcaagctcttctcaggcctggaagaattgataggaaaattgaatttcctaatcctaatgaagagtcacgttttgacatcttgaagattcactcgaggaaaatgaatttgatgcgtggaatcgatctgaaaaagattgcagagaagatgaatggcgcttcaggtgctgagctgaaggctgtgtgcacggaggcgggaatgtttgctctgcgtgagaggagagtacacgtgacacaagaagactttgagatggcggtggccaaggtaatgaagaaagacacggagaagaacatgtctctgcgtaagctgtggaagtaggaatctctcatggaaagactttctttactttactgtttgttgtttgattctgaaaccttttttcggttgtctcatgaaaacattttagaacaaagtttttactatctagacacgagtttatct

SEQ ID NO: 4218 - DNA, 1339 bp, Brassica oleracea
  misc_feature (747)..(747): n is a, c, g, or t
tcgcgatctagaactagtcgtgatccgatccatcgtcgtctcaatactagatctctgtctcgctcgcgtcgataatttgtgataaaaatggcggccgtaggaatcgagacgaggcgtcctgagggtgcgatggaggaaacctgcaacgtgaagggagcacaaggagaggggcttaagcagtactatctccagcacatcgacgagctccagcgacttctccgccagaaaactaacaacctcaatcgcctcgaagctcagaggaacgatctcaactctcgagtacgaatgctgagagaagagttgcagctgcttcaggaacctgggtcctatgtgggtgaagtggtcaaagttatgggaaaaaacaaggtcttggttaaggttcatccagaggggaagtatgttgttgatattgacaaaagtatagacataactaaacttaccccatctacaagagttgccctccgtaatgatagctatgttctccaccttgtcctgccaagtaaagttgatcccctggttaaccttatgaaagttgagaaggttcctgactccacttatgacatgattggtggtcttgaccagcaaattaaggaaattaaggaggtcattgagcttccaatcaagcatcctgaattgtttgagtctcttggaatcgctcagccaaagggtgtgttgttatatggtccacccggaactgggaagacacttttggctcgggctgtggcacatcacactgactgtaccttnatcagagtttctggttcggagctggtccagaaatacattggagaaggttctagaatggtcagagaactttttgtgatggcaagggagcatgcaccatcaatcatctttatggatgagatcgatagtatcgggtctgctcgtatggaatctggaagtggaaacggtgacagtgaggttcagcggactatgcttgagcttctcaatcaacttgacggtttcgaagcatcaaacaaaatcaaggttctgatggcgacaaatcgtattgatattctggatcaagctctcctcaggccaggaaggattgataggaaaatcgaattccctaatcctaatgaagattcacgttgtgatatcttgaagattcactcgaggaagatgaacttgatgcgtggaattgatctgaaaaagattgcagagaagatgaatggtgcttcaggtgccgaactgaaggctgtgtgcacggaggcgggaatgtttgctctgagggagaggagagtacacgtgacacaggaagactttgagatggcagtggcgaaggttatgaagaaagacacagagaagaacatgtctctgcgtaagctctggaagtagg

SEQ ID NO: 4219 - DNA, 1402 bp, Brassica rapa
  misc_feature (1345)..(1345): n is a, c, g, or t
ataagccaagattccaaattataagagggcattatttgctaaatgctctcgtcgtccctgtgatccgatccatcgtcgtctccaatactagatctctctctctctctctcgctcgcgtcgataatttgtgataaaaatggcggccgtaggaatcgagacgaggcgtcctgagggtgcgatggaggaaacctgccacgtcaagggagcggtggcgaaacaaggagaggggcttaagcagtactatctccagcacatcgacgagctccagcgacttctccgccacaaaactaacaacctcaatcgcctcgaagctcagaggaacgatctcaactctcgagtacgaatgctgagagaagagttgcagctgcttcaggaacctgggtcctatgtgggtgaagtggtcaaagtgatgggaaaaaacaaggtcttggttaaggttcatccagaggggaagtatgttgttgatattgacaaaagtatagacataactaaacttaccccatctacaagagttgctctccgtaatgatagctatgttctccaccttgtcctgccaagtaaagttgatcccctggttaacctaatgaaagttgagaaggttcctgactccacttatgacatgattggtggtcttgaccagcaaattaaggaaattaaggaggtcattgagcttccaatcaagcatcctgaattgtttgagtctcttggaatcgctcagccaaagggtgtgttgctatatggtccacccggaactgggaagacacttttggctcgggctgtggcacatcacactgactgtaccttcatcagagtttctggttcggagctggtccagaaatacattggagaaggttctagaatggtcagagaactttttgtgatggcaagggagcatgcaccatcaatcatctttatggatgagatcgatagtattgggtctgctcgtatggaatctggaagtggaaacggtgacagtgaagttcagcgtactatgcttgagcttctcaatcaacttgacgggttcgaagcgtcaaacaaaatcaaggttttgatggcgacaaatcgtattgatattctggatcaagctcttctcaggccaggaaggattgataggaaaatcgaattccccaatcctaatgaagattcacgttgtgatatcttgaagatccactcgaggaaaatgaacctgatgcgtggaattgatctgaaaaagattgcagagaagatgaatggtgcttcaggtgccgaactgaaggctgtgtgcacggaggcgggaatgtttgctctgagggagaggagagtacacgtgacacaggaagactttgagatggcagtggcgaaggtnatgaagaaagacacagagaagaacatgtctctgcgtaagctctggaagtaggaatct

SEQ ID NO: 4220 - DNA, 1715 bp, Musa acuminata
gggggatgtatatgaagagagaggaaacgaaagcagagaagacgcgagagctgacgggcgtgtgcgatcggatctagatagatagatttcgcttgggtgaagccgggggcaggacgatggcaacggccgtggtggagaagaagcaaccgatggaagcggagggggagatgtgtgcgccgccgtagacccaggggaggcggaggcgaggggttgcggcagtactacctgcagcacatccatgacctccatctccagatccggcagaagaccaacaacctccagcgcctcgaggcccagcggaacgacctcaactctcgagtgcgagcgcttcgagaggagttgcagctacttcaagagcctggttcgtatgttggcgaggtggttaaggtgaaggggaaatcgaaggtcttagtcaaggtccatcccgaaggaaaatatgttgttgatattgataagagcattgatataacaaagttaacaccatcaaccagagttgctcttcggaatgatagttatgttcttcacctaattttgcctagcaaagtagatcctctagtcaatcttatgaaggtcgaaaaggtacctgattccacctatgacatgattggtggtcttgaacagcaaattaaggagataaaggaggttattgaacttccaattaagcatcctgagttgtttgaaagccttggaatagcacaaccaaagggagtcttgctttatgggcctcctggcacggggaaaactctattagcaagagccgttgctcatcatactgattgcacattcataagggtttctggttctgagttggttcagaaatacataggagaggggtctagaatggttcgggaactatttgttatggccagggaacatgctccttcaataatattcatggatgaaatagacagtattggatctgctagaatggagtctggtactggtaatggtgacagtgaagtgcaacgtactatgctggagcttctaaaccagcttgatggctttgaagcatcaaacaaaattaaagttctgatggccacaaatcggatagacatcctggaccaagcactcctcaggcctggacggattgacagaaaaaatgagttccctaatcccaaggaagagttccgcttggatattctaaagattcactcgaggaagatgaacttgatgcgtgggatagatcttaagaaaattgcagagaagatgaatggagcatctggagcagaactcaaggctgtgtgcacagaagcagggatgtttgctctcagggaaagaagagttcatgtgacacaagaagatttcgagatggccgttgctaaagtcatgaagaaagaaacagagaagaacatgtccctgcgaaaactatggaaatagattctttcccattcgtcacttggttgttactgaaaggatataaacgacagtaaccatttaactctgtgtgttggcatttaactctagaactttcatgatcaagtgtgaggcactgaagtcttatagtgttcccatggatgtaagattctgcccttacttccagaacgattttttttgtgtgctatggcggttggcaattctgaatctgattgtttaaagtagcaaaaggtggtagtagtggtctactgatatcggattcccgggtcaggcaagctctcaggacatggttaatctaatgttttaatcttcatgcctatttagtgatttggctgtggaat

SEQ ID NO: 4221 - DNA, 1426 bp, Brassica napus
atggcggccgtaggagtcgaggcgaggcgtcccgagacagcgatggaggaaacctgcaacgccaagggagcggtggcgaaacaaggggaagggcttaagcagtactacctccagcacatccacgagctccagcgcctgctccgccagaaaaccaacaacctcaatcgccttgaagctcagaggaatgaactcaattctcgagtacgaatgctcagagaagagttgcagctgcttcaggaacctggttcctatgtgggcgaagtggttaaagtgatgggaaaaaacaaggtcttggttaaggttcatcctgaggggaagtatgttgttgatattgacaaaagtattgacataaataagatcacaccatcgacaagagttgctcttcgtaatgatagctatgttcttcacctggttcttccgagtaaagtagatccgctggtcaaccttatgaaagttgagaaggttcctgactccacatatgacatgattggtggtcttgaccagcaaattaaggaaatcaaggaggtcattgagcttccaatcaagcatcctgaattgtttgagtcgcttggaattgcgcagccaaagggtgtgttgttatatggtccacctggaactgggaagacactattagctcgggctgtggcacatcacactgactgtacgttcatcagagtttctggttccgagctggtccaaaaatacattggagaaggttctagaatggtcagagagctttttgtgatggcaagggagcatgcaccatcaatcatcttcatggatgaaatcgacagtatcgggtctgctcgtatggaatctggaagtggaaacggtgacagtgaggtgcaacggactatgcttgagcttctcaatcaacttgacggattcgaagcatcaaacaaaatcaaggttttgatggcaacaaatcgtattgatattctggatcaagctcttctcaggccaggaaggattgataggaaaattgaattccctaatccaaatgaagattcacgttttgatatcctgaagattcactcgaggaaaatgaatttgatgcgtggaattgatctgaaaaagattgcagagaagatgaatggtgcgtcgggtgctgaactgaaggctgtgtgcacggaggcaggcatgtttgctctgagggagaggagagtacacgtgacacaggaagactttgaaatggcggtggcgaaggtaatgaagaaagacacagagaagaacatgtctctgcgtaagctctggaagtagggtagtctcttcgttgtctagacctgatatatcagcctttctttactgtttgttggttgtttctgaaatcttatcgttttgttgtctaaacgttctgaaaaacaaagttgtttacaaacactagtttatttttcaaatggtctcaagacatatcagtttcgatttt

SEQ ID NO: 4222 - DNA, 1497 bp, Brassica napus
atcgaaataccgagagacacgaatcactcacgatatggcggccgtaggagtcgaggcgaggcgtcccgagacagcgatggaggaaacctgcaacgccaagggagcggtggcgaaacaaggggaagggcttaagcagtactacctccagcacatccacgagctccagcgcctgctccgccagaaaaccaacaacctcaatcgccttgaagctcagagaaacgaactcaattctcgagtacgaatgctcagagaagagttgcagctgcttcaggaacctggttcctatgtgggcgaagtggttaaagtgatggggaaaaacaaggtcttggttaaggttcatcctgaggggaagtatgttgttgatattgacaaaagtattgacataaataagatcacaccatcgacaagagttgctctccgtaatgatagctatgttcttcacctggttcttcccagtaaagtagatccgctggtcaaccttatgaaagttgagaaggttcctgactccacatatgacatgattggtggtcttgaccagcaaattaaggaaatcaaggaggtcattgagcttccaatcaagcatcctgaattgtttgagtctcttggaattgcgcagccaaagggtgtgttgttatatggtccacctggaactggcaagacactattagctcgggctgtggcacatcacactgactgtacgttcatcagagtttctggttccgagctggtccagaaatacattggagaaggttctagaatggtcagagagctttttgtgatggcaagggagcatgcaccatcaatcatcttcatggatgaaatcgacagtatcgggtctgctcgtatggaatctggaagtggaaacggtgacagtgaggtgcaacggactatgcttgagctgctcaatcaacttgacggattcgaagcatcaaacaaaatcaaggttttgatggcaacaaatcgtattgatattctggatcaagctcttctcaggccaggaaggattgataggaaaattgaattccccaatccaaatgaagattcacgttttgatatcctgaagattcactcgaggaaaatgaacttgatgcgtggaattgatctgaaaaagattgcagagaagatgaatggtgcgtcgggtgctgaactgaaggctgtgtgcacggaggcaggcatgtttgctctgagggagaggagagtacacgtgacacaggaagactttgaaatggcggtggcgaaggtaatgaagaaagacacagagaagaacatgtctctgcgtaagctctggaagtagggtagtctcttcgttgtctagacctgatatatcagcctttctttactgtttgttggttgtttctgaaatcttatcgttttgttgtctaaacgttctgaaaaacaaagttgtttacaaacactagtttatttttcaaatggtctcaagacatatcagtttcgatttttacaaacaagttatttctttacaatatagaagttttc

SEQ ID NO: 4223 - DNA, 1650 bp, Gossypium hirsutum
aggccaaatcaaaacttgttgtcaaagaaaaatccccttgtaccaagtatctgagtgccattgtagtttccaaaatcaagaacctagaagcaaactcaaatggcgacggtcgctatcgagaggaagcaacaggcatctgcggaagagatgtgcaccgccaagagcggtgccaagcaaggggagggcctccgacaatactatcttcaacacatccacgagctccagctcaatctccgccaaaaaacccacaatttgaaccgactcgaagcccaacgcaacgagctcaattctcgagttagaatgcttagagaggaactgcagctgcttcaggagcctggatcctatgttggtgaggttgtgaaagttatgggtaaaaacaaggttttagtcaaggtccatccagaaggaaaatatgttgtcgatattgacaagaatattgatatcacaaaaatcacaccatcaacaagagttgctctgcgtaatgacagctatgttctccatctgatcttacctagcaaagtagaccctttggttaaccttatgaaagttgaaaaagttccagattctacgttcgatatgattggtggtcttgatcaacaaattaaagagataaaagaggttatcgaacttccaattaaacatcccgaattgtttgaaagccttggaatagcccagccaaagggtgtcctgctttatggaccacctggtacaggaaaaacactattggctagagctgtggcccatcatactgattgtacctttatcagggtttctggttctgaattagttcagaaatatatcggggagggttctcgaatggttagagaacttttcgttatggccagagagcatgctccatcaattatatttatggatgagatagacagtattggatctgctcgaatggaatctggaagtggaaatggtgatagcgaggtgcagcgtaccatgttggagcttctcaaccagcttgatggatttgaagcatctaacaagatcaaggttctgatggccacaaaccggatagatatcttggatcaagctcttcttaggccaggacggattgacaggaagattgaatttccaaatcccaatgaggagtctcgactggacatcttaaaaatacattctagaagaatgaacttgatgcgagggattgatctaaagaagattgcagagaagatgaatggtgcttctggtgcagagcttaaggcggtatgcacagaagcagggatgtttgcattgagggaaaggagagtccatgtaacacaagaagattttgagatggcagtggcgaaggtgatgaaaaaggagaccgagaaaaacatgtccttacggaagctttggaagtgattacatttttttgttttggggaaagatggaacatgtgtaaacctcatcccaatactcaaaaaacaatgtatcgactatttagtacacaatttgtcgttctgcttggtaccatgcatctgctttcttgacaaggctgtctttcagagttgctaggagaggattattattattatttttaaatgaacaacttggtttgacttgcagagttgtggataatacatacagcgcttggtttacaatggaggcaggcagctgactccgttaaagtagtaacataagattctatagttgtgttct

SEQ ID NO: 4224 - DNA, 1661 bp, Gossypium hirsutum
attccaaatcaaaacttgttgtcaaagaaaaatccccttgtaccaagtatctgagtgccattgtagtttccaaaatcaagaacctagaagcaaactcaaatggcgacggtcgctatcgagaggaagcaacaggcatctgcggaagagatgtgcaccgccaagagcggtgccaagcaaggggagggcctccgacaatactatcttcaacacatccacgagctccagctcaatctccgccaaaaaacccacaatttgaaccgactcgaagcccaacgcaacgagctcaattctcgagttagaatgcttagagaggaactgcagctgcttcaggagcctggatcctatgttggtgaggttgtgaaagttatgggtaaaaacaaggttttagtcaaggtccatccagaaggaaaatatgttgtcgatattgacaagaatattgatatcacaaaaatcacaccatcaacaagagttgctctgcgtaatgacagctatgttctccatctgatcttacctagcaaagtagaccctttggttaaccttatgaaagttgaaaaagttccagattctacgttcgatatgattggtggtcttgatcaacaaattaaagagataaaagaggttatcgaacttccaattaaacatcccgaattgtttgaaagccttggaatagcccagccaaagggtgtcctgctttatggaccacctggtacaggaaaaacactattggctagagctgtggcccatcatactgattgtacctttatcagggtttctggttctgaattagttcagaaatatatcggggagggttctcgaatggttagagaacttttcgttatggccagagagcatgctccatcaattatatttatggatgagatagacagtattggatctgctcgaatggaatctggaagtggaaatggtgatagcgaggtgcagcgtaccatgttggagcttctcaaccagcttgatggatttgaagcatctaacaagatcaaggttctgatggccacaaaccggatagatatcttggatcaagctcttcttaggccaggacggattgacaggaagattgaatttccaaatcccaatgaggagtctcgactggacatcttaaaaatacattctagaagaatgaacttgatgcgagggattgatctaaagaagattgcagagaagatgaatggtgcttctggtgcagagcttaaggcggtatgcacagaagcagggatgtttgcattgagggaaaggagagtccatgtaacacaagaagattttgagatggcagtggcgaaggtgatgaaaaaggagaccgagaaaaacatgtccttacggaagctttggaagtgattacatttttttgttttggggaaagatggaacatgtgtaaacctcatcccaatactcaaaaaacaatgtatcgactatttagtacacaatttgtcgttctgcttggtaccatgcatctgctttcttgacaaggctgtctttcagagttgctaggagaggattattattattatttttaaatgaacaacttggtttgacttgcagagttgtggataatacatacagcgcttggtttacaatggaggcaggcagctgactccgttaaagtagtaacataagattctatagttgtgttctaaaaaaaaaaa

SEQ ID NO: 4225 - DNA, 1625 bp, Medicago truncatula
atagtatctcctttaacttgtcgcataccccaattcgattctaccaaaatcaaataccctcacaacatcttcaacttcaccatcgcgtccgaagaaggaggatttatcgtactgaatttataaagtatagttgatcggatctgatctatggctgccgtcggagtagaagtgaagcatgccgagggtgcaccggaggagcattgctctgcgaaaccaaccaaacaaggcgagggtctccgtcaatactatactcagcacatccatgagcttcagctccttcaacgtcaaaagactcataatcttaaccgtctcgaggcgcaacgtaacgagctcaattctagggtgaggatgcttcgggaagaactgcagcttcttcaggagcctggttcatatgttggtgaagtcgttaaagtgatgggcaagaacaaagtcttggtcaaggtccatccagaagggaaatatgttgttgatattgataaaaatattgacatcacaaagattactccatctactagagttgctcttcgcaacgacagttatgtgcttcatttagttcttcccagcaaagttgatccattggttaatctgatgaaagttgagaaagttcctgattctacatatgacatgattggtggtttagaccaacaaatcaaagaaataaaagaggtcattgagcttccaattaaacatcctgagttgttcgaaagtcttggaatagctcaaccaaagggtgtcttgctttatgggccacctggtacaggaaaaacattgttggctagggcagtagcacatcatactgattgtacattcatcagggtgtctggttctgaacttgttcagaaatacatcggagaaggttctagaatggttagggaactttttgttatggccagggagcatgccccatcaattatcttcatggacgaaattgacagtattggatctgctcgtatggaatctggaagtggcaatggtgatagtgaagtgcagcgtactatgctggaacttctcaaccagttggatggattcgaagcttccaataagatcaaggttttgatggccaccaatcggattgatatcctggatcaagcacttctgagacctggacggattgacaggaaaattgaatttccaaatcctaatgaagagtctcgccgagatatcttgaaaatccattcaagaagaatgaatttaatgcgtggtattgacttgaagaagattgctgagaagatgaatggagcatctggtgctgagcttaaggctgtgtgcactgaagctggaatgtttgctttgagagagaggagggtacatgtgacacaggaggattttgagatggctgtggccaaggtgatgaagaaggagactgagaaaaacatgtcattgaggaagttgtggaagtgatttgtattttatgtttctggtgcacattgtcatgtgcagattataagagaacacaccttactgcactttcagtttatggccactctggtgttcttgcgtattttgactaagttattgtgtagcaaatcatgatccttttgtgttcagttgcatcttttattactcttcagtttttgatttgtatgattttaattgattaaatttttaatgcaaaatttagagtt

SEQ ID NO: 4226 - DNA, 1653 bp, Medicago truncatula
cggccggggaaaaattaccgacatatagtatctcctttaacttgtcgcataccccaattcgattctaccaaaatcaaataccctcacaacatcttcaacttcaccatcgcgtccgaagaaggaggatttatcgtactgaatttataaagtatagttgatcggatctgatctatggctgccgtcggagtagaagtgaagcatgccgagggtgcaccggaggagcattgctctgcgaaaccaaccaaacaaggcgagggtctccgtcaatactatactcagcacatccatgagcttcagctccttcaacgtcaaaagactcataatcttaaccgtctcgaggcgcaacgtaacgagctcaattctagggtgaggatgcttcgggaagaactgcagcttcttcaggagcctggttcatatgttggtgaagtcgttaaagtgatgggcaagaacaaagtcttggtcaaggtccatccagaagggaaatatgttgttgatattgataaaaatattgacatcacaaagattactccatctactagagttgctcttcgcaacgacagttatgtgcttcatttagttcttcccagcaaagttgatccattggttaatctgatgaaagttgagaaagttcctgattctacatatgacatgattggtggtttagaccaacaaatcaaagaaataaaagaggtcattgagcttccaattaaacatcctgagttgttcgaaagtcttggaatagctcaaccaaagggtgtcttgctttatgggccacctggtacaggaaaaacattgttggctagggcagtagcacatcatactgattgtacattcatcagggtgtctggttctgaacttgttcagaaatacatcggagaaggttctagaatggttagggaactttttgttatggccagggagcatgccccatcaattatcttcatggacgaaattgacagtattggatctgctcgtatggaatctggaagtggcaatggtgatagtgaagtgcagcgtactatgctggaacttctcaaccagttggatggattcgaagcttccaataagatcaaggttttgatggccaccaatcggattgatatcctggatcaagcacttctgagacctggacggattgacaggaaaattgaatttccaaatcctaatgaagagtctcgccgagatatcttgaaaatccattcaagaagaatgaatttaatgcgtggtattgacttgaagaagattgctgagaagatgaatggagcatctggtgctgagcttaaggctgtgtgcactgaagctggaatgtttgctttgagagagaggagggtacatgtgacacaggaggattttgagatggctgtggccaaggtgatgaagaaggagactgagaaaaacatgtcattgaggaagttgtggaagtgatttgtattttatgtttctggtgcacattgtcatgtgcagattataagagaacacaccttactgcactttcagtttatggccactctggtgttcttgcgtattttgactaagttattgtgtagcaaatcatgatccttttgtgttcagttgcatcttttattactcttcagtttttgatttgtatgattttaattgattaaatttttaatgcaaaatttagagtttacg

SEQ ID NO: 4227 - DNA, 1793 bp, Cucumis melo
aaagcgcaagaaaccaggcacacccacctccatttacaacattcatcttcttcgctcgacaaagtctcattttccagtttggttatcttttgttcaaatctagatcgtccagttaaaggagttcgatttttctaggtctttccaatggcgacaatggaggtcgagacccagaaagtggcgtcggcgtcgttagatgcttgctcggcgaaacaggcgacgaaacaaggtgagggtctgaggcagtactatctccaacatattcacgagctccagctccaggtccgtcaaaagacccataatctaaatcgtcttgaagctcagcgtaacgagctgaattcgaaagtacgcatgcttcgggaagagctccagctacttcaagagccaggatcttatgttggtgaagttgttaaagtcatgggaaagaacaaagttttagttaaggttcatccagaagggaaatatgttgttgatattgacaaaagtatcgatatcacaaaaatcacaccctcaacccgagtggctctccgtaatgacagctacgttcttcatttagtcttgccaagcaaagtggatccacttgttaatcttatgaaagttgaaaaggttcctgattcaacttatgatatgattggtggtctagaccaacaaataaaagaaataaaagaggttattgaactccccattaagcatcctgaactttttgagagtcttggaatagctcaaccaaagggtgtcttgctgtatgggccacctggtactgggaaaacactgttggctagagcagtggctcaccatacagattgtactttcatcagggtttctgggtctgagttggtccagaaatatattggagaaggttctagaatggtcagagagcttttcgtcatggctagggagcatgcaccttctattattttcatggatgaaatcgatagtattgggtctgctagaatggaatctgggagtggtaatggtgatagtgaggtgcagcgtactatgttggaacttcttaaccagcttgatggatttgaagcatcaaataagatcaaggtcttgatggccaccaataggattgatattctggatcaagctctcctaaggccaggacgaattgacaggaagattgaatttccaaatcctaacgaggattcccggtttgatatcttgaaaatacattctcgtaaaatgaatttgatgcgtgggattgatctgaagaaaattgctgagaagatgaatggtgcatctggtgcagaactcaaggccgtatgtacagaagcggggatgtttgctttgagggaaagaagggttcacgtgactcaggaagattttgagatggctgttgccaaggtgatgaagaaggaatcagagaagaacatgtcgttacgaaagctatggaagtagaactatcataagaagcagccaaggcgtggcaaattctgaatagtgcttacctttttattcttgaattcttcacctcatctggctgtgcctagagatttgtcgaacttggtttatgtaccttgaatgatgttttatagtcgttcactcatttattttcacctggatcttgtaacttaaaatccctctcattgccacatttctttgaccatctccttttccagatgtattgacaagttgatggaagctggtaagaattaaagaattacccaattgaaaattatttactttgttcatattattggagagagaaagaggtgatactctcaagggggaactgatgcaaagaaatgttcaacatcactgttaatatatttaaatcgtggagatgtaac

SEQ ID NO: 4228 - DNA, 1669 bp, Cucumis melo
gaaacacttcaggaacaagcatcttcaattttcgatggcgacgatggagttagacaccaagctaccggaggccataaatgaagaggcgtgctccgccaaaccggcgacaaagcacggcgaaggtcttaggcactattatcttcaacacattcaggacctccagcttcaactccgcctcaaaactcataatctcaatcgtcttgaagctcagcgaaacgagctcaactctagagtgaggttgcttcgtgaagaacttcagctgcttcaagaacctggatcttatgttggcgaagtggtcaaagtcatgggaaagaataaggttttagtgaaggtgcatccagaagggaaatatgttgtagatatagataaaagcattgatatcacaaaaatcaccccatcaactagggttgctcttcgaaatgacagttatgttcttcatttagttctgccaagcaaagtagatccattagtgaatcttatgaaagttgaaaaggtccctgattctacttatgacatgattggtggtcttgatcagcaaatcaaggagataaaagaggtcattgagcttccaatcaagcatccagagttattcgaaagtcttggaatagctcaaccaaagggtgtcttgctatatgggcctcctggtactgggaaaacactgttggctcgtgcagtagcccatcacactgattgtactttcattagggtttctggttctgagttggtgcagaaatatattggagagggttctaggatggttagagaacttttgtgatggccagggaacatgctccgtctatcattttcatggatgaaattgatagtattgggtcagctcgtatggaatctgggtctggtaatagtgatagtgaggtgcagagaactatgctggaacttcttaaccaactggatggatttgaagcgtctaacaagatcaaggttctgatggccacaaatcggattgatattcttgatcaggctcttctaagacctggacgaattgatagaaaaatagagttcccaaatcctaatgaggagtctcgttttgatatcttgaaaatacattcgagaaaaatgaatttaatgcgggggatcgacttgaaaaagattgctgagaagatgaatggtgcatccggtgctgaacttaaggctgtctgcacagaagctggaatgtttgctctaagagaaagaagggttcatgtgacacaagaagatttcgagatggcagttgcaaaggttatgaagaaagacacagataagaacatgtcgttgcgaaagctctggaagtaagtagactgaagtagtagttttaccgtttggtcacacactaaaactttcaaaccaagacgacagtgaaggcagcggcacagttctccacaaccaacctgttttgggaattaaatgaggctgttgggtgtgagaccagttcaaagcactctccacttcaatgtaagcttcttctctaagtccttattacactttaaaacacgtcaatgcccaattcccactttgaaaagtaaatactttggaggaccctcatgagctgccgtatatctcaatttgtggtacccgttgttctgaaggacattcttgctttcttgtcgatattactttatctttccaggtcttctgggtgaaagatggcaacatcttttttttttttttcccc

SEQ ID NO: 4229 - DNA, 1798 bp, Populus trichocarpa
gtgaaaacaaacctttaaaccaaaccgaaccccatcaatcgcgatggcaacagtaggagtggagaggaggcaacagcagcagcaaacagaatcaacaatgacgatgacggcggaggagagctgcttggcgaaaacgggggcggcgaagcaaggagagggattaaagcagtattacatccaacacatccatgagcttctgctacatgtccgtcaaaaaacccacaatctcaatcgcctagaagctcaacgcaatgacattaattccagagtgaggatgcttagagaagagttgcagctacttcaagaacctgggtcatatgttggtgaagttgtcaaagtaatggggaagaacaaggtgttggttaaggttcatccagaggggaagtatgttgttgatattgataaaagtattgatatcacgaagatcactccatcaacaagggttgcccttcgcaacgacagctatgttcttcacttgatcttgcctagcaaagtggatcctctggtcaacctcatgaaggttgaaaaagttccagattctacctatgacatgataggtggtcttgaccaacaaattaaagagataaaggaggtcattgaacttccaattaaacaccctgaattgtttgagagtcttggaatcgctcaaccaaagggtgttctcctctatgggcctcctggcactggaaaaactctactggctagggcagtggctcaccacactgactgtactttcatcagggtttctggttctgaattagttcagaaatacattggagaaggctctagaatggtcagagagctctttgttatggcaagagagcatgctccatcaatcattttcatggatgaaattgacagtatcggatctgctcgaatggaatctgggagcggcaatggtgacagtgaggtgcagcgaactatgctggagcttctaaatcagctggatggatttgaagcatcaaacaagataaaggttttgatggctacaaatcggattgatattctggatcaagctctccttcggccaggacgaattgacaggaagattgaatttccaaatcccaacgaagactcacgttgtgatatcttgaaaatccattcaagaaggatgaatttaatgcgtgggattgatttgaagaagatagctgggaagatgaatggtgcttctggtgcagagctcaaggcggtgtgcacagaggctggaatgtttgctctaagagagaggagggtccatgttacacaagaagattttgagatggcagtagcaaaggtcatgaagaaggagacagagaagaacatgtcattgcggaagctctggaagtagactgtaacttgatatctgttctttcttttttcagtctatgaaaatgtcaagaacaagaatcaaataggacagcactttatgcatatggaatatttgcccactggatttcctgcctgggccttggcagtaccaagcgtgtgcttttttcccccacaagaattgttcgtggactgtatttcagatcctgattggtaccagtcctgatatgaattatataaattatgtgcgcatgcgcatgtctgtgtgtgtaggcctccatagcttgatgtcaaccttcgcgggtttctgaagtctcctaaccagggcctgaatagcagaaaatcatggtcctggggctcccggttatccatgaatgtcatctccaggcgctattcatgtatggtggttcagcgtatgcgttttaatgtcctcgtcattacttttcattaaaaaataataaaaataataataataataataatcatatccgtt

SEQ ID NO: 4230 - DNA, 1669 bp, Momordica charantia
tccatttcaggacattgatacgagaacgaaatcgcattcttctgagttactgatctttgttcaaatctcgatcatcaagaaagagaacttcaatttctaaaggggtttccaatggcgacaatggaggtcgagaaccagcaagcgacgttagcgtcggtggatacttgctcggcgaagcaggccacgaaacaaggtgagggtctgaggcagtactatctgcagcatattcacgagctccagctccaggtccgtcaaaagacccataatttgaatcgtcttgaagctcagcggaatgagctgaattcgaaagtgcgcatgctccgggaagagcttcagctgcttcaagagccaggatcctatgttggtgaagttgttaaggtcatgggaaagaacaaggttttagtcaaggttcatccagaagggaaatatgttgttgatattgacaaaagtatcgatatcacaaaaatcacaccttcaactagagttgctctccgtaatgacagctatgttcttcatttaatcttgccaagcaaagtagatccccttgttaatcttatgaaagttgaaaaggttcctgattctacttatgatatgattggtggtcttgaccaacaaataaaagaaataaaagaggttattgaactccccattaagcatcctgaactatttgagagccttggaatagcccaaccaaagggggtcttgctttatggaccacctggtacagggaagacactgttggctagggcagtggctcaccataccgattgtactttcatcagggtttctgggtctgaattggtccagaaatatattggagaaggctctagaatggtcagagagcttttttgttatggccagggagcatgctccttcaatcattttcatggatgaaattgatagcattgggtctgctcgaatggaatctgggagtggtaatggtgacagtgaggtgcagcggactatgttggaacttcttaaccagcttgatggatttgaagcatcaaataagatcaaggtcttgatggccacaaataggattgatattctggatcaagccctcctaaggccaggacgaattgacaggaagattgaattcccaaatcctaacgaggattcccggtttgatatcttgaaaattcattcgcggaaaatgaatttgatgcgcgggattgatttgaagaaaatcgcagagaagatgaatggtgcatctggtgcagagctcaaggccgtgtgcacagaagcagggatgtttgccttgagggaaagaagggttcatgtgactcaggaagatttcgagatggcggttgccaaggtaatgaagaaggaatccgagaagaacatgtcgttgcgaaagctgtggaagtagaatcgccgcacaagtcggcacatgcgtggcaagtttcaaatattgcttacccttttatttttctgaattcttcacctcacctgggctgcttggagaatgttgatgaacttggttatctgccttaaatgatgttttcttagtcgtcgactctttatccgtctatggatcttgtaacttaaaaaaatcttcccctgcaacatttcttttgccatctctgaatgtgatgacaagttggctgtaggtggtgaggaattatcaattggcttataatttggaagtttgttcttcatttacttgaag

SEQ ID NO: 4231 - DNA, 1595 bp, Amsonia hubrichtii
gaaatttgcgagactgcaaaattcccaaaagtcctcggagaatcatcaagagctggctgttgaaagatcgatttctaatggcggccgcaacaattgagagtaattttccggcggaggaagccaaaggcgttttgaagcattaccatcagcagcaacaagccagtgccgatggcgaagggctgaggcattattatctgctgcgcatccatgatcttcagctccaagttcgccagaaaaccgatgacctgcagcgtcttgaagcccagcgcaatgaacttaattccagagtgagaatgcttaaggaagaactgcaacttcttcaggagcctggctcttatgttggtgaagttgttaaagtcatggggaaatcaaaagtcttagttaaggttcaccccgaagggaagtacgtggttgacattgacaagaatattgatatcacaaaacttacaccatcaacccgagttgcattacggaatgacagctatatgcttcacttgatattgcccagtaaagttgatccccttgtgaacctaatgaaagttgaaaaagttcccgactcaacttatgacatgattggtggtcttgatcaacaaattaaagagataaaagaggtcattgagttgccaatcaaacatcctgaattgttcgagagtcttggaatagcacaaccaaagggagtcttgctctatggaccacctggtactgggaaaacacttcttgcaagagctgttgcacatcatactgattgcacctttatcagggtttcgggttcagaattagttcagaagtatattggagaagggtctaggatggttagagagctttttgtgatggcacgggagcatgctccatcaatcatcttcatggatgaaattgatagtatagggtctgctcgcatggaatctggaagtggaaatggggacagtgaagttcaacggacaatgctggagcttcttaatcaacttgatgggtttgaagcttccaacaagataaaagttttgatggccactaacagaattgacattttggatcaagcccttcttagacctggaagaattgacaggaaaattgagtttccaaatcccaatgaagagtctagatttgacatcttgaagattcactcaagaaggatgaatctgatgcgtgggattgatctgaagaagattgcagaaaaaatgactggtgcctctggggcagaattgaaggctgtttgcactgaagctggaatgtttgctctgcgggagaggagggtccatgttactcaggaagattttgagatggcagtgggcaaagtcatgaagaaggacactgagaaaaacatgtccttgaggaagctctggaagtaagtacttacaggagcttcctagcaattgaaatgcaggaatacaaaccaatttctatggagccactgtttccatacatcatcttagtattcaaaactttagttaattccccaatgtcacttgcattactttgaatcttattttgttctgtactattcttatccaattgcagttctctctcatacttattatgtaagaaaaacaaatagattgttgatttcagatagcaggatattgcagatgaaacacaat

SEQ ID NO: 4232 - DNA, 1606 bp, Amsonia hubrichtii
gaacaagccgcagcgaaccaaacaccgaccctgccttatatagagggagaagcagttcttcttcttcccaattgattgctaaaaccaaagctgtaattcagaagaaatggccacagcagagatcgaggcgaaccgtagcgaagttgagagaggagagagttgttcggcgaagggttcgatggtgaagcaaggcgaaggtttgaggcaatattatctgcagcacatccatgatctccaactccaggtccgtcagaaaacccacaatctcaatcgcctcgaagctcaacgtaacgagctcaattccaaagtgagaatgcttaaggaggagttgcaattgcttcaagagcctggatcttatgttggtgaagttgtcaaagtgatggggaagtcaaaagtgttagttaaagttcatccagaagggaagtatgttgtggatattgataaaagcattgatataacaaagatcactccatcgaccagagttgcccttcgcaatgacagctatgttcttcatttagtcttgcccagcaaggtggatcctttagtcaacctcatgaaggttgaaaaagtacctgattctacttatgatatgattggtggccttgatcagcaaattaaagagattaaggaggtgattgagcttcctatcaaacatcctgaattatttgagagtcttggaatcgctcagcctaagggagttttgctttatgggcccccaggaactgggaaaacattgttggcaagggcagtggcacatcatactgattgtactttcataagagtctctggttctgaactagtgcagaaatatattggtgaaggttcccgaatggtgagggagctttttgttatggccagggagcatgcaccatctatcatatttatggatgagatagacagtattggttctgctagaatggaatctggaagtggtaatggtgatagtgaagtgcaaagaacaatgcttgagcttctgaaccaacttgatgggtttgaggcatcaaataagatcaaggtattaatggccacaaatcgcattgatattctggatcatgccctcctcaggccaggaaggattgataggaagattgaatttccaaatcccaacgaagattctcgctttgatatcttaaagattcattcaagaaaaatgaatttaatgcgtgggattgatttaaagaagattgcagagaagatgaatggtgcttcaggtgcagagctgaaggctgtatgtacagaagctgggatgtttgctctgagggagagaagagttcacgtgacacaagaagattttgaaatggccgttgcaaaggtaatgaagaaggagacggagaagaatatgtccttgagaaagttgtggaagtaatttgtttgaatcctttctttcacaaacttaagtattctggagcgcagttaaatttgtccctaatgttggttttacatagaagagtggcagtttcttggttggtgccatttttgcttctgttggaaatcctttgtatcactttgaatttaccaagatgtgttgttatgctgaatttattgattttccccacgttggctcacatttatacataaccgggacatacgtttattacttaaacct

SEQ ID NO: 4233 - DNA, 1500 bp, Arnica chamissonis
gaaaggcatcaaataagaacatcaaatcccgctgatacacgaaagcggttgggttacaaattctcagatctaaaagggcaagattgttgaatggcgagtgtggatgtagcgatgaaaccatcggattcagtggaccgagatgagaactgttcatcaaggcctacaacggcgaaaccaggtgaaggtttgaggcagtattacttgcaacatatccacgatgctcaactccaggttcgccaaaagactcataatctcaatcgccttgaagctcagcgtaacgagctcaattctcgagtcaggatgcttaaggaagagttgcagctgcttcaggagccaggatcttatgttggtgaagttgttaaagtaatggggaagtccaaagtactagtcaaggtgcacccagagggtaaatatgtagttgatatcgacaaaagcattgatattactaagatcactccatcaaccagagtagcccttcgcaatgacagctatgttcttcatttggttttaccaagcaaagtcgaccctctggtcaaccttatgaaagttgaaaaagtccctgattctacatatgacatgattggtgggctagaccagcaaattaaagagattaaagaggttatcgaacttccaatcaaacatccagagttatttgagagtcttggaattgctcaaccaaagggagttctgttatatgggccacctggcacagggaagaccttgttggcaagagcagtggctcatcatactgattgtactttcattagggtttctggttctgaactagtacagaaatatatcggagaaggatctcgaatggtcagagaactttttgttatggccagggaacatgctccatctatcatattcatggatgaaatagacagtatcggatctgcacggatggaatctggaagtggaaatggtgacagtgaagtacaacgaactatgcttgagcttctcaatcagcttgatggatttgaagcatcaaacaagatcaaggttttgatggctacaaaccgtatcgatattctggatcaggctcttctcaggcccgggagaattgataggaaaattgaattcccaaatcccaatgaagattcacgttgtgatattctgaaaattcattcaagaaggatgaacttaatgcgtggaattgatctgaagaagatagctgagaagatgaatggggcttcgggtgctgagcttaaggcggtttgtactgaagcgggaatgtttgctttgagggaaaggagagtccatgtgacacaagaagattttgagatggcggttgccaaagttatgaagaaggaaagcgagaagaacatgtctttgcgcaagctttggaagtaatcaacgagaacgttaataagccaacggcttttctacctagtattgttttcaaatgtttaaaacttgtgcggattatgtttggctcgaagtcggttgtttcaacttacttttatcttttgcatccgaaacatatactgatcttatgtt

SEQ ID NO: 4234 - DNA, 1465 bp, Cirsium arvense
aagattgttggatggcgagtgtggagatagcgatgaaattatcggattcagagaacagagatgagaactgttcatcgaggcctacaacggcgaaaacaggtgaaggtctgagacagtattacttgcaacatatccacgatgctcaactccaggttcgccaaaagactcataatctcaatcgccttgaggctcagcgtaacgacctcaattctcgagtcagaatgcttaaagaagagttgcagctgcttcaagagcctggatcttatgtcggtgaagttgtcaaagtaatggggaagtcaaaagtacttgtcaaggtgcacccagagggtaaatatgtagttgatatagacaaaagcattgatattactaagatcactccatcaaccagggtagctcttcgcaacgatagctacgttcttcatttggttttgccaagcaaagttgatcctctggtgaatcttatgaaagtcgaaaaagttcctgattctacatatgacatgattggtgggctagaccagcaaattaaagagattaaggaggttattgaacttccaatcaaacatccggagttgtttgagagtcttggaattgctcaaccaaagggggttctgttatatgggcctcctggtacagggaagaccttgttggcaagagcggtggctcatcatactgattgtaccttcattagggtctctggttctgaactagtacagaaatatattggagaagggtctcgaatggtgagagaacttttcgttatggccagggaacatgctccatctatcatatttatggatgaaatagatagtattggatctgctcggatggagtctggaagtgggaatggtgacagtgaagtacaacgaacaatgcttgagcttcttaatcagctcgatggatttgaagcatctaacaaaatcaaggttttgatggctacaaaccgtattgatatcctggatcaagcccttctcaggccagggagaatcgatagaaagattgaattcccaaatcccaacgaagattcacgatttgatattctgaaaattcattcaagaaagatgaacttaatgcgtggtatcgatctgaagaagattgctgagaagatgaacggtgcttcaggtgccgagcttaaggcggtgtgtactgaagcgggaatgtttgctttgagggaaaggagagtccatgtgacacaagaagatttcgagatggcagttgctaaggttatgaagaaggaaaccgagaaaaacatgtcgttacgcaagttatggaagtaaattatatatcccaaattagactttgtatcatttcttttaagattattgtttttaaaaactgcactttttacttcatctttgcatcccaaacatattgaaatctcttttaaaacctagttgtcagttggttgatgttgattttagtctttgggaattctctatatttgaattggtaacaatctctatttgat

SEQ ID NO: 4235 - DNA, 1542 bp, Helianthus annuus
tcatactcttgtcttgcgcagaaagccatcaacaagaaccccaaatcgcctgacacacgaaacctatagggctacaaatcctccgatctaaacctacaaaattgtgaaaatggcgagtgtcgatgtagccatgaaaccatcggattcagttgacagagatgagaactgttcgtcaagatcctcaacggcaaaatcaggtgaaggattaaggcagtattacctgcaacatatccacgattctcagcttcaggttcgccagaagactcataatcttaaccggcttgaagcgcagcgtaacgagctcaattctcgagtcaggatgcttaaggaagagttgcagctgcttcaagagccaggatcttatgttggtgaagttgttaaagtaatggggaaatccaaagtactagtcaaggtgcacccagagggcaaatacgtagttgatatagacaaaagcattgatattactaagatcactccatcaaccagagtagcccttcgcaacgacagctatgttcttcatttggttttaccaagcaaagttgaccctctggtcaaccttatgaaagttgaaaaagtccctgattctacatatgacatgattggtgggctagaccagcaaattaaggagatcaaagaggttatcgaacttccaatcaaacatccagagttattcgagagtctcggaatcgctcaaccaaagggagttttgttatacgggccacctggcactgggaagaccttgttggcaagagcagtggctcatcatactgattgtactttcattagggtttctggttctgaactagtacagaaatacattggagaggggtctcgaatggtcagagaactttttgttatggcgagggaacatgctccatctatcatatttatggatgaaatagacagtattggatctgctcggatggaatctggaagtgggaatggtgatagtgaagtacaacgaactatgctcgagcttcttaatcagcttgacggttttgaagcatcaaacaagattaaggttttgatggctacaaaccgtattgatatcctggatcaggctcttctcaggcccgggagaattgataggaaaattgaattcccaaatcccaatgaagactcacggttcgatattctgaaaattcattcaagaaagatgaagttaatgcgtggcattgatctgaagaagatagcggagaaaatgaatggggcttcaggtgctgagcttaaggcggtttgtaccgaagctggaatgtttgctttgagggagaggagagtccacgtgacccaggaagattttgagatggcagtcgccaaggttatgaagaaggaaactgagaaaaacatgtctctgcgcaagctctggaagtaatcaagtagacgcatttctttctagtactcttttcaaacgtttaaaccttacatcctttattatgtaccaattgtgttatttacttttatcttttgcatccgaaacatactaatattatgttaaagcccaactttaaaagactcttggttgatattgattgaagtttagga

SEQ ID NO: 4236 - DNA, 1650 bp, Citrullus lanatus
ccgactcgaatcaccgaaagagaaacagaacaattcaggaagaagcacattcaattttcgatggcgacgatggagttagactccaagctaccggaggccacaattgaagagacgtgctccgccaagccggcgacgaagcacggcgaaggtcttaggcactattatcttcaacacattcaggaactccagcttcaactccgcctgaaaactcacaatctcaatcgtctcgaagctcagcgaaacgagctcaactctagagtgaggttgcttcgtgaagaacttcagctgcttcaggaacctggatcttatgttggcgaagtggtcaaagtcatgggaaagaataaggttttagtgaaggtgcatccagaagggaaatatgttgtagatatagataaaagcattgatatcacaaaaatcaccccatcaactagggtcgctcttcgaaatgacagttatgttcttcatttagttctgccaagcaaagtagatccattagtgaatcttatgaaagttgaaaaggtccctgattctacttatgacatgattggtggtcttgatcagcaaattaaggagataaaagaggtcattgagcttccaatcaagcatccagaattatttgaaagtcttggaatagctcaaccaaagggtgtcttgctatatgggcctcctggtactgggaaaacactattggctcgggcagtagcacatcataccgattgtactttcattagggtttctggttctgagttggtgcagaaatatattggagaaggttctagaatggttagagaactttttgtgatggccagggaacatgctccatctatcattttcatggatgaaattgacagtattgggtcagctcgtatggaatctgggactggtaatagtgatagtgaggtgcagagaactatgctggaacttcttaaccaactggatggatttgaagcatcaaacaagatcaaggttctgatggccacaaatcggattgatattcttgatcaggctcttctgagacccggacgaattgatagaaaaattgagttcccaaatcctaatgaggagtctcgttttgatatcttgaaaatacattcaagaaaaatgaatttaatgcgggggatcgatttaaaaaagatcgctgaaaagatgaatggtgcatctggtgccgaacttaaggctgtttgcactgaagctggaatgttcgccctaagggaaagaagggttcatgtgacacaggaagatttcgagatggcagttgcaaaggtaatgaagaaggatacagataagaacatgtcgctgcggaagctctggaagtagagtagattgaagtagtttaccgtttagtcggctacacatttttccacaacctatccctgttgggaattttaaatgacgcagttggctgtgagaccaattcaaaagactcttccctccaatgtaagcttctctaagcccttacacttcaaaacgcgtctgcctaattcccactttgaaaagtaaatattctggaggaccctcatcagctgtcttttatacgtcaaatcgtgggactgtttgttctgaagggcattcgtgctttcttgtcgatattactttattttccaggtcttcgggtgaaaaaaatagtaatatctcttttattttttttcc

SEQ ID NO: 4237 - DNA, 1742 bp, Arabidopsis thaliana
tttagttgtggttttggtattgcagacattaaaaataacaaaaccaagcggtttatagactcggtttattttgggtcgttcgttttccattttattctcacaaaataaaaaatagtaaattgaacttacaaaaaaaaaaaagatgtcttgttggataatccaaggttcttttctatataaaggttctttgctcatgatcttagtccctgtgatctatctttgaatctcaaaagcatacttgagagagatctgtttcgataatttgcttcaatcaccgtgttaatggcggccgtaggagtggaggcgagacctcctgtgacagcgatggaggaaacctgcaacgttaagggagcggcggcgaaacaaggagaagggcttaacaagtactacctccagcatctcgatgagctccagcgcctgcaacgcgaaaagtcgtataaccttaatcgtcttgaagctcagaggaatgaactcaattctcgagtacgaatgctcagagaagagttacagctccttcaagaacctgggtcctatgtgggtgaagtggtaaaagtgatgggaaaaaacaaggtcttggttaaggttcatccagaggggaagtatgttgtcgatattgacaaaagtatagacataacgaaactcactccatcaacgagagttgctctccgtaatgatagctatgttctccacctggttctgccaagtaaagtagatcccttggttaaccttatgaaagttgagaaggttccagactccacatatgacatgattggtggtcttgaccagcaaatcaaggaaataaaggaggtcattgaactgccaatcaagcatcctgaattgtttgagtctcttggaattgcgcagccaaagggtgtgttgttgtacggtccacctggaactgggaagacactattggctcgggctgtggcacatcacactgactgtactttcatcagagtttctggttctgagctggtccagaaatacattggagaaggttctagaatggtcagagaactttttgtgatggcaagggagcatgcaccatcaatcatcttcatggatgaaatcgatagtatcgggtctgctcgtatggaatctggtagtggaaatggtgacagtgaggtgcaaaggactatgcttgagcttctcaatcaacttgacggattcgaggcgtcaaacaaaatcaaggttttgatggctacaaatcgtattgatattctggatcaagctcttctccggcctggaaggattgataggaaaattgaatttcctaatcctaatgaagagtcacgttttgatatcttgaagatacactcaaggaaaatgaatttgatgcgtggaatcgatctgaaaaagattgcagagaagatgaatggtgcttcaggtgctgagctgaaggctgtatgcacggaggcgggcatgtttgcacttcgtgagaggagagtacatgtgactcaggaagactttgagatggctgtggcgaaggtaatgaagaaagacacagagaagaacatgtctctgcgtaagctctggaagtaggaatttcagagtcacagattaatttcgattatttcttctctactgtctgtggttctttctgaaaccttttcggctagcgctttaagcttttctaaacaatgtttgtacactagtttctattcattcaaatggttgttcagcataacatcttcgattcaaccaagcttacattttacatcttaagagtatattcttctcca

SEQ ID NO: 4238 - DNA, 1599 bp, Brassica rapa
tttagtagctgaagtaatgtgtgcgcgagggtttcagattccgatctctctctctctctcatctcccgaaatcgaaataccgagagacacgaatcactcacgatatggcggccgtaggagtcgaggcgaggcgtcccgagacagcgatggaggaaacctgcaacgccaagggagcggtggcgaaacaaggggaagggcttaagcagtactacctccagcacatccacgagctccagcgcctgctccgccagaaaaccaacaacctcaatcgccttgaagctcagagaaacgaactcaattctcgagtacgaatgctcagagaagagttgcagctgcttcaggaacctggttcctatgtgggcgaagtggttaaagtgatggggaaaaacaaggtcttggttaaggttcatcctgaggggaagtatgttgttgatattgacaaaagtattgacataaataagatcacaccatcgacaagagttgctcttcgtaatgatagctatgttcttcacctggttcttccgagtaaagtagatccgctggtcaaccttatgaaagttgagaaggttcctgactccacatatgacatgattggtggtcttgaccagcaaattaaggaaatcaaggaggtcattgagcttccaatcaagcatcctgaattgtttgagtctcttggaattgcgcagccaaagggtgtgttgttatatggtccacctggaactgggaagacactattagctcgggctgtggcacatcacactgactgtacgttcatcagagtttctggttccgagctggtccagaaatacattggagaaggttctagaatggtcagagagctttttgtgatggcaagggagcatgcaccatcaatcatcttcatggatgaaatcgacagtatcgggtctgctcgtatggaatctggaagtggaaacggtgacagtgaggtgcaacggactatgcttgagcttctcaatcaacttgacggattcgaagcatcaaacaaaatcaaggttttgatggcaacaaatcgtattgatattctggatcaagctcttctcaggccaggaaggattgataggaaaattgaattccccaatccaaatgaagattcacgttttgatatcctgaagattcactcgaggaaaatgaatttgatgcgtggaattgatctgaaaaagattgcagagaagatgaatggtgcgtcgggtgctgaactgaaggctgtgtgcacggaggcaggcatgtttgctctgagggagaggagagtacacgtgacacaggaagacgttgaaatggcggtggcgaaggtaatgaagaaagacacagagaagaacatgtctctgcgtaagctctggaagtagggtagtctctttgttgtctagacctgatatatcagcctttctttactgtttgttggttgtttctgaaatcttatcgttttgttgtctaaacgttctgaaaaacaaagttgtttagagcaaacactagtttatttttcaaatggtctcaagacatatcagtttcgatttttacaaacaagttttttctttacaatatagaagtttttccaaccgagtcatcagatattcagataaa

SEQ ID NO: 4239 - DNA, 1333 bp, Brassica rapa
  misc_feature (33)..(33): n is a, c, g, or t
gggtttcagattccgatcaaaaaaactaacatntctctctatcgaaataccgagagacacgaatcactcacgatatggcggccgtaggagtcgaggcgaggcgtcccgagacagcgatggaggaaacctgcaacgccaagggagcggtggcgaaacaaggggaagggcttaagcagtactacctccagcacatccacgagctccagcgcctgctccgccagaaaaccaacaacctcaatcgccttgaagctcagagaaacgaactcaattctcgagtacgaatgctcagagaagagttgcagctgcttcaggaacctggttcctatgtgggcgaagtggttaaagtgatggggaaaaacaaggtcttggttaaggttcatcctgaggggaagtatgttgttgatattgacaaaagtattgacataaataagatcacaccatcgacaagagttgctcttcgtaatgatagctatgttcttcacctggttcttccgagtaaagtagatccgctggtcaaccttatgaaagttgagaaggttcctgactccacatatgacatgattggtggtcttgaccagcaaattaaggaaatcaaggaggtcattgagcttccaatcaagcatcctgaattgtttgagtctcttggaattgcgcagccaaagggtgtgttgttatatggtccacctggaactgggaagacactattagctcgggctgtggcacatcacactgactgtacgttcatcagagtttctggttccgagctggtccagaaatacattggagaaggttctagaatggtcagagagctttttgtgatggcaagggagcatgcaccatcaatcatcttcatggatgaaatcgacagtatcgggtctgctcgtatggaatctggaagtggaaacggtgacagtgaggtgcaacggactatgcttgagcttctcaatcaacttgacggattcgaagcatcaaacaaaatcaaggttttgatggcaacaaatcgtattgatattctggatcaagctcttctcaggccaggaaggattgataggaaaattgaattccccaatccaaatgaagattcacgttttgatatcctgaagattcactcgaggaaaatgaatttgatgcgtggaattgatctgaaaaagattgcagagaagatgaatggtgcgtcgggtgctgaactgaaggctgtgtgcacggaggcaggcatgtttgctctgagggagaggagagtacacgtgacacaggaagacgttgaaatggcggtggcgaaggtaatgaagaaagacacagagaagaacatgtctctgcgtaagctctggaagta

SEQ ID NO: 4240 - DNA, 1672 bp, Cucumis sativus
aaagcgcaagaaaccaggaatacccacctccattttacaacattcatcttcttctattgatcgacaaagtctcattttctagtttgcttatcttttgttcaaatctagatcgtctagttaaagtagttcaatttttctacctctcttccaatggcgataatggaggtcgagacccagcaagcggcgtcggcgtcgttagatgcttgctcggcgaaacaggcgacgaaacaaggcgagggtctgaggcagtactatctccaacatattcacgagcatcagctccaggtccgtcaaaagacccataatctgaatcgtcttgaagctcagcgtaacgagctgaactcgaaagtacgcatgctccgggaagagctccagctacttcaagagccaggatcttatgttggtgaagttgttaaagtcatgggaaagaacaaagttttagttaaggttcatccagaagggaaatatgttgttgatatcgacaaaagtatcgatatcacaaaaatcacaccctcaacacgagttgctcttcgtaatgacagctacgttcttcatttagtcttgccaagcaaagtggatccacttgttaatcttatgaaagttgaaaaggttcctgattcaacttatgatatgattggtggtctcgaccaacaaataaaagaaataaaagaggttattgaactccccattaagcatcctgaactttttgagagtcttggaatagctcaaccaaagggtgtgttgctgtatgggccacctggtacagggaagacactgttggctagagcagtggctcaccatacagattgtactttcatcagggtttctgggtctgagttggtccagaaatatattggagaaggttctagaatggtcagagagcttttcgtcatggctagggagcatgcaccttctattattttcatggatgaaatcgatagtattgggtctgctagaatggaatctgggagtggtaatggtgatagtgaggtgcagcgtactatgttggaacttcttaaccagcttgatggatttgaagcatcaaataagatcaaggtcttgatggccaccaataggattgatattctggatcaagctcttctaaggccaggacgaattgacaggaagattgaattcccaaatcctaacgaggattctcggtttgatatcttgaaaatacattcccggaaaatgaatttgatgcgtgggattgatctgaagaaaattgctgagaagatgaatggtgcatctggtgcagaactcaaggccgtatgtacagaagcagggatgtttgctttgagggaaagaagggttcacgtgactcaggaagattttgagatggctgttgccaaggtgatgaagaaggaatcagagaagaacatgtcgttacgaaagctatggaagtagaactatcataagaagtagccaaggagtggcaaattctgaatagtgcttacgtttttattcttgaattcttcacctcatctggctgtgcttagagatttgtcgaacttggtttatgtaccttgattgatgttttatagtcatcaactcatttattttcacctggatcttgtaacttaaatccctccttttccagatgtattgacaagttgatggtagctggtaaggattaaagaattgcccaattgaaagttatttactttgttca

SEQ ID NO: 4241 - DNA, 1310 bp, Cucumis sativus
tgcaaatcaccgaaagagaaacaaaacatttcaggaacaagcatcttcaattctcgatggcgacgatggagttagacaccaagctaccggaggccattagtgaagacacgtgctccgccaagccggcgacaaagcacggcgaaggtcttaggcattattatcttcaacacattcaggacctccagcttcaactccgcctcaaaactcacaatctcaatcgtcttgaagctcagcgaaacgagctcaactctagagtgaggttgcttcgtgaagaacttcagctgcttcaagaacctggatcctatgttggcgaagtggtcaaagtcatgggaaagaataaggttttagtgaaggtacatccagaagggaaatatgttgtagatatagataaaagcattgatatcacaaaaatcaccccatcaactagggttgctcttcgaaacgacagttatgttcttcatttagttctgccaagcaaagtagatccattagtgaatcttatgaaagttgaaaaggtccctgattctacttatgacatgattggtggtcttgatcagcaaatcaaggagataaaagaggtcattgagcttccaatcaagcatccagagttattcgaaagtcttggaatagctcaaccaaagggtgtcttgctatatgggcctcctggtactgggaaaacactattggctcgtgcagttgcacatcacactgattgtactttcattagggtttctggttctgagttggtgcagaaatatattggagagggttctaggatggttagagagctttttgtgatggccagggaacatgctccgtctatcattttcatggatgaaattgacagtattgggtcagctcgtatggaatctgggtctggtaatagtgatagtgaggtgcagagaactatgctggaacttcttaaccaactggatggatttgaagcatctaacaagatcaaggttctgatggccacaaatcggattgatattcttgatcaggctcttctaagacctggacgaattgatagaaaaatagagttcccaaaccctaatgaggagtctcgttttgatatcttgaaaatacattcgagaaaaatgaatctaatgcgggggatcgacttgaaaaagattgctgagaagatgaatggtgcatccggtgctgaacttaaggctgtttgcacagaagctggaatgtttgctctaagagaaagaagggttcatgtaacccaagaagatttcgagatggcagttgcgaaggttatgaagaaagacacagataagaacatgtcattgcgaaagctctggaag

SEQ ID NO: 4242 - DNA, 1462 bp, Eschscholzia californica
ctctctctctctctaactctgtaatggcgacagcagcagtggagacgacgaaacaaccagaaacaggaagcgacatatatagcgcatcgagaacgatggtgaaacaaggggaaggtctgaaacaatactattctcaacgtattcatgattatcaacttcaagtccgtcagaaaactcataacctaaatcgtcttgaagctcaacgtaacgatctcaattctagagtgagaatgctcagagaagaattgcagctgcttcaagagcctggatcttatgtaggagaggtggtaaaagttatggggaaatcaaaggtgttggttaaggttcatccagaagggaagtatgttgttgatgtcgataaaagcattgatatcacaaagattacgccaacaaccagagttgctctgcgtaatgatagttatatgcttcacttgattttgccaagcaaagtagatcctctggtcaatcttatgaaagttgaaaaagttcctgactctacttatgacatgattggtggtcttgatcaacaaattaaagagatcaaagaggtcattgagctgccaattaaacatcccgagttgtttgagagtcttggaattgctcagccaaagggagttctactttacgggccacctggtacggggaaaacactgcttgctagggcagtagctcatcataccgactgcacctttatcagagtttctggttctgagttggtccagaaatacattggagaaggctctagaatggtccgagaactttttgttatggcaagggaacatgctccttcaattatttttatggatgaaattgatagtattggatctgctagaatggaatctggatctggtaatggtgacagcgaagtgcaaagaaccatgcttgagcttctgaatcagttggatgggtttgaagcatcaaacaagatcaaagttctcatggccactaatcggattgatattctggatcaagccctcctcaggccaggtcgcattgacaggaagattgagtttccaaacccgaatgccgactctcgctgggatattttgaaaattcactcaaggaaaatgaacttgatgcgtgggattgatttgaagaagatagcagagaagatgaatggtgcatctggtgcagaactcaaggctgtgtgcacagaagcagggatgtttgccttaagagagagaagagttcatgtaactcaggaagattttgaaatggcagtggggaaagtaatgaagaaagaaacagagaagaacatgtcactaaggaagttatggaagtagacttcttttttgcttctactatttcctcgttgattttctacttcgattcagacatcaaagcgaaacctaggtcttagcaatcatgttctcgctctttgtatgattgttatatttgctcggattgttatttattatgttgctttcctctgttccgttctgttgatgttatagttgagaaa

SEQ ID NO: 4243 - DNA, 1700 bp, Eucalyptus grandis
ctcttcttccccagtggagtaatcccaaagaaacctcttctctctctctctctacatctcgcctgagatcgtctctgcaaagatcttccctctccggcaatggcggcgacggcgttcgacaagccccagcccgaattggccccgccgccgtcggcggaggagggggcctgcaactccacgcgggggccgggcgccgcgaagcacggcgaggggctccggcagtactacctccagcacacccacgagctccagctcctcgtccgccagaagacccacaacctcaaccgcctcgaagcccagcggaacgagctcaattcccgagtaagaatgctcagagaggagctgcagctgcttcaggagcctggatcatatgttggtgaagttgtcaaagttatgggtaaaaataaagttctagttaaggttcacccagaaggaaaatatgttgttgatattgataaaaatattgacatcacaaaaattacaccttctactagagtggctcttcgcaatgacagctatgttctgcatttgatcttgcctagcaaagttgatccactggtcaaccttatgaaagttgaaaaagtccctgactctacatatgacatgatcggtggtcttgaccaacagatcaaggaaatcaaggaggttattgaactcccaattaagcatcctgaattatttgagagcctcggaatagctcagcccaagggcgtgttgctgtatggccctcctggcactgggaagacacttctggcaagggcagtggcccatcacactgattgtaccttcataagggtctctggttctgaattggtccagaagtacattggagaaggctctagaatggtcagagaactttttgtcatggcaagggaacatgctccatctatcatattcatggacgaaatcgacagtattggatctgctaggatggaatctggaagtggtaatggtgatagtgaagttcagcgaactatgctagagcttcttaaccagcttgatggatttgaagcatccaacaagattaaggttctgatggccacaaatcgtattgatattttggatcaagcccttcttaggccaggaagaattgacaggaaaattgaatttccaaatcctaatgaagagtctcgactggatatccttaaaatccactcaagaaagatgaacttaatgcgagggattgacctgaagaagattgctgagaaaatgaatggtgcatctggtgcagagctgaaggccgtgtgcacagaggctggcatgtttgctctgagggaaagaagggttcatgtaacccaggaggacttcgagatggcagtggcgaaggtcatgaagaaagagaccgagaaaaacatgtcgctgcggaagctttggaagtagaaatgtcctacaaggggggccattacttttgtccgagccaaaccgagagcatggagaccagacaccccactcccttgtttgcacacctgaacatctagctgcttccgtctttgtaatcctgcttttcattgatgccgcaaagttttaaaatgtagtccatggatgagggtttatgtcgcgttgtgaacctgggagaagagaggatggaagacggtgggaccaaatcaatgtcacgttaagaacagtctctcatatgactcctatttatgtattcctccttttcaatgtgaatgtctctattcttgagattctttctggta

SEQ ID NO: 4244 - DNA, 1561 bp, Euphorbia peplus
gatactcaaacaaccagagtccatgatcgtcgacgagagctgctccgccaagagtagcggcgccgccgccgccggaaagctaggtgaaggcctgaggcagtattatctccaacatatccacgagctccaccttctcgtccgccagaagtctcacaatcttaaccgtcttgaagctcagcgtaacgagctcaattcccgggtgagaatgctcagagaagaactacagttgcttcaggaacctggatcatatgttggtgaggttgtcaaagtaatggggaaaaacaaggtgttagttaaggttcatccagaagggaaatatgtggttgatatcgataaaagcattgatatcacaaagatcacaccatcaacaagggttgcccttcgaaatgacagctatgttcttcatttggtcttgcctagcaaggtggatccattggtcaatctcatgaaagttgaaaaggttccagattctacatatgacatgattggtggccttgaccagcaaattaaggagattaaggaggtcattgagcttccaattaaacatcctgaattgtttgagagtcttggaatcgctcagcccaagggtgttcttctctatggccctcctggtacagggaaaaccctcttagctagggcagtagcacatcataccgactgtacgttcattagggtttccggttctgaattggttcagaagtacatcggtgaaggctctcgaatggtcagagaactttttgtcatggccagagaacacgctccatctataattttcatggatgaaattgatagtattgggtccgctagaatggaatccggaagtggaaacggggacagtgaggtgcagcgcactatgctggagcttctcaatcagttggatgggtttgaagcatccaacaagatcaaggttttgatggctactaatcgaattgatattctcgatcaagctctcctaaggcctggacggattgaccggaagatagaatttccgaatcctaatgaagagtcacgtcaagatatcttgaaaattcattcaagaagaatgaacttgatgcgtgggattgacttgaagaagattgctgaaaagatgaatggtgcatctggtgcagagctcaaggctgtatgcacagaagcaggaatgtttgcacttagggagagaagggtgcacgtcacacaggaggattttgagatggccgtagcgaaggtgatgaagaaggagaccgagaagaacatgtcgttgcggaagctttggaagtaacacctttgtaatgtttatgtctttgaactaacaggcaaaggaaagccaagaaagagactcgcaacaagttctcggtattggattgtcatgcatgttatgtagttgttcatcggaatcagtccttgcttggtttactttttcacttgtgtaaaaaaccgatggatgaattggccagtgaagtgaacttgtcaattcatgtgttatattgtttaatatttcaatattcgagtatttattcatcgttggataacacatcattgtaaccaaaaaaaaaaaattaacttgtcaaaaaatgtcgtgcgc

SEQ ID NO: 4245 - DNA, 1643 bp, Cajanus cajan
caagtcctaggagtttcaagtttgttctccttatataccgacctaacccaaaaggagggaggtttgggatgcttctgctttgattgaatatagaatagaaggaagggatagatcgatctccatcgagaaattgaattgaaatcgatcaaatctatggcggccgtcggagtagaattgaagcacgcagagagtgcaccggaggagaattgctccgccaagcctaccaagcaaggcgaggggctccgccagtactatgctctccacatccacgagcatcagctcctcctccgccaaaagacgcataatctcaaccgtctcgaggctcagcgaaacgagcttaattccagggtgaggatgctccgtgaagaacttcagcttcttcaggagcctggctcttatgttggtgaagtcgtaaaagtcatggggaaaaacaaagtcctcgtcaaggtgcatccagaaggaaagtatgttgttgatattgacaaaaatattgacattacaaagattactccatccacccgggttgcccttagaaatgacagctacgttcttcatttaattctgccaagtaaagtggatccattggtcaatctgatgaaagttgagaaagttcctgattctacatatgacatgattggtggtttagaccagcaaatcaaagaaattaaagaggtcattgagcttcccattaaacatcccgagctttttgagagtcttggaattgcacaaccaaagggtgtcctgctctatgggccacctggtacaggaaaaacattgttggctagggcagtggcacatcatactgattgtacattcatcagggtgtctggttctgaattagttcagaaatacattggagaaggttctagaatggtcagggaactttttgttatggccagggaacatgctccatcaattatcttcatggatgaaattgacagtattggatctgcccggatggaatctggaagtggcaatggtgatagtgaggtacaacgtactatgctggaacttctcaaccagttggatggatttgaagcttcaaataagatcaaggttttgatggccacaaatcggattgatatcctggatcaagctctccttagacctgggcggattgacaggaagattgaatttcctaatcctaatgaagagtctcggctagatattttgaaaatccattcaagaagaatgaatttaatgcggggcatagatttgaagaagattgctgagaagatgaatggagcatctggtgctgaacttaaggctgtgtgcactgaagctggaatgtttgctttgagggaaaggagggtacatgtgactcaggaggatttcgagatggctgtggccaaggtgatgaaaaaggagaccgaaaaaaacatgtcattgcggaagttgtggaaataatttttatttcatgtttctggtgcacattgtcctgcaaagatgggcagcgaacacgccttagggttgtttcaatttacagtggcactggcttttgttttgattaagttgacgaagttatgtaccaaatcatgattctttcccgttgatttcttctttgtctgtgtcctcggactgcacgctgcatttatatagagtacttttaaaagggatttatattaaagatcacaacgtagtct

SEQ ID NO: 4246 - DNA, 1690 bp, Cichorium intybus
aaaggggcagcaacccttctttcgtgatctatactcctctgtacaccacaccgactattgaaatcaatatcgccattgaaacaaaaatctgcaagctcacgaattctctgttcgagagataggaatggcgacagcggagatagcgatgacgcccgcggattcattggagaaagacgagggttgttcgacgaggcacacggcgaaaccaggtgaaggtcttaggcaatattacctccagcatatccacgatgctcagcttcaggttcgccagaagagtcataatctcaatcgccttgaggctcagcgtaacgagctaaattcccgagttaggatgctaaaggaagagttgcagcttcttcaagaacctggatcttatgttggtgaagttgtcaaagtaatgggaaaatcaaaagttctagtgaaggttcacccagagggcaaatatgtggttgatattgataaaagcattgacattactaaaatcacaccatcaaccagggttgccctgcgaaatgacagttatgtccttcatttggttttgccaagtaaagtggatcctttagtcaaccttatgaaagtagagaaggttcctgattctacatatgacatgattggtgggcttgaccaacaaattaaagagattaaggaggttattgaacttccaatcaaacatccagagttatttgagagcctcggaattgctcaaccaaagggagttctgttatacggtccacctggcaccggaaagacattgttggcaagagccgtggctcatcatactgattgtactttcattcgggtttctggttctgaattggttcagaaatatatcggagaaggttccagaatggttagagaacttttcgtcatggccagggagcatgccccatcgattatattcatggatgaaatcgacagcattggatctgctcgaatggagtctggaagtgggaatggagacagtgaagtccaaagaacaatgctcgagcttcttaatcaactcgatggatttgaagcatcaaacaagatcaaggttttgatggctacgaaccgtattgatatcctggatcaggctcttcttaggcctggaagaatcgacagaaagattgagttcccaaatcctaatgaagactcgaggtgggatatcttgaaaattcattcaagaaaaatgaacttgatgcgtggcattgatctgaaaaagattgctgagaagatgaatggtgcttccggtgcagaacttaaggcggtttgcacagaggcagggatgtttgcattaagagaaaggagagtccacgtgacacaagaagactttgagatggcagtggccaaggttatgaagaaggaaaccgagaaaaacatgtcccttcgcaagctatggaagtaattcttcattttacgagggtgaaagtggaattttaccaaccataatagtatggaatgatccccgccaaaactttggtcatacaactgagaaccgtggttttggtctttgctggatttccttgcctttaatgttttgaaatttcttgttttttttgcaatgtaatttcatgctcaaggagactgtccctgtttgtccaagtagtaaggatgtaagaatctataaacttgggcttctttattttccttgttctcgagatattctgatttaccttctcttctgttaagtttaatttatatgcattaaacc

SEQ ID NO: 4247 - DNA, 1674 bp, Coffea canephora
cggccgggggaataccagagttcagaggaaatcgatcgtcattctggtgcaattgaatccccaattcacctatcatcaaaatccgataaaatcgaagctaccaaagaagctttaataaaatggctacagcagaggtagagaagaaccgaagtggagcagagagagaagagagctgttcgagcaagggtacgatgatggtgaagcaaggcgagggcttgcggcagtattatctccaacatatccacgatcttcagctccaggtccgccagaaatcccacaatctcaaccgtctcgaagcccaacgcaacgagctcaattctaaagtgagaatgctcaaggaggagttgcaactactgcaggagcctggatcttatgtgggtgaagttgtcaaagtaatggggaaatctaaagttctagttaaagtccatccagaaggaaaatatgtggttgatattgataaaaacattgacattacaaagatcactccatcaaccagagttgctctccgaaatgacagctatgtcctgcatttaattttgcccagcaaagtggatccgttagtcaatctcatgaaagttgaaaaagttcctgattctacatatgacatgattggcggtcttgaccagcaaatcaaagagattaaggaggttattgagcttccaatcaaacatcctgagttatttgagagtcttgggatagctcaacccaagggagtcctactttatggacctccaggaactgggaaaacactgttggcgagggcagtcgcacatcataccgattgtactttcatcagggtctctggttctgaactagtgcaaaaatatattggggaaggttcccgaatggtgagggaactttttgtcatggccagggagcatgccccatccatcatctttatggatgaaatagacagtattggttctgcgagaatggaatctggaagtggcaatggtgacagtgaagtacagcggacgatgctggaacttctcaaccaacttgatggttttgaggcatcaaataagatcaaggttttgatggccacaaatcgtattgatattttggatcaagctctccttagacctgggagaattgaccggaagatagaatttccaaatccgaatgaagagtctcggttcgatattctaaaaatccattcaagaaagatgaatttaatgcgtgggattgacttaaagaagattgcagaaaagatgaatggtgcatctggtgcagaattgaaggctgtgtgtacagaagcagggatgtttgctctgagggagaggagggttcatgtgacgcaagaggattttgagatggctgttgccaaggtgatgaaaaaggagacggagaaaaatatgtccttgcgaaagctatggaagtaatgagagttttggttttctctggattgatgtacttgaaaagtgtccaagtttctgtttaactttggttttatgtagcagaatatcgttgatctggaagataccatgtttgcatctgtcgttgctcgcctttgcgttagtaaccccagatgcaaatcggttgtgttattttctgagtttgacgtttttcctcccttgtcttgcgaacatttgtatgtaattttatgaagtgagttcgataaagttcttaatccagcccgaggtttcatgactcgtggcattttcttcttaaaaa

SEQ ID NO: 4248 - DNA, 1594 bp, Solanum tuberosum
aatttaatgctgctatattcttctttcactcccaaacccaattagtccggacaacgcaaatcactgcgatttcttcaaaacctatctgcaaaaatggcgtcagttgatgttgagaagagcaggagcgatatggagagagaggaagcctgttcggcgaaaccaacaaagcaaggggaagggctgagacagtactatatgcagcacatccatgatctccagctccaagtccgcgtaaagactcacaatcttaatcgccttgaagcccagaggaacgaactcaattctaaagtgagaatgctcaaagaggaattacaattgcttcaggagcctggatcatatgttggtgaagttgttaaagtaatggggaagtcaaaggttctagtcaaagttcatcctgaaggcaaatatgttgtcgatattggcaaaaatattgacattacaaagatcactccatcaactagagttgccctgcgcaatgatagctatgtccttcatctaatattgcccagcaaagttgatccattggtcaacctcatgaaagttgagaaagtgccagattccacttatgacatgattggtggtcttgaccagcagatcaaggagattaaagaggttattgagcttcctataaagcatcctgagttatttgagtctcttggaatagctcaaccaaagggagtgctgctctatggacctccaggaactgggaaaacattgttggctagggcagttgcacatcacactgattgtaccttcattagggtctctggttccgaactagtgcagaaatatattggagaaggttctcgaatggtgagagaactttttgttatggccagggaacatgctccttctatcatttttatggatgagatagacagcattggatctgctaggatggaatcagggagtggcaatggtgacagtgaagtgcagaggacaatgcttgaacttctcaatcagcttgatggatttgaggcatcaaacaaaatcaaggttctgatggccacaaaccgcatagatattctagatcaagcactccttagaccaggaaggatagacaggaagattgaatttccaaatcccaatgaagagtctcgtcaggacattttgaagattcattcgaggaagatgaacttgatgcgggggattgatttgaagaagattgctgagaagatgagtggtgcttctggggctgaacttaaggctgtatgtacggaagcagggatgtttgctctaagagagaggagggtgcatgtgacgcaagaagattttgagatggctgttgctaaagtaatgaagaaagagactgagaagaacatgtcactgcgaaagctgtggaagtagatgatggtcgatatgaaggacctgaaacgcatacacatctgagttgattgtctataattacttttgttggaacttttatttgaccccaggagcttacgacttgcccttggtattttcatgtttctcagtaagctgtttcattttctttggccgtatggggcattcacagatgtaattcaaaaatgttcagtgtttttccgcgcagcttttgtatttcactcccggcttctaacttattcatgtttag

SEQ ID NO: 4249 - DNA, 1852 bp, Oryza sativa
cgaaacacaggtcgagagcggccctctcaaaacgcgagctcgatcagcgtcccgacgaaagagacgagacgaaacgaaaccctcgaactcgaagcaatggcgacggcggacgtctcgcggccctcctcctccgcgccgacggcggcggctgcgggggcagacggccacggggcgaaggggagcgccttccgcggtgacgggctgcggccgtactaccagtcgcgcatccacgacctgcagctccagatccgccaagggacggacaacctcagccgcctcgaggcccagcggaacgtcctcaattcccaagttataacgctgggggaagagttgaaggtgctccatgaaccgggctcatatgttggtgaggttgtcaaggttatgggcaagtccaaggttctagtgaaggtgcacccagaaggaaaatatgttgttgatgtcgataaaagtattgatattacaaagctctcgccttcaacaagagttgctcttcgaaatgacagctatatgcttcatcttatcctgcccagcaaagttgatccattggttaatcttatgaaggttgagaaggttcctgattctacttatgatatgattggcggccttgatcagcagattaaggagatcaaagaggttattgagcttcccattaagcatcctgagctgtttgaaagtcttggaattgcccagccaaagggtgtccttctttacgggcctccgggtacaggaaaaacgctactagctcgggcagttgctcatcacaccgactgtacctttattagggtgtcaggttccgagttggttcagaagtatattggagagggttccagaatggttcgtgaactatttgtgatggccagagagcatgcaccatccataatctttatggatgaaatagactccattggatctgctagaatgcagtcaggatctgggggtggtgatagtgaggttcaacgcactatgcttgagcttctgaatcaacttgatggctttgaagcatcaaacaaaattaaggttcttatggcgacaaataggatggatattttggatcaagctctcctgaggcctggtcgcattgataggaagattgaatttccaaatccgaatgaagattcccgctttgatatcttgaagattcattcaagaaaaatgaacttgatgcgtggcattgatctgaaaaagattgcagagaagatgaatggggcatctggagcagagcttaaggcggtctgcacggaagcaggaatgtttgcccttcgcgagagaagggttcatgtcaaccaggaggatttcttgatggcggtggcgaaggtgatgaagaaggataccgaaaagaacatgtccctgcgcaagctctggaagtgaaggaagctctcatctcgacatccctgtcatatgcctaaacagctgaagctaaacagcgccagcgatgcattgatcgctgtaaattccttaaaacatgtcgagaagggaaacgttcaacatcttacagtagcttcttttaaagttatagaattccttcattggattatcaagatgtgaaatgaaaaggtttagatcaatctctcgctggtgtgatgtaagttcatattgttcactggattggttccaccctctgctcgtgtgtgcacaatttagcccagattttgtagatcaggataagttgccaacttacgcccatattggatcaaactgccaatatcacaatggagaatgttttcgttaacaagctaatatgggtcgccccttcttcttgcgccaaagatcttaccatttccgaagcggaaatggggctacatttcttttcaattttcattcaagagtttctatctgtttccacgcccttttt

SEQ ID NO: 4250 - DNA, 1719 bp, Oryza sativa
cagcgtcccgacgaaagagacgagacgaaacgaaaccctcgaactcgaagcaatggcgacggcggacgtctcgcggccctcctcctccgcgccgacggcggcggctgcgggggcagacggccacggggcgaaggggagcgccttccgcggcgacgggctgcggccgtactaccagtcgcgcatccacgacctgcagctccagatccgccaagggacggacaacctcagccgcctcgaggcccagcggaacgtcctcaattcccaagttataacgctgggggaagagttgaaggtgctccatgaaccgggctcatatgttggtgaggttgtcaaggttatgggcaagtccaaggttctagtgaaggtgcacccagaaggaaaatatgttgttgatgtcgataaaagtattgatattacaaagctctcgccttcaacaagagttgctcttcgaaatgacagctatatgcttcatcttatcctgcccagcaaagttgatccattggttaatcttatgaaggttgagaaggttcctgattctacttatgatatgattggcggccttgatcagcagattaaggagatcaaagaggttattgagcttcccattaagcatcctgagctgtttgaaagtcttggaattgcccagccaaagggtgtccttctttacgggcctccgggtacaggaaaaacgctactagctcgggcagttgctcatcacaccgactgtacctttattagggtgtcaggttccgagttggttcagaagtatattggagagggttccagaatggttcgtgaactatttgtgatggccagagagcatgcaccatccataatctttatggatgaaatagactccattggatctgctagaatgcagtcaggatctgggggtggtgatagtgaggttcaacgcactatgcttgagcttctgaatcaacttgatggctttgaagcatcaaacaaaattaaggttcttatggcgacaaataggatggatattttggatcaagctctcctgaggcctggtcgcattgataggaagattgaatttccaaatccgaatgaagattcccgctttgatatcttgaagattcattcaagaaaaatgaacttgatgcgtggcattgatctgaaaaagattgcagagaagatgaatggggcatctggagcagagcttaaggcggtctgcacggaagcaggaatgtttgcccttcgcgagagaagggttcatgtcaaccaggaggatttcttgatggcggtggcgaaggtgatgaagaaggataccgaaaagaacatgtccctgcgcaagctctggaagtgaaggaagctctcatctcgacatccctgtcatatgcctaaacagctgaagctaaacagcgccagcgatgcattgatcgctgtaaattccttaaaacatgtcgagaagggaaacgttcaacatcttacagtagcttcttttaaagttatagaattccttcattggattatcaagatgtgaaatgaaaaggtttagatcaatctctcgctggtgtgatgtaagttcatattgttcactggattggttccaccctctgctcgtgtgtgcacaatttagcccagattttgtagatcaggataagttgccaacttacgcccatattggatcaaactgccaatatcacaatggagaatgttttcgttaacaagctaatatgggtcgccccttcttcttgcgcc

SEQ ID NO: 4251 - DNA, 1780 bp, Solanum phureja
acccccattgccatccctatgtattgttttccctgccaacaaaagaaacgagctttaaaagcccaaaacggatggggaaattttaattgctgctatattcttctttcactcccaaacccaattagtccggacaacgcaaatcactgcgatttcttcaaagcctatctgcaaaaatggcgtcagttgatgttgagaagagcaggagcgatatggagagagaggaagcctgttcggcgaaaccaacaaagcaaggggaagggctgagacagtactatatgcagcacatccatgatctccagctccaagtccgcgtaaagactcacaatcttaatcgccttgaagcccagaggaacgaactcaattctaaagtgagaatgctcaaagaggaattacaattgcttcaggagcctggatcatatgttggtgaagttgttaaagtaatggggaagtcaaaggttctagtcaaagttcatcctgaaggcaaatatgttgtcgatattggcaaaaatattgacattacaaaaatcactccatcaactagagttgccctgcgcaatgatagctatgtccttcatctaattttgcccagcaaagttgatccattggtcaacctcatgaaagttgagaaagtgccagattccacttatgacatgattggtggtcttgaccagcagatcaaggagattaaagaggttattgagcttcctataaagcatcctgagttatttgagtctcttggaatagctcaaccaaagggagtgctgctctatggacctccaggaactgggaaaacattgttggctagggcagttgcacatcacactgattgtaccttcattagggtctctggttccgaactagtgcagaaatatattggagaaggttctcgaatggtgagagagctttttgttatggccagggaacatgctccttctatcatttttatggatgagatagacagcattggatctgctaggatggaatcagggagtggcaatggtgacagtgaagtgcagaggacaatgcttgaacttctcaatcagcttgatggatttgaggcatcaaacaaaatcaaggttctgatggccacaaaccgcatagatattctagatcaagcactccttagaccaggaaggatagacaggaagattgaatttccaaatcccaatgaagagtctcgtcaggacattttgaagattcattcgaggaagatgaacttgatgcgggggattgatttgaagaagattgctgagaagatgagtggtgcttctggggctgaacttaaggctgtatgtacggaagcagggatgtttgctctaagagagaggagggtgcatgtgacgcaagaagattttgagatggctgttgctaaagtaatgaagaaagagactgagaagaacatgtcactgcgaaagctgtggaagtagatgatggtcgatatgaaggacctgaaatgcatacacatctgagttgattgtctataattactattgttcttggaacttttatttgaccccaggagcttacgacttgcccttggtattttcatgtttctcagtaaactgtttcattttctttggccgtatggggcattcacagctgtaattcaaaaatgttaaagtgtttttccgcgcagctttagtatttgacactctggcttctagcttgtattcttgtttattgacatgctgtacttctttttcggctctaacttgaaagccctgcctaggagttgtacttgtactctgtccattttaatttatataacatagtttgatat

SEQ ID NO: 4252 - DNA, 1636 bp, Glycine max
aagttacaagtactattttgtttgttctcctttctaccgacctaacacgagaggagaggagagaagagaggaagttttggggtttgaatctatagaatagaatcaaaccaaattgaaagaagatcgatcgatcgatcgatggctctggtcggagttgaagtgaagcatgcggcggagggcgcaccggaggagaattgctccgccaagcccaccaagcagggcgagggcctccgccactactattctcacaacatccacgagcatcagctccttctccgtcaaaagacgcataacctcaaccgtcttgaggctcagagaaacgagctcaattccagggtgaggatgctgcgcgaagaattacagcttttgcaggaaccaggctcttatgttggtgaagttgtcaaagtcatgggcaagaacaaagtccttgtcaaggtccacccagaaggaaaatatgtcgttgatattgacaaaagtattgacattacaaagattactccatccactagagttgcacttcgcaacgacagttatgttcttcacttagttctgccaagtaaagttgatccattggtcaatctgatgaaagttgagaaggttcccgattctacttacgacatgattggtggtttagaccagcaaattaaagaaataaaagaggtcattgagttaccaatcaaacatcctgagctgtttgaaagtcttggaattgcacaaccaaagggtgtcctgctctatgggccacctggtacaggaaaaacattgttggctagggcagtggctcatcatactgactgtacattcatcagggtgtctggttctgaattagttcagaaatacattggagaaggttctagaatggtcagggaactttttgttatggccagggaacatgctccatcaattatcttcatggacgaaattgacagtattggatctgctcggatggaatctggaagtggcaatggtgatagtgaggtacagcgtactatgctggaacttctcaatcagttggatggatttgaagcttcaaacaagatcaaggttttgatggccacaaatcggattgatatcctggatcaagccctccttagacctggacggattgaccggaagattgaatttccaaaccctaatgaagagtctcggctggatattttgaaaatccattcaagaagaatgaatttaatgcgtggcattgatctgaagaagattgccgagaagatgaatggagcatctggtgctgaacttaaggctgtttgcaccgaagctggaatgtttgcattgagggagcggagggtacacgtgactcaggaggattttgagatggctgtggccaaggtgatgaaaaaggagactgaaaaaaacatgtcattgcggaagttgtggaagtgatttttatttcatgtttgtggtgcacattattatcctgcgaagatgggcagcgaacacaccttagggttatttcaatttacagtggcattggatttcattttgcttaagtttaccaagttatgtaccgaatcatatgattctttctttgagtttttccttgtctgtgtcttcggacggcacactacatttatagagtatttttaaaagatttatattcaagaccactaagtacgtagtctct

SEQ ID NO: 4253 - DNA, 1549 bp, Saccharum officinarum
gaaggggaggagcggcgccgggggagaggggctacggcagtactacctgcagcacatccacgacctgcagctccagatccggcagaagacccacaacctcaaccgcctcgaggcccagcgcaacgacctcaactcccgagttagaatgctcagggaagagttgcagttgcttcaagagcctggttcgtatgttggtgaggtggtgaaggtcatggggaaatcaaaggttctggtgaaggtacatcccgaaggcaaatatgtggtggatctagataagagcattgatatcacaaagatcacaccttcaacaagagttgctcttcggaatgacagctatatgctccatctgatcctaccaagcaaagttgatccattggtcaatctcatgaaagttgagaaggttcctgattctacttatgatatgattggaggccttgaccagcaaattaaagagatcaaagaggtcatcgagcttccaatcaaacacccagagctgtttgagagccttggaattgcccaaccaaagggtgtcctcctttatggacctccgggcacaggaaagacattgctggcacgtgcggttgctcatcacactgactgcaccttcatcagggtgtctggttctgagttggttcagaagtatattggtgagggctcccggatggttcgtgaactctttgttatggccagggaacatgcaccatccattatatttatggatgaaattgactctatcggatctgctagaatggagtctggaactggcaacggtgatagtgaagtgcagcgtaccatgcttgaacttctaaaccagcttgatggttttgaagcatcaaacaaaattaaggttttgatggcaacgaacagaatagacatcttggatcaagcccttctgaggcctggccgcatagacaggaagattgaatttccaaatcccaacgaggattcacgtttcgatatcttgaagatccattcaagaaaaatgaacttgatgcgtggtattgatctgaaaaagatcgcggaaaagatgaatggggcctcaggagctgagctcaaggccgtctgcacagaggctggaatgtttgctctccgtgagagaagggtgcacgttacccaggaggacttcgagatggcagtggccaaggtgatgaagaaagacacggagaagaacatgtccctgcgcaagctctggaagtgaggctcatgccttgttgtacccacctttcccggcctccctgaagctagtgccttcatcttcgtatatctttgccaaagcagtggaatggtgtagcggcatgctctggacctttgcgatgtgctttaagttgtgccgtgcatgcctatatctttaaagttttccttgtaacggttgtagtatgttgcaaagttgaattttatcagatcagctagattacggtactaatgcattgctagctcgcgatgtactgcgttccacttcctacgcagtttgccagctcactcgtaatgaacactgcataatggttactgctctgatctgattatccatgcgatgttctctttggtgtgt

SEQ ID NO: 4254 - DNA, 1563 bp, Triphysaria pusilla
ggccaggacgaaaccctcttcttacttattccccgatctcctcagagaccaagcttcggtgcatcatatagaatggcaacggtggcgataaagactaggccagcggatcaatcgaagcaaacccaccagcaaggcgccgcggccgtcagtggtgaagggctccgacagtactatcagcagcggatacaggatgtgcagctattagtccgtcaaaaagttcacgatctgcagagactggaagctcaacgcaatgacctcaatgcccgagtgagatctctgaaggaagagttgcagcttcttcaggagcctggatcttatgttggtgaagttgtcaaagttatgggaaaatcgaaggttctcgttaaggtccatcctgaagggaagtacgtggttgatatcgacaagagcattgacatcactaagattacaccttcaacgagggttgctttacgtaatgacagctatgtgctccacttggtcctgcctagtaaagttgatccgttggtgaaccttatgaaagtagaaaaagttccagattccacttatgacatgattggtggtcttgaccagcaaattaaggagattaaagaggtgattgaacttccgatcaaacatcctgaattgtttgagagtcttggaatagcccagcctaagggagtgttgctatatggtccacctggtacgggtaagactttgcttgcaagggcagtggctcaccataccgactgtacttttatccgagtttcaggctctgaattagttcagaagtacattggagaaggatctaggatggtgagagaactttttgtgatggccagagagcatgctccgtccatcatcttcatggatgaaatcgatagcattggatctgctcgtatggaatctggaagtggaaatggggatagtgaagttcagagaactatgcttgagcttctcaatcaacttgatggatttgaggcatctaataagatcaaagtattgatggctaccaatagaattgacattctggaccaagctcttcttaggcctggaagaattgataggaaaattgagtttccaaatcccaacgaagactctcggggtgatattttgaagattcactcgaggaaaatgaatttaatgagagggattgatctgaagaagatcgctgagaagatgggcggtgcatctggtgcagagcttaaggctgtttgcacagaagctggaatgtttgctctgagagagaggagagttcatgttactcaggaggactttgagatggccgttgcaaaggtcatgaagaaggaaactgagaagaacatgtctctgaggaagctttggaagtagattgtgatgaattagaaacctaagcgttgatgttgatgagctctgggcaaattcgggttattgaacaattaatgcatcaatagtatgttatgtcgaattacgataacccttggaaaaacatgtttttgtctacttgtggttgtggacttgcaccgataataccttcaaatttatttgatatgatgttttcagcttttgcgaaaacttgtcatttacagtaaaaaaaaaaaaaaaaaa

SEQ ID NO: 4255 - DNA, 1527 bp, Brassica napus
gatcgaaactcagataactattctctctttctcctccttctgggtttcatcaaaatcacaaatactcgcgacaatcattgagaggatatggctgccgtaggagtggagtcgatgcgtcccgagtcagcgatggaggaaacctgcaacgtcaagatagcggcggcgaaacaaggggaggggcttaagcagtactatctccagcacatccatgagctccagcgccagctccgccagaaaactaacaacctcaatcgccttgaagctcagaggaatgaactcaattctcgagtacgaatgctcagagaagagttgcagctgcttcaagaacctggttcctatgtcggtgaagtggtcaaagtgatggggaaaaacaaggtcttggttaaggttcatccagagggtaagtatgttgttgatattgacaaaagcatagacataacgaagatcacaccatcaacaagagttgctctccgtaacgatagctatgttctccacctcgtcctgccaagtaaagttgatccgctggtcaaccttatgaaagttgagaaggttcccgactccacatatgacatgattggtggtcttgaccagcaaattaaagaaattaaggaggtcattgagctgcctatcaagcatcctgaattgttcgagtctcttggaattgcgcagccaaagggtgtgttgttatatggtccacctggaactgggaagacacttttggctcgagctgtagcacatcacactgactgtacgttcatcagagtttctggttccgagctggtccagaaatacattggagaaggttctagaatggtcagagaactcttcgtgatggcaagggagcacgcaccatcaatcatcttcatggatgagatcgacagtattgggtctgctcgtatggaatctggaagtggaaatggtgacagtgaggtccaacggactatgcttgagcttctcaatcaacttgatggattcgaagcgtcaaacaaaatcaaggttctgatggcgacaaatcgaattgatattctggataaagctcttctcaggccaggaaggattgataggaaaatcgaattccctaatcctaatgaagattcacgttgtgatatcttgaagattcactcgaggaaaatgaatctgatgcgtgggattgatctgaaaaagatcgcagagaagatgaatggtgcttcaggtgctgaactgaaggctgtgtgcacggaggcgggcatgtttgctctgagggagaggagagtacacgtgacacaggaagactttgagatggcggtggcgaaggttatgaagaaagacacagagaagaacatgtctttgcgtaagctctggaagtaggaatctctttcgtttgtactctaaaagggagagccacctgagaaataaggggtttcttttttatcacgtgtggttctttatgtttcttctttaagcctttgaacaaagtgtgtatttactgcctaaacactagtttaatgttcccgtatttcatcctttaccaacttagagactattatt

SEQ ID NO: 4256 - DNA, 1616 bp, Brassica napus
ggtatttgactttatatgtaagtaatgtttgcgtcgtgagagggttttcagattccgatcgaaaaataactattctctctatctcctccttctgggtttcatcaacatcacaatactcgcgacaatcattgagaggatatggctgccgtaggagtggagtcgatgcgtccggagactgcgatggaggaaacgtgcaacgtcaagatagcggcggcgaaacaaggggagggacttaagcagtactatctccagcacatccatgagctccagcgccagctccgccagaaaactaacaacctcaatcgcctcgaagctcagaggaatgaactcaattctcgagtacgaatgctcagagaagagttgcagctgcttcaagaacctggctcctatgttggtgaagtagtcaaagtgatggggaaaaacaaggtcttggttaaggttcatccagaggggaagtatgttgttgatattgacaaaagcatagacataaataaaatcacaccatcaacaagagttgctctccgtaacgatagctatgttctccacctggttctcccgagtaaagttgatcccttggtcaaccttatgaaagttgagaaggttcccgactctacatatgacatgattggtggtcttgaccagcaaattaaagaaattaaggaggtcattgagctgcctatcaagcatcctgaactgttcgagtctcttggaattgcgcagccaaagggtgtgttgttatatggtccacctggaactgggaagacacttttggctcgagctgtggcacatcacactgactgtacgttcatcagagtttctggttcagagctggtccagaagtacattggagaaggttcaagaatggtcagagaactcttcgtgatggcaagggagcacgcaccatcaatcatcttcatggatgagatcgacagtattgggtctgctcgtatggaatctggaagtggaaacggtgacagtgaggtccaacggactatgcttgagcttctcaatcaacttgatggattcgaagcgtcaaacaaaatcaaggttctgatggcgacaaatcgaattgatattctggatcaagctcttctcaggccaggaaggattgataggaaaatcgaattccctaatcctaatgaagattcacgttgtgatatcttgaagattcactcgaggaaaatgaatctgatgcgtgggattgatctgaaaaagattgcagagaagatgaatggtgcttcaggtgctgaactgaaggctgtgtgcacggaggcgggcatgtttgctctgagggagaggagagtacacgtgacacaggaagactttgagatggcggtggcgaaggttatgaagaaagacacagagaagaacatgtctttgcgtaagctctggaagtagaggaatctctttcgtttgtactcaaaaagggagagacacagattcatttcagacctgagaaataagggtttcttttcatcacgtgtggttctctatgtttcttctttaagcatttgaacaaagtgtgtttactgcctaaaacactagtttaatgttctcaagcataacagttcccttatttcatcctttgtcaacttagagattattattcgaactga

SEQ ID NO: 4257 - DNA, 1547 bp, Cirsium arvense
cgggggatcaacactcctcgctttgaacaccgaatactgaatcaaatctccattgaaaccaaattcttcaagtttcacgaattctccatctgataaacaagaatggcggcagcggatatagcgatgaaaccagcggattcaggggaaaaacacgaaatctgttcatcaaagcacacgacggcgaaacagggtgaaggtttgaggcagtattacttgcagcatatccacgatgctcagctccaggttcgccagaagagtcataatctcaatcgtcttgaagctcagcggaatgacctaaattctcgagtaaggatgcttaaggaagagttgcaactccttcaagagcccggatcttatgttggtgaagttgtcaaagtaatgggaaaatcgaaggtcctagtgaaggtgcacccagagggtaaatacgtggttgatattgataaaagcattgatattaccaagattacaccatcaaccagggttgcacttcgcaatgatagctatgtccttcatttggttttgccaagcaaagtagatcctctagtgaaccttatgaaagttgagaaggttcctgattctacatatgacatgattggtggacttgaccagcaaattaaagagatcaaggaggttattgaacttccaatcaaacatccggagttatttgagagtctgggaattgctcaaccaaagggagttctattatatggcccaccaggtactgggaagacattgttggccagagccgtggcgcatcatactgattgtactttcatcagggtctctggttctgaactagtacagaaatatatcggagaaggttccagaatggttagagaactttttgttatggccagggaacatgcaccatcgatcatatttatggatgaaattgacagtattggatctgctcggatggaatctggaagcgggaatggtgacagtgaagttcaacgaacaatgctggagcttctcaatcaacttgatgggtttgaagcatcaaacaagatcaaggttttgatggctacaaatcgtattgatatcctagaccacgctcttctcaggccaggaagaattgacaggaagattgaattcccaaatccaaatgaagactcgaggtttgacatcttgaaaattcattcaagaaagatgaacttaatgcgtggcatcgatctgaaaaagattgctgaaaagatgaatggtgcttcaggtgcagaacttaaggcggtatgcacggagggagggatgtttgctttgagagaaaggagagttcatgtgacacaagaagatttcgagatggcagtggccaaggttatgaagaaggaaacagagaagaacatgtcgctacgcaagttatggaagtaaaattgttggtttggaattgtgtcttttcggacttttcttttagttgatgtaatgtaatttttccctaaagtattctgacaccaacaagaagcgataaaacgcacaagaattcaaacacaccattacttgaataccaatccgattaaggagttaacgcgtactctacaagatacatgcagaaa

SEQ ID NO: 4258 - DNA, 1691 bp, Rosa hybrid cultivar
aaagaaaccctctcccataaataaacaagctctctcactttagttgaacccaaacgacatcaaactctgagaaacccccaaatctcaaatctcacatctttcgatttcgattcgaataacaacaacaacaacaagactagggcttttgcttgatcgcgatggctgccgtcggcgtcgagaccaagcccgtcgaggccttgccggaggacacctgctccgccaagctcgccgcctccaaactcggcgaggggctccgcccttactatctccaacacattcacgagctccagctccaggtccgccagaagacccacaatctcaatcgactcgaggctcagcggaacgagctcaattccagagtgagaatgctcagggaagaactacaacttcttcaggagcctgggtcctatgtcggtgaggttgtcaacgtcatgggaaagaacaaggttttggttaaggttcatccggaagggaagtatgtggttgatattgataagaacattgatatcacaaagatcacaccatctacaagagtggctctacgcaatgacagctatgttcttcatttagtgctgccaagcaaagtagatcctctcgtcaatctgatgaaagtggaaaaggttccagattctacatatgatatgattggtggtctggatcagcagattaaagaaatcaaagaggtcattgaacttccaattaaacatcctgaattgtttgaaagtcttggaatagctcagccaaagggagtcctgctttatggtccccccggcactggcaaaaccttgttggctagggccgtggctcatcacactgactgtactttcatcagggtttctggttcagagttggttcagaaatacattggggaaggttcccgaatggttagagaacttttcgtaatggccagggaacatgctccatctatcatttttatggatgaaatcgatagtattggatctgctcgcatggaatctggcagtggcaatggggacagcgaggtgcagaggactatgcttgagcttcttaaccaactggatggatttgaggcctcaaacaaaatcaaggttttgatggctacaaatcgtattgatattctggatcaagccctgctgaggccaggacgcatagacagaaagatcgaatttcccaaccctaacgaagagtctcgttgggacattctgaaaatccattcaagaagaatgaatttaatgcgtggaattgacctgaagaagattgcggagaaaatgaacggcgcctctggcgctgagttgaaggcggtttgcactgaagcaggaatgtttgcactgagggagaggagagtgcatgtaacccaagaagactttgagatggcagttgccaaggttatgaagaaggagacggagaagaatatgtccctgcgtaagctgtggaagtgatgtgttagttgttactgctttatcttgccaagttcctttgtttgtttgggatatttttggtacaaatttcagtgattaccagacttgaatgtctacatcatctactcagcttcaatttcaccttccactagtaaactattggatacagcaatcattgagtgtcgatgtgatctggttagttggatcatgaatggagaaggcattgaattatgaactgcaaaaagtctttcttattcggtggaggatcattgaatttcttagtttatattgtaa

SEQ ID NO: 4259 - DNA, 1616 bp, Helianthus annuus
gtgacaactgaacatacatgatacaacacgaaccctataaaaagcagaaaaaaaaagaaaaagaaaaatccttttcttgatcaacaatcttcttcttcatcttcatcaaataaaaaaacctgcaacttcaaatacacatcttatcaaaactaatggcgacagcggacatatcgatgaaaccggcggattcaggagagaaaaacgagacctgttcttcgattatttcgtctgcgaaacaaggtgaaggtctgaagcagtattatctgcaacatattcatgattctcagcttctggttcgtcagaagactcataatctcaatcgccttgaggcgcagcgtaacgagcttaattcgcgagtaaggatgcttaaggaagagttgcagctgcttcaagagccaggatcctatgttggtgaagttgtcaaagtaatgggaaaatcaaaagttctagtcaaggtgcacccagagggtaaatatgtggttgatattgataaaagcatcgacatcactaagattacaccatcaaccagagttgctcttaaaaacgatagctacgttcttcatttagttttaccaagcaaagtagatcctctggtcaaccttatgaaagtcgaaaaggttcctgattctacatatgacatgatcggtgggcttgaccagcaaatcaaagagattaaggaggttattgaacttccaatcaagcatccagagttatttgagagtcttggtattgctcaaccaaagggtgttctgttatacgggccaccaggtactgggaagacgctgttggcgagagcagtggctcatcatacggattgtactttcattagggtttctggttctgaattagtacagaaatatattggagaaggttccagaatggttagagaactttttgtaatggccagagaacatgccccgtcgatcatctttatggatgaaattgacagtattggatctgctcgaatggaatctggaagtgggaatggtgatagtgaagtccaaagaacaatgctggagcttcttaatcaactcgatggattcgaagcatcaaacaagatcaaggttttgatggctacaaatcgtattgatatactcgatcaggcccttctcaggccaggaagaattgacaggaaaatcgagttcccgaatccaaatgaagattcgaggttcgatatcttgaaaattcattcaagaaagatgaacttaatgcgtggcattgatctgaaaaaaattgctgagaagatgaacggtgcttcgggtgcagaacttaaggcggtttgcacagaggcggggatgtttgcattgagagaaaggagagtgcacgtgacacaagaggatttcgagatggctgtggccaaagtcatgaaaaaggaaaccgagaaaaacatgtcacttcgcaagctctggaaataagtaacggttaccaaccgttttttttcttttatgtcgttgaattagttgttaatgtaatttcagtttgcatcgttaaagatttggaatttgtgttcatgctatagatataacacaatatatatttgttaacctcacccatggttaaccaacaactggcttacctgactcgatttttgtttactgtagggtagagaagaccta

SEQ ID NO: 4260 - DNA, 3230 bp, Brassica rapa
gaagaagaagatgtcttgttggataagccaagattccaaattataagagggcattatttgctaaatgctctcgtcgtccctgtgatccgatccatcgtcgtctccaatactagatctctctctctctctctcgctcgcgtcgataatttgtgataaaaatggcagccgtaggaatcgagacgaggcgtcctgagggtgcgatggaggaaacctgcaacgtgaagggagcggtggcgaaacaaggagaggggcttaagcagtactatctccagcacatcgacgagctccagcgacttctccgccacaaaactaacaacctcaatcgcctcgaagctcagaggaacgatctcaactctcgagtacgaatgctgagagaagagttgcagctgcttcaggaacctgggtcctatgtgggtgaagtggtcaaagtgatgggaaaaaacaaggtcttggttaaggttcatccagaggggaagtatgttgttgatattgacaaaagtatagacataactaaacttaccccatctacaagagttgctctccgtaatgatagctatgttctccaccttgtcctgccaagtaaagttgatcccctggttaacctaatgaaagttgagaaggttcctgactccacttatgacatgattggtggtcttgaccagcaaattaaggaaattaaggaggtcattgagcttccaatcaagcatcctgaattgtttgagtctcttggaatcgctcagccaaagggtgtgttgctatatggtccacccggaactgggaagacacttttggctcgggctgtggcacatcacactgactgtaccttcatcagagtttctggttcggagctggtccagaaatacattggagaaggttctagaatggtcagagaactttttgtgatggcaagggagcatgcaccatcaatcatctttatggatgagatcgatagtattgggtctgctcgtatggaatctggaagtggaaacggtgacagtgaagttcagcgtactatgcttgagcttctcaatcaacttgacgggttcgaagcgtcaaacaaaatcaaggttttgatggcgacaaatcgtattgatattctggatcaagctcttctcaggccaggaaggattgataggaaaatcgaattccccaatcctaatgaagattcacgttgtgatatcttgaagatccactcgaggaaaatgaacctgatgcgtggaattgatctgaaaaagattgcagagcagatgaatggtgcttcaggtgccgaactgaaggctgtgtgcacggaggcgggaatgtttgctctgagggagaggagagtacacgtgacacaggaagactttgagatggcagtggcgaaggttatgaagaaagacacagagaagaacatgtctctgcgtaagctctggaagtaggaatctctctgttctgttctctgttattccaagaatcttttctgtttcttctttaagcgtttgaaaacaattttttttactgcctaaacgctagtgtgtacttgaatgtacgcataccagttccgagttcatcgtcttcaaactaagagatattattcaagaaagacacccctccattgggcacactaagataacatgtactttgtttatatgaaacccactatggaatcaaaaggtataatctaaaaggatcagggtatatgcaaagtgtgaaatgtgagcttatatgacgggttttacacattcactttgttgaatttcaacatgttgtatgtgctctacctaaccagcaaaccgtcgattaccctagcttcaagctcgtcattgttggtgacggaggcacaggaaaaacaactttcgtcaagagacatcttactggagagttcgagaagaagtatgaacctactattggtgtggaggttcatcctctagatttcttcacaaactgtggcaagatccgtttctactgctgggacactgctggtcaagaaaagttcggtggccttagagatggttactacatccatggtcaatgtgcggttatcatgttcgacgtgacagcgcggctcacatacaagaacgtccccacgtggcaccgtgacctctgccgtgtgtgtgagaacatccccatcgttctctgcgggaacaaggtcgatgtgaagaacaggcaagtgaaggctaagcaggtgacgttccacaggaagaagaatcttcagtactacgagatctccgcgaagagtaactacaactttgagaagcctttcttgtacctcgctaggaagctcgctggtgaccagaaccttcactttgttgagtcgccggctcttgctccccctgaggttcacattgacgttgctgagcagcagaggaacgaggctgatctcattgccgcagccgctcagcctcttccagatgatgatgatgatgcttttgagtaaaagaagagcttcttccactatgtctgccatgggaagctgtttgcgttgtctgattctctatttgtgtttttttttttggtttttttaacatgttgggggaaatattgtttaagattgtttcgttttggaatagagcagcgacttgtctttgaacccaaaatgagatatgagaatcaagtaacaccacaataaaaaaaaagaaatatgttcaaaagggatatttgtacaaactactctttaacatttattctatgtaacacaatgttgtagttgtgaatgatgattctatctgtaagtagtgctgttgtcatcagagatgaggttttttatctgcatcagatgttcctcatttgatatgttcaatctcaagcggagatttgtgatccaggtttcttgttcccatgttatgttaggtcctgatgcatgcagtctctcaatgctggatcggtattcatccagctctaacctatgaacatcaccagcttctgagtctttcgctggtgaactcaacttcttgttcttgatgcttctgtggcggccacaagaggatgactctgtgtcactagagttactggtttctatgggaccgaaagagacagtgcttaaaccgtccatgttacaactgccaacagaagatgcaacactctctctatcgtcttcttgttcttctgttcttttaagaaactttagcggattgtgcggttcaaccaaagagtaggtccgtttctttggacctttcgtcgaaagtacatgagactcattgagcttgtgtttgctctcaaatgaaacatactcgccttttagatacgccttt

SEQ ID NO: 4261 - DNA, 1363 bp, Brassica rapa
aagtaatgtttgcgtcgtgagagggttttcagattccgatcgaaaagaaaactattctctcatcaacatcacaatactcgcgatactcattgaggatatggctgccgtaggagtggagtcgatgcgtccggagacagcgatggaggaaacctgcaacgtcaagatagcggcggcgaaacaaggggagggacttaagcagtactatctgcagcacatccatgagctccagcgccagctccgccagaaaactaacaacctcaatcgcctcgaagctcagaggaatgaactcaattctcgagtacgaatgctcagagaagagttgcagctgcttcaagaacctggctcctatgttggtgaagtagtcaaagtgatggggaaaaacaaggtcttggttaaggttcatccagaggggaagtatgttgttgatattgacaaaagcatagacataaataaaatcacaccatcgacaagagttgctctccgtaacgatagctatgttcttcacctcgtcctgccaagtaaagttgatccgctggtcaaccttatgaaagttgagaaggttcccgactctacatatgacatgattggtggtcttgaccagcaaattaaggaaataaaagaggtcattgagctgcctatcaagcatcctgaactgttcgagtctcttggaattgcgcagccaaagggtgtgttgttatatggtccacctggaactgggaagacacttttggctcgagctgtggcacatcacactgactgtacgttcatcagagtttctggttccgagctggtccagaagtacattggagaaggttctagaatggtcagagaactctttgtgatggcaagggagcatgcaccatcaatcatcttcatggatgagatcgatagtattgggtctgctcgtatggaatctggaagtggaaacggtgacagtgaggtgcaacggactatgcttgagcttctcaatcaacttgatggattcgaagcgtcaaacaaaataaaggttctgatggcgacaaatcgaattgatattctggatcaagctcttctcaggccaggaaggattgataggaaaatcgaattccctaatcctaatgaagattcacgatgtgatatcttgaagattcactcaaggaaaatgaatctgatgcgtgggattgatctgaaaaagattgcagagaagatgaatggtgcttcaggtgctgaactgaaggctgtgtgcacggaggcgggcatgtttgctctgagggagaggagagtacacgtgacacaggaagactttgagatggcggtggcgaaggttatgaagaaagacacagagaagaacatgtctttgcgtaagctctggaagtaggaatct

SEQ ID NO: 4262 - DNA, 1486 bp, Raphanus sativus
  misc_feature (63)..(63): n is a, c, g, or t
  misc_feature (99)..(99): n is a, c, g, or t
  misc_feature (206)..(206): n is a, c, g, or t
  misc_feature (218)..(218): n is a, c, g, or t
  misc_feature (257)..(257): n is a, c, g, or t
  misc_feature (350)..(350): n is a, c, g, or t
  misc_feature (1073)..(1073): n is a, c, g, or t
  misc_feature (1472)..(1472): n is a, c, g, or t
atcgtcgtcgccaatactagatcgctcgctcgctctcgtcgataattttcgcaaccaccgacnaaaaaatggcggccgtaggaatcgagtcgaggcgtnccgagaccgcgatggaggctgaaacctgcaacgtcaagggagcggtggcgaaacaaggagaggggcttaagcagtactatctccagcacatcgacgagctccagcgncttctccgccanaaaactaacaacctcaatcgcctcgaagctcagaggaangatctcaactctcgagtacgaatgctgagggaagagttgcagctgcttcaggaacctggctcctatgtgggtgaagtggtcaaagtgatgggnaaaaacaaggtcttggttaaggttcatccagaggggaagtatgttgttgatattgacaaaagcatagacataacgaagcttacaccatcaacaagagttgctctccgtaatgatagctatgttctccaccttgtcctgccaagtaaagttgatcccctggttaaccttatgaaagttgagaaggttcctgactccacttacgacatgattggtggtcttgaccagcaaattaaggaaattaaggaggtcattgagctaccaatcaagcatcctgaattgtttgagtctcttggaatcgctcagccaaagggtgtgttgttatatggtccacctggaactgggaagacactcttggctcgggctgtggcacatcacactgactgtacgttcatcagagtttctggttccgagctggtccagaaatacattggagaaggttctagaatggtcagagaactttttgtgatggcaagggagcatgcaccatcgatcatattcatggatgaaatcgatagtatcgggtctgctcgtatggaatctggaagtggaaacggtgacagtgaggttcagcggactatgcttgagcttctcaatcaacttgacggtttcgaagcgtcaaacaagatcaaggttctgatggcgacaaatcgtatagatattctggatcaagctcttctcaggccaggaaggattgataggaaaattgaattcccaaatcctaangaagattcacgttttgatatcttgaagatccactcgaggaaaatgaatttgatgcgtggaattgatctgaagaagattgcagagaagatgaatggtgcttcaggtgctgagctgaaggctgtgtgcacggaggcaggcatgtttgctctgagggagaggagagtacacgtgacacaggaagactttgagatggcggtggcgaaggttatgaagaaagacacagagaagaacatgtctctgcgtaagctctggaagtaggaatatcaatctgttctctgttctttccagaatctcttctgtttttttctttaagcgtttgaaaacagagtttttttttactgcctaaacactattgtgtacttgaaatgttagcataccagttccgagttcatcgtgttnaactaagagagatt

SEQ ID NO: 4263 - DNA, 1570 bp, Raphanus sativus
  misc_feature (24)..(24): n is a, c, g, or t
  misc_feature (43)..(43): n is a, c, g, or t
  misc_feature (46)..(46): n is a, c, g, or t
  misc_feature (68)..(68): n is a, c, g, or t
  misc_feature (278)..(278): n is a, c, g, or t
  misc_feature (752)..(752): n is a, c, g, or t
  misc_feature (1478)..(1478): n is a, c, g, or t
tccgatcgaaaacaacaacactgntctctctttctccttgtgngtntcatcaacatcatcacaatacncgcgacgatcattgaggagaggatatggctgccgtaggagtggagtcgatgcgtccggagactgcggtggaggaaacctgcaacatcaagataggggcggcgaaacaaggggaggggctcaagcagtactatctccagcacatccatgagctccagcgccagctccgccagaaaactaacaacctcaatcgccttgaagctcagaggaangaactcaattctcgagtacgaatgctcagagaagagttgcagctacttcaggaacctggttcctatgtcggtgaagtggtcaaagtgatgggaaaaaacaaggtcttggttaaggttcatccagaggggaagtatgtcgttgatattgacaaaagcatagacattacgaaaatcacaccatcaacaagagttgctcttcgtaacgatagctatgttctccacctcgtcctgccgagtaaagttgatccgctagtcaaccttatgaaggttgagaaggttcccgactctacatatgacatgattggtggtcttgaccagcaaattaaggaaataaaggaggtcattgagctgccaatcaagcatcctgaactgttcgagtctcttggaattgcgcagccaaagggtgtgttgttatatggtccacctggaactgggaagacacttttggctcgagctgtggcacatcacactgantgtacgttcatcagagtttctggttccgagctggtccagaagtacattggagaaggttctcgaatggtcagagaactctttgtgatggcaagggagcatgcaccatcaatcatcttcatggatgagatcgatagtatcgggtctgctcgtatggaatctggaagtggaaacggtgacagtgaggtgcaacggactatgcttgagcttctcaatcaacttgacggattcgaagcgtcaaacaaaatcaaggttttgatggcgacaaatcgtattgatattctggatcaagctcttctcaggccaggaaggattgataggaaaatcgaattccccaatcctaatgaagattcacgttttgatatcttgaagattcactcgaggaagatgaatttgatgcgtggaattgatctgaagaagattgccgagaagatgaatggtgcttcaggtgctgagctgaaggcggtgtgcacggaggcgggtatgtttgcgctgcgggagaggagagtacacgtgacacaggaagactttgagatggcagtggggaaggttatgaagaaagacacagagaagaacatgtctttgcgtaagctctggaagtaggaaggatatatctctgtgttattgcatgtggtttttctctgaaataatttatgtttgttctctttaagcatttgaaaacaaagttgtttactgcctaaacaccaaatgttcttaagcataacagtntccgatttcatccttgtcaactaggagattatattaatcgagaaagaaacaccagagtgcatcaagataataacatgaacagttttgatcca

SEQ ID NO: 4264 - DNA, 1389 bp, Gossypium hirsutum
agaggaagcaaccggcaacggcggaagagatgtgcactgccaagagcggcgccaagcaaggggaaggcctccgccaatactatctccaacacatccacgagctccagctcaacctccgccaaaaaacccacaatctcaatcgtctcgaagcccagcgcaatgagctcaattctcgagtgagaatgcttagagaggaactgcagctgcttcaagagcctggatcctatgttggtgaggtcgtgaaagttatgggtaaaaacaaagttttagtcaaggttcatcctgaaggaaaatatgttgtcgatattgataagagtattgatatcacaaaaatcactccatcaacaagagttgctcttcgcaatgacagctatgtcttgcatctgatcttaccaagcaaagttgatcccttggttaatcttatgaaagttgaaaaagttccagattctacatatgacatgattggtgggcttgaccagcaaattaaagagataaaagaggtcatagaacttcctattaaacatcctgaattgtttgaaagtcttggaatagcccagcccaagggtgttctgctgtatggaccacctggtacaggaaaaactctgttggctagagctgtggcccatcatactgattgtactttcatcagggtttctggttctgaattagttcagaaatacattggtgagggctctcggatggttagagagcttttcgtcatggccagggagcatgctccatcaatcatatttatggatgagatagacagtattggatctgctcgaatggaatctggaagtggcaatggtgacagtgaggtgcagaggaccatgttggagcttctcaaccagctggatggatttgaagcatctaacaagatcaaggttctgatggctacaaatcggattgatatcttggatcaagctcttcttaggccaggccgaattgacaggaagattgaatttccaaacccgaacgaggagtctcgtcaggacatcttaaaaatacattctagaagaatgaatttgatgcgggggattgacctaaagaagattgctgagaagatgaacggtgcttctggtgcggagcttaaggcggtttgcacagaagcagggatgtttgctttgagggaaaggagagtccacgtaacacaggaagattttgagatggcagtagcgaaggtgatgaagaaggagaccgagaaaaacatgtccttacgaaagctgtggaagtgattaagctttattttcattattgtgctttgttatgggcaaaaagtggatggaacgtgtaaaactagacttatacagtgacattagaataccgaacgcctgttttctttgacaaaagcctgtcctacaaaatttgcaggtaaaggacttagatttt

SEQ ID NO: 4265 - DNA, 1718 bp, Papaver somniferum
caatggcgacactggaagtcgacacatatcaaccagaaacaacccaaaaagatgcagtctgtacctcaggagcaagtcttggtgaaggtttgaagagatactatgaacaacacattcacgatctagtactcttggagcaaagcaaaactaatgacctaaatcggttagaagctcaaaggaatgattttaactccaaagtgaggatgcttagggaggagctgcagcttcttcaggaacctggatcctatgttggtgaagtagtgaaagttatgggcaaatccaaggttttagtaaaggttcatccagaaggaaagtatgtcgttgatattgataagagcattgatatcacaaaactcacaccaacaaccagagttgctctccgtaacgatagctatgttcttcacttaatcttgcctagcaaagtagatcctcttgtcaaccttatgaaagttgagaaagttcctgactctacctacgatatgattggtggtctagaccagcaaatcaaagagattaaagaggtcattgagctgccaataaaacatcctgaattgtttgaaagtcttggaatagctcaaccaaagggagtcttgctgtatgggccacctggtacaggaaaaacattgctagcaagggcagttgctcatcatactgactgcacttttatcagggtttctggttctgaattagtccagaaatacattggagaaggttctagaatggttagagagctctttgtcatggccagagaacatgccccatcaatcatttttatggatgaaattgatagcattggatctgcgcgaatggaatctggaagtggcaatggtgatagtgaagtgcagcgtaccatgcttgagcttcttaatcaactcgacggatttgaagcatcaaacaagatcaaagttttgatggctacaaatcgaattgatattctggatccagcacttcttaggcctggtagaatcgacagaaagatcgaattcccaaatccaaacgaagattcccgtgccgatatcctaagaattcattcaagaaggatgaacttgatgcgaggcattgatttgaagaagatagcagagaagatgagtggtgcctctggtgcagaacttaaggctgtatgcacagaagctgggatgtttgctctaagggaaaggagagtgcatgtaacacaagaagattttgagatgtctgtggccaaggtaatgaagaaggaaacagacaagaacatgtcacttcggaagctgtggaaatagattttctgcattcagtatatctttttccagcgacaaaatggaacagcaaagaattcaaagaagagaagatacttatctctcaatcagtcaaatgaacagagaaaccaaggagaaaaccatgcagccatgtcttcctgaggttgtcaaactaagattggcctgtgtatgttcatgggctattggcagcttgaccaacccactaaactgaggaacatattttttactctcagactcttcagagtgttttcagaatatgaattattgggtttttagttttaagaaaaacgctcaaaactgcaaaaccatagaaaaatttgttaaaaaggaagtattccgtatcgttgtttgtgacttgagttgaccctggttatcaatggggttgcttaagattggtattacgtttgttttagtttaaacactggaaataaagcagcacctgatgtgatattgcagtttctctga

SEQ ID NO: 4266 - DNA, 1569 bp, Fagus grandifolia
acagagctagcctagcaccgagctattattaaaagaagtgaaacaaatagagcaacttttttcaattcagatcgcaaatcgaaaccctaactcattccgatggcgatcgaaacgaaacatccggaggcggtgccggcggacgagacttgctcggcgaaggcgtccaagcaaggggagggtctcaagcagtactatctccaacacattcacgagcaccagctccaggttcgccaaaagacccacaatctcaaccgcctcgaggcccagcgtaacgagttcaattctcgagtgagaatgctaagggaagaactacagctactccaggagcctggatcatatgttggtgaagttgtcaaagtaatggggaagaataaggttttagttaaggttcatcctgaaggaaaatatgttgttgacatcgataaaaatattgacatcacaaagataactccatcaacaagagttgctcttcgcaatgacagttatgtgcttcatttaatcttgccaagcaaagttgatcctttggtcaacctaatgaaagttgaaaaggttcctgattcaacatatgacatgattggtggtcttgaccagcaaattaaagagataaaggaggtcattgagcttccaatcaaacatcctgaattatttgagagtcttggaatagctcaaccaaagggtgtcctgctatatgggccacctggtacagggaaaacgctgttggctagggcagtggcacatcatacagattgtactttcatcagggtttctggttctgaattagttcagaagtacattggagaaggttccagaatggttagggaacttttcgttatggccagggaacatgctccatctatcatatttatggatgaaatagacagtattggatctgctcgaatggaatctggtagtggcaatggtgatagtgaagtgcagcggactatgctggagcttctcaaccagctggatggatttgaagcatcaaacaaaattaaggttctgatggctacaaatcgtattgatattctcgatcaagctctccttaggccagggcgaattgataggaagattgaatttcctaatcctaacgcggagtctcgatttgatattttaaaaatacattcaagaagaatgaatctgatgcgtgggattgacctgaagaaaatagctgagaaaatgaacggtgcatctggtgcagagctcaaggctgtgtgcacagaagctgggatgtttgctctgagggagaggagggttcatgtaacacaagaagattttgagatggcagtagcaaaggtaatgaagaaggagaccgagaaaaacatgtcattgcggaagctatggaagtagtgttcttatagattactgtttgtttcactccaccatcccttgaaccatttgatctgtggagtcgtcattcacacacaaaaccaagagttgtgttcttctatgtatgggtataaaaaactagatgacggtgcctacactctgttgttgaagttttaaagtaccactggcatctttgtttattttattagttatatattcttttgtgatacatctttagattat

SEQ ID NO: 4267 - DNA, 1722 bp, Solanum lycopersicum
ccaatccaggacccccattgctatccccatgtattgttttcccttccaacaagaaacgagctttaaaatccccaaaccgatgcgggaaattccaattgctgcgctatattcttctttcagtgccaaacccaattagtccggacgacgcaaatcacagcgatttcttcaaaacctatctggaaaaatggcatcagttgatgttgagaagaggaggagcgatatggagagagaggaagcctgttcggccaaaccaacaaagcaaggggaagggctgagacagtactatatgcagcacatccatgatctccagctccaagtccgcgtaaagactcacaatcttaatcgccttgaagcccagaggaacgaactcaattctaaagtgagaatgctaaaagaggaattacaattgcttcaggagcctggatcatatgttggtgaagttgttaaagtaatggggaagtcaaaggttctagtcaaagttcatcctgaaggcaaatatgttgttgatattggcaaaaacattgacattacaaagatcactccatcaactagagttgccctgcgcaatgatagctatgttcttcatctaattttgcccagcaaagttgatccattggtcaacctcatgaaagttgagaaagtgccagattccacttatgacatgattggtggtcttgaccagcagatcaaggagattaaagaggttattgagcttcctataaagcatcctgagttatttgagtctcttggaatagctcagccaaagggagtgctgctctatggacctccaggaactgggaaaacattgttggctagggcagttgcacatcacactgattgtaccttcattagggtctctggttccgaactagtgcagaaatatattggagaaggttctcgaatggtgagagaactttttgttatggccagggaacatgctccttctatcatttttatggatgagatagacagcattggatctgctaggatggaatcagggagtggcaatggtgacagtgaagtgcagaggacaatgcttgaacttctcaatcagcttgatggatttgaggcatcaaacaaaatcaaggttctgatggctacaaaccgtatagatattctagatcaagcactccttagaccaggaaggatagacaggaagattgaatttccaaatcccaatgaagagtctcgtcaggacattttgaagattcattcgaggaagatgaacttgatgcgggggattgatttgaagaagattgctgagaagatgagtggtgcttctggggctgaacttaaggccgtatgtacggaagcagggatgtttgctctaagagagaggagggtgcatgtgacgcaagaagattttgagatggctgttgctaaagtaatgaagaaagagaccgagaagaacatgtcactgcgaaagctgtggaagtagatgatggtcgatatgaaggacctgaaacacatacacatctgagttgattgtctatatttactgttgttcttggaacttttatttgaccccaggagcttccgacttgcccttaatattttcatgtttctctgtaagctgtttaatcttctttggccgtatggggcattcgcagctgtaattcaaaaatgtccagtgtttttccgcgcagctttagtattcgactctcggcttctaacttatatttgcttttattgacagcaataaagagataaaagacttgtgga

SEQ ID NO: 4268 - DNA, 1621 bp, Cucurbita pepo
caatttctaaagggtgttttcaatggcgacaatggaggtcgagacccagaaagtgttgtcgacgatggtggatagttgctcggcgaaacaggcggcgaaacaaggtgagggtctgaggcagtactatctgcaacatattcacgagctgcagctacaggtccgtcagaaatcccataatctgaatcgtcttgaagctcagcggaacgagctgaattcgaaagtgcgcatgctacgggaagagctgcagctgcttcaagagccaggatcctatgttggagaagttgttaaagtcatgggaaagaacaaagttttagtcaaggtccatccggaagggaagtatgtggttgatattgacaaaagtatcgatatcactaaaatcacaccttcaactagagttgctctccgtaatgacagctatgttcttcatttaatcttgccaagcaaagtagatccccttgttaatcttatgaaagttgaaaaggttcctgattctacttacgatatgattggtggtcttgaccagcaaataaaggaaataaagaggttattgaacttcccattaagcatcctgaactatttgagagtcttggaatagctcaaccaaagggtgtcctgctatacggaccacctggtacagggaagacactgttggctagagcagtggcgcaccatacagattgtactttcatcagggtttctgggtctgaattggtccagaaatatattggagaaggctctagaatggtcagagagcttttcgtcatggccagggagcatgcgccttctatcattttcatggatgaaattgatagcattgggtctgctagaatggaatccgggagtggtaatggtgatagcgaggtgcagcgtactatgttggaacttcttaaccagctcgatggatttgaagcatcaaataagatcaaggtcttgatggccacaaataggattgatattctggatcaagctcttctaaggccaggacgaattgacaggaagattgaattcccaaatcctaacgaggattcccggtttgatatcttgaaaatacattcacggaaaatgaatttgatgcgtgggatcgatttgaagaaaattgcagagaaaatgaatggcgcatctggtgctgagctcaaggcggtgtgcacagaagctgggatgtttgctttgagagaaagaagggttcacgtgactcaggaagattttgagatggccgtggccaaggtaatgaagaaggaatcagagaagaacatgtcgttgcgaaaactctggaagtagaatatcatacgaagcacccaatggccgagcaaatttcaagcattattgttgcttacccttttcgtttttgaattctctgcctcacctgggctgtgcttggacgttgttgaacttgctcattttaccttgaatgatgttttcttgtcgtcaactcttttatactcaattgtatctgtaacttaaaagtctcccctgccacattttttaccgcctccttctccaaatgtattgacaagttgcatgtagttggcaagaattatcaattggctgatagtttagaattgtgttctatatttacttcatatcattctgacctttgagaatgagtattattacttcagat

SEQ ID NO: 4269 - DNA, 1614 bp, Centaurea maculosa
  misc_feature (11)..(12): n is a, c, g, or t
  misc_feature (1210)..(1210): n is a, c, g, or t
  misc_feature (1249)..(1249): n is a, c, g, or t
  misc_feature (1333)..(1333): n is a, c, g, or t
  misc_feature (1356)..(1356): n is a, c, g, or t
  misc_feature (1385)..(1386): n is a, c, g, or t
tctgtcttgcnngaaagacatcgaataagaacatccaaatcgccattgatacacgaaaccctattaccttcaagattctcctccgatctgaatcaaaaaccaagattgctggatggcgagtgtggaggtagccatgaacttatctgattcaggggacagagatgagagctgttcttcgaggcctacaacggccaaaacaggcgatggtctgagacagtattacctgcaacatatccacgatgctcagcttcaggttcgccaaaagactcacaatctcaatcgccttgaagcccagcgtaacgagctcaattctcgagtcaggatgcttaaagaagagttgcagctgcttcaagagccgggatcatatgttggcgaagttgtcaaagtaatgggaaagtcaaaagtactcgtcaaggtgcacccggagggtaaatatgtagttgatatcgacaaaagcatcgacattactaagatcactccgtcaaccagggtagcccttcgcaatgacagctacgtccttcatttggttttgccaagcaaagttgatcccctggtgaatcttatgaaagtcgaaaaagttcctgattctacatatgacatgattggtgggctagaccagcaaattaaagaaattaaggaggttatcgaacttccaatcaaacatccggagttattcgagagtcttggaattgctcaaccaaagggagttctgttatatggtccgcctggtaccgggaagactttactggctagggcggtggctcatcataccgattgtaccttcattagggtttctggttctgaactagtgcaaaaatacattggagaggggtctcgaatggtgagagaacttttcgttatggccagggaacatgctccatctatcatatttatggatgaaattgatagtattggatctgctagaatggagtctggaagtgggaatggtgacagtgaagtacaacgaacgatgcttgagcttcttaatcagctcgatggatttgaagcatctaacaaaatcaaggttttgatggctacaaaccgtatcgatatcctggaccaagcccttctcaggccaggaagaattgataggaagattgaattcccgaatcctaacgaagactcacgattcgatattctgaaaattcattcaagaaagatgaacttaatgcgtggcattgatctgaagaagatagctgaaaagatgaanggtgcttctggtgccgagcttaaggctgtgtgtactgangctgggatgtttgctttgagggaaaggagagtccatgtaacacaagaagatttcgagatggcggttgccaaggttatgaagaangaaaccgagaagaacatgtcgtngcgcaagctatggaagtaatcctccctcnnctgttctgtttttatggacccatttggagtttgtatcatttctttaagattgtttttttaagactgcagctttactttatatttgcatactcaaatacgttaaaactagtgggaattctcataaatatttgtgttaagaggataactcacttgacatggtagcacatcaagtgtggatcatgggatgtggaaatggtaaaatgaggatcaagtttggacaaaaaaaat

SEQ ID NO: 4270 - DNA, 1583 bp, Tragopogon dubius
aagcaaaccttttcttgatcaacactcctatatacaccgactactgaaatcaaatcgccatcgaaactaaaaccttcaagctctcgaattatctacccaatagacacgaatggcgacagcggatatagcgatgaatcacgtggattcaggggagaaagacgagggttgttcgtcgaggcacacaacggcgaaagcaggtgaaggtctgaggcaatattacctgcagcatatccacgatgctcagctccaggttcgccagaagaatcataatctcaatcgccttgaggctcagcgtaacgagctaaattctcgagtaaggatgcttaaggaagagttgcagctgcttcaagagcctggatcttatgttggtgaagttgtcaaagtaatgggaaaatcaaaagttctagtgaaggtgcacccagagggtaaatatgtcgttgacattgataaaagcattgacattactaaaattacaccatcaaccagggttgccctgcgaaatgacagttatgtccttcaatttggtttttgccaagcaaagtagatcctttagtcaaccttatgaaagttgaaaaggttcctgactccacatatgacatgatcggtggccttgaccaacaaattaaagaaatcaaggaggttattgaacttccaattaaacatccagagttattcgaaagcctgggtattgctcaaccaaagggagttctattatacggtccacctggcactggaaagcattactggcaagagctgttgctcatcacaccgactgtactttcattagggtttctggctctgaactagtccagaaatacatcggagaaggttccagaatggtcagagaactcttcgtcatggccagggaacacgccccatcaattatattcatggatgaaattgatagcattggatctgcaagaatggagtctggaagtggaaatggtgacagtgaagtccaacgaacaatgcttgagcttcttaatcaactcgatggattcgaagcatcaaacaaaatcaaagttttgatggctacaaaccgtattgatatcctggatcaggcccttcttaggcccggaagaattgataggaagattgaattcccaaatccaaatgaagactcgaggtttgatatcttgaaaattcattcgagaaggatgaacttaatgcgtggaattgatctgaaaaagattgctgagaagatgaacggtgcttcgggtgcagaacttaaggcggtttgcacagaggcggggatgtttgcgttaagagaaaggagagtgcacgtgacacaagaagattttgagatggcagtggccaaagttatgaagaaggaaaccgagaaaaacatgtccctccgcaagctctggaagtaattgtatggaattatgcctccaaaatggaagatttgggaaccgttgttttgttctcgacagaattccttgctctttacactttgaaatttcttgttcttctgcaatgtaatttccatgagcgttatgaatatttggaatatgtgtttgatgatgaagtgagctttgttaatttaaccaaattagatctattaactaaaaaaaaaaaaaaaa

SEQ ID NO: 4271 - DNA, 1412 bp, Helianthus annuus
aaactaatggcgacagcggacatatcaatgaaaccggcggattcacgagagaaaaacgagacctgttcttcgattatttcgtctgcgaaacaaggtgaaggtctgaagcagtattatctgcaacacattcatgattctcagcttcttgttcgtcagaagactcataatctcaatcgccttgaggcgcagcgtaacgagcttaattcgagagtaaggatgcttaaggaagagttgcagctgcttcaagagccaggatcctatgttggtgaagttgtcaaagtaatgggaaaatcaaaagttctagtcaaggtgcacccagagggtaaatatgtggttgatattgataaaagcatcgacatcaccaagattacaccatcaacaagagttgctcttaaaaatgatagctacgttcttcatttagttttaccaagcaaagtagatcctctggtcaaccttatgaaagttgaaaaggttcccgattctacatatgacatgatcggtggacttgaccagcaaatcaaagagattaaggaggttattgaacttccaatcaagcatccagagttatttgagagtcttggtattgctcaaccaaaaggtgttctgttatacgggccaccaggtactgggaagacgctgttggcgagagcagtggctcatcatacggattgtactttcataagggtttccggttctgaattagtacagaaatatattggagaaggttccagaatggttagagaactttttgtaatggccagagaacatgccccgtcgatcatctttatggatgaaattgacagtattggatctgctcgaatggaatctggaagtgggaatggtgatagtgaagtccaaagaacaatgctggagcttcttaatcaactcgatggattcgaagcatcaaacaagatcaaggttttgatggctacaaatcgtattgatatactcgatcaggcccttctcaggccaggaagaatcgacaggaaaatcgagttcccgaatccaaatgaagattcgaggtttgatatcttgaaaattcattcaagaaagatgaacttaatgcgtggcattgatctgaaaaaattgctgagaagatgaacggtgcttcgggtgcagaacttaaggcggtttgcacagaggcggggatgtttgcattgagagaaaggagagtgcacgtgacacaagaggatttcgagatggctgtggccaaagtcatgaaaaaggaaaccgagaaaaacatgtcacttcgcaagctctggaaataagtaacggttaccaaccgtttttcctcctttatgtcgttgaattagttgttaatgtaatttcagtttgcatcgttaaagatttggaatttgtgttcatgctatagatataacacaatatatatttgttaacctcacccatggtta

SEQ ID NO: 4272 - DNA, 1675 bp, Aquilegia formosa
cttgattgattagaaagaagaaagaagaagttgtgttgagttaatcaatggcgacagtagcagtagatacagcaaaagcagtagaaattggaacaacagagatgatgatgtgtaacaacaacaacaacacatcagcaggaaaaacgaaacaaggtgaaggtttgaggcaatattatcttcaacatatccacgatcttcaacttcttttgcgtcagaagactcacaatcttaatcgacttgaagctcaacgaaacgagctcaatgctagagtgaggatgcttagagaagaattgcagttgcttcaggagcctggatcttatgtgggtgaagtggttaaagttatggggaagtcaaaggttctagtcaaggtacatccagagggaaagtatgttgttgatatcgataaaagcattgatatcaccaagatcacaccgtcaactagagttgctcttcgcaatgatagctatgtgcttcacttgattttgccaagcaaagtagatcctttggttaatctaatgaaagttgaaaaagttcctgactctacatatgacatgattggtggtcttgatcaacaaattaaagagataaaggaggttattgagctgccaatcaaacatcctgagctctttgagagtcttggaatagctcaaccaaagggtgtcctcctttatgggccacctggtacagggaaaactttgctagcaagggcagtggctcatcatactgactgcacctttatcagagtttctggttctgagttggttcagaaatatattggggagggatctagaatggtcagagagctctttgtaatggcaagagaacatgccccctcaatcatatttatggatgaaatcgatagcattggttctgccagaatggaatctggaactggaaatggtgacagtgaagtgcagcgcactatgcttgagttactcaatcagcttgatggatttgaagcatccaacaagatcaaggtattgatggctacaaatcgtattgatattctggatcaagccctccttaggcctggacgaattgacaggaaaattgagtttcctaacccaaatgaagagtcccgctttgatattttgaaaatacattcaagaagaatgaacttgatgcgtggaattgatttaaagaagatagcagaaaagatgaatggtgcatctggtgcagaactcaaggcggtttgcacggaagcagggatgttcgctttgagggaaaggagagtgcatgtgacacaagaggattttgagatggctgtagcaaaggtaatgaagaaagagagcgagaaaaacatgtccctgcgcaagttatggaagtagattacatgtcacgtttcattttctttttaaagttggatggagacaggaacctagacccagcatattctcacaagttgtttgtgtaattctgttgaagtgccataattatcacaaactcttgttaagtgtgtttaaaatttcttgggcatgtcacagtaatgtaagttaaaagcctgtgcatgaacacatgctattgtttcttcatttctccgaaaagtgtttggattctatcagtatgtgctttgacctgtgtaacaggatgtcatgattgcccagactgtcccaccaaggtactctggacggtaagcagtaatggaaaattgaatggaaatttgccctggttcaat

SEQ ID NO: 4273 - DNA, 1650 bp, Eutrema halophilum
atttaggtgaagtaatgtctgcgtgagggtttcagattccgatcaaagaaattaaatctcactatcttttccttctcttctccttccccgattccgatcaaagaaattgttctctctctctcacatcagattaccagatacaatcagtgacgaatatggcggccgtaggagtcgattcgaggcgtcttgagactacgatggaggaaacctgcaacgtcaagggagcggtggcgaaacaaggggagggacttaagcagtactatctccagcacatccatgagctccaacgccagctccgccagaaaactaacaacctcaatcgccttgaagctcagaggaatgagctcaattctcgagtacgaatgctcagagaagagttgcagctgcttcaagaacctgggtcctatgtgggtgaagtcgtaaaagtgatgggaaaaaacaaggtcttggttaaggttcatccagaggggaagtatgttgttgatattgacaaaagcatagatataacgaagatcaccccatcaacgagagtcgctcttcgtaatgatagctatgttctccacctggtcctgccaagtaaagtagatccattggttaaccttatgaaagttgagaaggttccagactccacatatgacatgattggtggtcttgaccagcaaattaaggaaataaaagaggtcattgagctcccaatcaagcatcctgaattgtttgagtctcttggaattgcgcagccaaagggtgtgttgttatacggtccacctggaactggaaagacacttttggctcgagctgtggcacatcacactgattgtacgttcatcagagtttctggttccgagctggtccagaagtacattggagaaggctctagaatggtcagagaactttttgtgatggcaagggagcatgcaccatcaatcatcttcatggatgaaatcgatagcatcgggtcagctcgtatggaatctggaagtggcaatggtgacagcgaggttcaacggactatgcttgagcttctcaaccaacttgacggattcgaagcgtcaaacaaaattaaggttttgatggcaacaaatcgaattgatattctggatcaagctcttctcaggccaggaaggattgacaggaaaattgaattccctaatcctaatgaagactcacgttttgatatcttgaaaattcactcgaggaaaatgaatttgatgcggggaattgatctgaaaaagattggagagaagatgaatggtgcttcaggtgctgaattgaaggctgtgtgcacagaggcgggcatgtttgcgctgcgggagaggagagtacacgtgacgcaggaagactttgagatggcggtggctaaggttatgaagaaagacacagagaagaacatgtctctacgtaagctctggaagtaggaatctctcactgttgccttgctcaaaggagagccacagattgatttcagacctaagaaattagtgcttctttactgtctgttgttctttctgaaaccatttcggtttgttctttaagcatttgaaaacaaagtttttactgcctaaacagtagtttgttatattcaagtgttctcccaagcataacagtttcgatttaaacaaacaagcatctacatttagtatttgtttcccc

SEQ ID NO: 4274 - DNA, 4255 bp, Brassica rapa
ggtatctaacttttatatgtaagtaatgtttgcgtcgtgagagggttttcagattccgatcgaaaagaaaactattctctcatcaacatcacaatactcgcgatactcattgaggatatggctgccgtaggagtggagtcgatgcgtccggagacagcgatggaggaaacctgcaacgtcaagatagcggcggcgaaacaaggggagggacttaagcagtactatctgcagcacatccatgagctccagcgccagctccgccagaaaactaacaacctcaatcgcctcgaagctcagaggaatgaactcaattctcgagtacgaatgctcagagaagagttgcagctgcttcaagaacctggctcctatgttggtgaagtagtcaaagtgatggggaaaaacaaggtcttggttaaggttcatccagaggggaagtatgttgttgatattgacaaaagcatagacataaataaaatcacaccatcgacaagagttgctctccgtaacgatagctatgttcttcacctcgtcctgccaagtaaagttgatccgctggtcaaccttatgaaagttgagaaggttcccgactctacatatgacatgattggtggtcttgaccagcaaattaaggaaataaaagaggtcattgagctgcctatcaagcatcctgaactgttcgagtctcttggaattgcgcagccaaagggtgtgttgttatatggtccacctggaactgggaagacacttttggctcgagctgtggcacatcacactgactgtacgttcctcagagtttctggttccgagctggtccagaagtacattggagaaggttctagaatggtcagagaactctttgtgatggcaagggagcatgcaccatcaatcatcttcatggatgagatcgatagtattgggtctgctcgtatggaatctggaagtggaaacggtgacagtgaggtgcaacggactatgcttgagcttctcaatcaacttgatggattcgaagcgtcaaacaaaataaaggttctgatggcgacaaatcgaattgatattctggatcaagctcttctcaggccaggaaggattgataggaaaatcgaattccctaatcctaatgaagattcacgatgtgatatcttgaagattcactcaaggaaaatgaatctgatgcgtgggattgatctgaaaaagattgcagagaagatgaatggtgcttcaggtgctgaactgaaggctgtgtgcacggaggcgggcatgtttgctctgagggagaggagagtacacgtgacacaggaagactttgagatggcggtggcgaaggttatgaagaaagacacagagaagaacatgtctttgcgtaagctctggaagtaggaatctatttcgtttgtactcaaaaagggagagccacagattcatttcagacctgagaaataagtgtttcttttcatcacgtctggttctctatgtttcttctttaagcctttgaaaacaaagtgtgtgtttactgcctaaaacactagtttaatgttcttaagcataacagtctccgtattccatccttgtcacaacttagagattattattattcaagaaagaaaagccactacagagtacattaattaaaagaggaaagagaccgcgtgggactaaagctgaaaaagatctaacggtggagaaaggtgcgttgaaaattgagagcgatcaaaaagaagggaatctaacggtcgtaagaatagcgtcagacctaagcgaaaacccttgcaaaaaatttcctcttttaaaaaccccatctccctctcgccgcttctctccttcttctcaatatcatctccccgcacgctcgctcacatcgtctgattcttgcgattcagaaaacatggctctaccgaaccagcaaaccgtcgattatcctagcttcaagctcgtcattgttggtgacggaggcacagggaaaactactttcgtcaagagacatcttactggggagtttgagaagaagtatgaacctaccattggtgtggaggttcatcctttggatttcttcacaaactgtggcaagatccgtttctactgctgggatactgctggtcaagagaagttcggtggccttagggatggttactacatccatggccagtgtgctgtgattatgtttgacgtcacagcacgtctcacatacaagaacgttccaacatggcaccgtgatctctgcagggtgtgcgagaatattcccattgttctctgtgggaacaaagtcgatgtcaagaacaggcaagtcaaggccaagcaggtgacattccacaggaagaagaatctgcagtactacgagatatccgcaaagagcaactacaacttcgagaagcccttcttgtacctcgctaggaaacttgctggcgaccctaaccttcactttgtcgagtcaccagctcttgctccccctgaggttcacattgacgttgctgagcagcagaagaacgaggctgatctcattgccgccgctgctcagcctctcccagatgatgatgatgacgcttttgagtaaacaaaaaaatcttccaagaatgtctgcccccgtggggaagctttgcgttgtctgattctctcttttgttttggttttgttctatgttgcgttgttgttacatatagaatgaaccgagtgttttagaactgatattggggaagtattgagattgttccggtttggaatagagtgagttgtttttgaacccgaagagaatatgcaatcaaggatctttttatatgcgttgtcatgaacctcgaatactcttagcttgaatctgttgagctcgagattgtttgcatgttgctgtgtcgactgtctgttttgtttgcatgtatgttgctgtgtgtgattgcttgtttacatgttggtgcgacctgttactgcaagtcacagctcgtttgttgctgcgatctgtgaccaatagcaagtcatacagcttgttgtttgcttcactattgtgcgactaatcgcagcgattgacaacacactttacaatgttgaaagaagatagaagttaagagtctgcagtagtatggtgcagtaatcattcatatatgttcaaactcacatttacaagctcaggaagaaaaaaaaatcaaatagctgtgtttgaaaatagagtgacattttgtacaaccttaaccttagttttcattctatgtaacacagcttgtagatgttaaatgatgctgctatctgtatgtagtactgttatcatcagagataaggtttcttatctgcatcagatgttcctcattcgagatgttcagtctcagacggaggtttgtgatccacgtttcttgttcccacgttatattcggtccagatgcgtgcaatctctcgatactgcatcggtattcatccaactctagcctatgaacatcagcagcttctgagccttttggtgtaaagccagacttcttcttgatcttgaagcttctgtagcgacaagatgatgactcagtgtcactggagctaccggtttctatgggaacgaaagagacagtacttaaaccatccaagttacaactaccaacagaagaagcaatactctctctatcttcttcttctttgacttgtggagtttgattgtgtggcgtaaccaaagagtaggtccgtttctttgaacccagtgcatcagacacattgagcttgtctttgctctcagatgaaacatagtcgcctttcagattcacctttctccttaactttcctgttgaagtctgtgcgcttaatctcggtgaactctttaaccaaatggtataaacaaaatgtcagctcacaaaagcctttgaaagatacagatattgaaagagaaaagaaacaggtacctgcccgaccatgatccactcattgtcttgccaagactgtctgacccgaatgtcagatttgtttgccttgaccttgactgaggaaccaagtaatctaaccaagacacaatcatcctccaaaaccttggaaacgatagccatcttccaggaacagctttcaaaaacctcaagaacgtcaccaggaacccaagaatgaagaacttgcagaggaggaggctcaggtctcatactcttcctcggtaccctctctgtagcgtcaacgctatcatacatgacagtgtaataatgcccattaccggacattatctcagcagatcgccaagcaccagatggaagtgaagatttggtcaacacttccactttagttcctttcttgaatctcatcattcctg

SEQ ID NO: 4275 - DNA, 1613 bp, Fragaria vesca
ccaactcaaaacgacacacacgacatctctcttctctcaaactcctcacacccccaaatcgccaatctcacaaattccgattccaaagtttagggctttgcttgatcacgatggctgcagtcgccgccgagaccaagcccatcgatgccgtgccggaggagacctgctcgtccaagctcgccgcctccaaactcggcgatgggctccggccgtactacctccaacacattcacgagctccagctccaggtccgccagaagacccacaatctcaatcgactcgaggctcagcgtaacgagctcaattccagagtgagaatgctcagggaagaactgcagcttcttcaggagcctgggtcctatgtcggtgaggttgtcaacgtcatgggaaagaacaaggttttggttaaggttcatccggaagggaaatatgtggttgatatcgataagaacattgatattacaaagatcacaccatctacacgtgtggctctccgcaatgacagctatgttcttcatttagtactgccaagcaaagttgatcctcttgtcaatctgatgaaagtggagaaggttccagattctacatatgatatgattggtggtctggatcagcagattaaagaaatcaaagaggtcattgaacttccaattaaacatcctgaattgttcgaaagtcttggaatagctcagccaaagggagtcctgctttatggtccccccggcactggaaaaaccttgttggctagggctgtggctcatcataccgactgtactttcatcagggtctctggttcagagttggttcagaaatacattggggaaggttcccgaatggttagagaacttttcgtcatggccagggaacatgctccatctatcatctttatggatgaaatcgatagtattggatctgctcgtatggaatctggcagtggcaatggtgacagtgaggtgcagcggactatgcttgagcttcttaatcaactggatggatttgaggcctcaaacaaaatcaaggttttgatggctacaaatcgtattgatattttggatcaagccctgctgaggccaggacgcatagacaggaaaattgaatttcccaaccctaacgaagagtctcgttgggacatcctgaaaatccattcaagaagaatgaatttaatgcgtggaatagacctgaagaagattgccgagaaaatgaatggcgcatctggtgctgagttgaaggctgtatgtactgaagcaggaatgtttgcactgagggagaggagagtgcatgtaacccaagaagactttgagatggcagttgccaaggttatgaagaaggagactgagaagaacatgtccctgcgcaagctgtggaagtgagatgttcttacgcggacgcttattactgctttactctgcgttttttaactgttgtaaacgcaccaaagctcctttgtttgtttgggatccttttggtacaaatttcagtgtttagacttgtgtatgtctacaccatattaagcttcaaattcactttcctcctctggtgaacttctggataccgcaatcattggaaaatgtcaaatgtgatctggttagttggatcatgaatggagaaggcat

SEQ ID NO: 4276 - DNA, 1583 bp, Cichorium intybus
gatagactcgaatagaacatccatccctgttgatacacgaaagctataaccttccagattttccgatctaaaagcaagattcgtgaatggcgactgcggaggtagcgatgaaaccagcggattcaggtgagagagatgaaagctgttcatcgaggcctacagcggcgaaagcaggtgaaggtctgaggcagtattacttgcaacatatccacgatgctcaactccaggttcgccaaaagactcataatctcaatcgtcttgaggctcagcgtaacgagctcaattctcgagtcaggatgctcaaggaagagttgcagctgcttcaagagcctggttcttatgttggtgaagttgtcaaagtaatgggaaagtcaaaagtactagtcaaggtacacccggagggtaaatatgtagttgatatagacaaaagcattgatattactaaaatcaccccatcaaccagggtagcccttcgcaatgacagctatgttcttcatttggttttgccaagtaaagttgaccctctggtcaaccttatgaaagttgaaaaagtccctgattctacttatgacatgattggtgggctagatcaacaaattaaagagattaaggaggtgatagaacttccaatcaaacatccagaattattcgagagtcttggaattgctcaaccaaagggagttttgttatacgggccacctggcacaggaaagaccttgttggcaagagcagttgcacatcatactgattgtaccttcattagggtttctggttctgaattggtacagaaatatattggagaaggctctcgaatggtcagagaactttttgttatggccagggaacatgctccatctattatatttatggatgaaatagacagtattgggtctgctagaatggaatctggaagtgggaatggtgacagtgaagtacaaagaactatgcttgagcttcttaatcagcttgatggatttgaagcatcaaataaaatcaaggttttgatggctacaaaccgtattgatatcttagatcaagctcttttaaggccaggaagaatcgataggaagattgaattccaaatcctaatgaagattcacgatgtgatattctgaaaattcattcaagaaagatgaatttaatgcgtgggatcgatctaaagaaaattgctgaaaaaatgaatggtgcttctggtgctgaacttaaggcggtttgtacggaagctggaatgtttgctttaagggaaagaagagtccatgtgacacaagaagattttgaaatggcggttgcaaaggttatgaaaaaggaaactgagaaaaacatgtctcttcgcaagctatggaagtaattattgagaaaatgtcttttctacccctcaacctcccaaacaattcgactttatatcctttctttcttcattgttttagactgcagggttactttgtatttgcatcccaaacttttaaaagctagtggttgtttgaattatatttacaacgatatgcattttttttttttaaactgtaacgtgttttagacatttttacatacaataaaattgtggtaagaatgttttggatgcc

SEQ ID NO: 4277 - DNA, 1305 bp, Eschscholzia californica
ccccaatcaacaagaaacctctctaactttctctctctaaagttgtaatggcgacagcagtagtggagaagacgatggtgaaacaaggtgaaggtcttagacagtactactctcaacatattcatgatcttcaactgcaggttcgtcagaagacccataacctcaatcgtcttgaagctcaacgtaacgatctcaattctagagtgaggatgctcagagaagaattgcaactacttcaggagcctggatcatacgtaggagaagtagttaaagtgatggggaagtcgaaggtcttagttaaggttcatcccgaagggaagtatgtagttgatattgataaaagcatcgatatcacaaagattacaccatcgaccagagttgctcttcgtaatgacagctatgtgcttcacttgattttgcccagcaaagtagatcctttggtcaacctcatgaaagttgagaaagttccagactctacttatgacatgattggtggtcttgatcaacaaattaaagagataaaagaggttattgagctgccaatcaagcatcctgagttatttgagagtcttggaatagctcaaccgaagggagtcctgctttacgggccacctggtacagggaaaacactgcttgccagggcagttgctcatcatactgattgcaccttcatcagagtttctggttctgagttggtccagaagtacattggagaaggttctaggatggttagagagctttttgttatggcaagggaacatgctccttctatcatttttatggatgaaattgatagtattggatctgctcgtatggaatctggcactggtaatggtgacagcgaagtgcagagaaccatgcttgagcttctcaatcagctggatggatttgaagcatcaaacaagatcaaagtgctcatggctacaaatcggattgatattttagatcaagctctactcaggcctggacgtattgacaggaagattgagtttccaaatccgaatgcggagtctcgttgggatattttgaaaattcactcaaggagaatgaacctgatgcgtggaattgatttgaaaaagatagcagaaaagatgaatggtgcatctggtgcagagctcaaggctgtgtgcacagaagcaggaatgtttgccctaagggagaggagagttcatgtaacccaagaagatttcgaaatggcagtaggaaaggtgatgaagaaagaaaccgagaagaacatgtcactaaggaagttgtggaagtagactctttgaattgctttcattgttttgtcttctttcgttcttc

SEQ ID NO: 4278 - DNA, 1637 bp, Populus trichocarpa
gcagcagcagcagcagcaacagcaggaaaaaaaacaatcaatcgcgatggcaactgtaggagtggagaggaagcagcagcagcaaacagaatcaacgatgacgatgatagcggaggagagctgctcggcgaaaacgggagcggtgaggcaaggagagggtttgaagcagtactatctccaacacatccatgagcttcagctccttgtccgccaaaaatcccacaatcttaatcgcctcgaagcgcaacgcaatggccttaattccagagtcaggatgcttagagaagagtcgcagctacttcaagagcctgggtcatatgttggtgaagttgtcaaagtaatggggaagaacaaggtgttagttaaggttcatccagaggggaagtatgttgttgatattgataaaagtattgatatcacaaagatcactccatcaacaagggttgcccttcgcaatgacagctatgttcttcacttgatcttgccaagcaaagtggatcctttggtcaacctcatgaaggttgaaaaagttccagattccacctatgacatgatcggtggtcttgatcaacaaattaaagagattaaggaggtcattgaacttccaatcaaacaccctgaattgtttgagagtcttggaattgctcaaccaaagggtgttctgctttatggacctcctggcacaggaaaaactctactggctagggcagtggctcatcacactgactgtactttcatcagggtttctggttctgaattagttcagaaatacattggagaaggctctagaatggtcagagagctttttgttatggcaagagagcatgctccatcaatcattttcatggatgaaattgatagtattggatccgctcgaatggaatctggcagtggcaatggtgacagtgaggtgcagcgtactatgctggagctcctcaatcagctggatggatttgaagcatcaaacaagatcaaggttttgatggctacaaatcggattgatattctggatcaagctctccttaggccaggaagaattgacaggaagattgaatttccaaatcccaacgtggattcacgttttgatatcgtgaaaatccattcaagaaggatgaatttaatgcgtgggattgatatgaagaagatagctgagaagatgaatggggcatccggtgcagagctcaaggcggtgtgcactgaggccggaatgtttgctctaagagagaggagggtccatgttacacaagaagattttgagatggctgtagcaaaggtcatgaagaaggagacagagaagaacatgtctttgcggaagctctggaaataaatcggtttctgtaacttgctgtgttttctgtttgttttttttttctctcctatgaaaatgtctcaagaatcgaataggggagcaatttagagcattgaatatttacgcactggatttcctgcctggaccttgtcagcaccatgcacatgatttctttcacgagatcaagggatgggcatggaattgttgtgttttgaaagagttgttcgtgtattgtctttgtaatcctgaatgcctgatgggaattatttatttcttcttgattattgattctttatataaaattgctaggagcaaggcctgcatagct

SEQ ID NO: 4279 - DNA, 1646 bp, Glycine max
gggctagaagcatgagggcccaataaacgaattgcattggcattatcagtacgagactagaagagtcttcttttgtttgttcttctgtctaccgacctaacccaagacgagagaatagaggaagcttggggtttgaatcgaatcgaatcgaagcgattcatcgatcgatcgatggctcttgtaggagttgaactgaagcatgcggcggagggcgtaccggaggcgaattgctccgccaagcccaccaagcagggcgagggcctccgccactactattctctcaacatccacgagcatcagctccttcttcgccaaaagactcataacctcaaccgtctcgaggctcagagaaacgacctcaattctagggtgaggatgctgcgcgaagaattacagcttctgcaggaacccggctcttatgtcggtgaagttgtcaaagtaatgggcaagaacaaagtccttgtcaaggtccacccagaaggaaaatatgttgttgacattgacaaaaatattgacattacaaagattactccatccactagagttgcactccgcaacgacagttatgttcttcacttagttctgccaagtaaagttgatccattggtcaatctgatgaaagttgagaaagttcccgattctacatatgacatgattggtggtttagaccagcaaattaaagaaataaaagaggtcattgagctaccaatcaaacatcctgagctgtttgaaagtcttggaattgcacaaccaaagggtgtcctgctctatgggccacctggtacaggtaaaacattgttggctagggcagtggctcatcatactgactgtacattcatcagggtgtctggttctgagttagttcagaaatacattggagaaggttctagaatggtcagggaactttttgttatggccagggaacatgctccatcaattatcttcatggatgaaattgacagtattggatctgctcggatggaatctggaagtggcaacggtgatagtgaggtacagcgtactatgctggaacttctcaaccagttggatggatttgaagcttcaaataagatcaaggttttgatggccaccaatcggattgatatcctggatcaagccctccttagaccaggacggatagaccggaaaattgaatttccaaaccctaatgaagagtctcggctggatattttgaaaatccattctagaagaatgaatttaatgcgtggcattgatttgaagaagattgccgagaagatgaatggagcatctggtgctgaacttaaggctgtttgcactgaagctggaatgtttgctttgagggagcggagggtacacgtgactcaggaggattttgagatggccgtggcgaaggtgatgaaaaaggagactgaaaaaaacatgtcattgcggaagttgtggaagtgattctcatttcatgtttgtggtgcacattgtcctgcgaagatgggcagagaacacacattagggttatttcaatttacagtggcattggctttcgttttgcttaactttacccaatcatgattctttcctcgagttcttccttgtctgtgtcttaggacggcacactacatttatagagtatttttaaaagatttatattcaagaccactaagtattct

SEQ ID NO: 4280 - DNA, 1366 bp, Flaveria ramosissima
caatcttcttttcacacagactacaaaatcaactatcaatcacattattgaaacacaaatctgcaagcttcacaatcatacacaaatctcacagacaccaatggcgacagcggagatagcgatgaacccatcggattccggtgagaaagacgatagctatttatcgagacacatgggttcgaaaccaggcgaaggtctgaagcagtattaccagcaacatattcacgatgcacagctccaggttcgtcagaagacgcataatctcaatcgccttgaggctcagcgtaacgagcttaattctcgagtaaggatgcttaaggaagagttgcagatgcttcaagagccaggatcttatgttggtgaagttgtcaaagtaatgggaaaatcaaaagttctagtgaaggtgcacccagagggtaaatatgtggttgatattgataaaagcattgacattactaagatcacaccatcaaccagggttgctctcaagaatgatagctatgttcttcatttagttttaccaagcaaagtagatcctctggtgaaccttatgaaagttgaaaaggttcctgattctacatatgacatgattggtgggcttgaccagcaaattaaagagattaaggaggttattgaacttccaatcaaacatccagagttatttgagtctcttggtattgctcaaccaaagggtgttctgttatatgggccaccaggcactgggaagacgctgttggccagagcagtggctcatcacactgattgtacttttattagggtttctggttctgaattagtacagaaatatattggagaaggttccagaatggttagagaactttttgtaatggccagagaacatgccccgtcgattatatttatggatgaaattgacagtattggatctgctcgaatggaatctggaagtgggaatggtgacagtgaagtccaaaggacaatgttggagcttcttaatcagctggatggatttgaagcgtcaaacaagatcaaggttttgatggctacaaatcgtattgatatcctggatcaggcccttctcaggccaggaagaatcgacaggaaaattgaattcccaaatccaaatgaggactcgaggttcgacatcttgaaaatccattcaagaaagatgaacttgatgcgcggcattgatctgaaaaaaatcgctgagaagatgaatggtgcttcgggtgcagaactcaaggctgtttgcacagaggcagggatgtttgcattgagagaaaggagagtgcatgtgacacaagaagatttcgagatggcagtggccaaagtcatgaaaaaggaaaccgaaaagaacatgtcacttcgcaagctctggaaataaagg

SEQ ID NO: 4281 - DNA, 1514 bp, Vinca minor
gatttttaatggcggcggcaacaataaattgagagtaataggccatcggaggacgccaccaatggcggcggcggcttgaggcattacaatcagcagaaacaaggccgtggagaaggtctgaggcaatattatttgctccgaatccatgatcttcagctcctagtccgccagaaatccgacgaccttcttcgtcttgaagcccagcgcaatgaacttaattccagagtcagaatgcttaaagaagaactccaacttcttcaggagcccggctcatacgttggcgaagttgttaaagtcatggggaaatcaaaggtcctggttaaggttcaccctgaaggcaagtacgtggttgacatcgacaagaatattgatatcacaaaactttcaccatcaacccgagttgcattgaagaatgatagctatatgcttcacttgatattacctagtaaagttgatccccttgtcaatctaatgaaagtcgaaaaggttcctgactctacttatgacatgattggtggtcttgatcaacaaattaaggagataaaagaggtcatagagttaccaataaaacatcctgaattgtttgagagtcttggaatagcacaaccaaagggagtcttgctctatggaccacctggtacggggaaaacactgcttgccagagctgtagcacatcatactgattgcaccttcatcagggtttcgggttcagagttggttcagaaatatattggagaaggatctaggatggttagggagctcttcgtgatggcacgtgaacatgctccatcaatcatcttcatggatgaaattgatagtataggatctgctcgcatggaatctggaagtggaaatggggatagtgaagttcaacggactatgctggaacttcttaatcaacttgatggatttgaagcctcaaacaagataaaagttttgatggctactaacagaattgacattttggaccatgcccttcttagacctgggagaattgacaggaaaattgagttcccaaatcccaatgaagagtctaggtttgacatcctgaaaatacactcgagaaggatgaatctgatgcgtggaattgatctgaagaagattgcggagaaaatgaatggtgcctctggggcagaattgaaggctgtttgcaccgaagctggaatgtttgctttgcgggagaggagggtccatgttactcaagaggatttcgagatggcagtggggaaagtcatgaaaaaggattccgagaaaaacatgtcgttgaggaagctttggaagtaagtccttcccccgagctgccccttctcttgctatattcaaaatgaaggaacaaaaccagctccagggagtcactacttccgttacacaaaccttgggttattcaaactttatttgattccataacttgtttcagtgtattgtaacatgacaatataaggcaaagattttacatcttttcttctggctttatttgacggatatcttctttgccttaaacttgtatgcaaacg

SEQ ID NO: 4282 - DNA, 1513 bp, Ambrosia trifida
gaaaggaaccatttttcttgaacaacactctatatctgcagaccgactacaaaaaccaattaatcaatcttccttctttcctccatccaaacaataatattaataataatcttcagaattcaacatcaataataataataatggtgtcagcagagatatcgacgaaagggttaaaacaaatggattcaaaacctggagaaggtctaaagcaatattatcaacagcatatccacgatgctcaactccaggttcgccacaagaccaataatctcaaccgtcttcaggctcagcgtaacgacctcaattccaaagtgaggatgcttaaggaagagttgcagctgcttcaagagcctgggtcgtatgttggtgaagttgtcaaagtaatgggaaaatcaaaagttctagtcaaggtgcacccagagggtaaatatgtggtggatatcgataaaagcattgatattactaaaatcacaccatcaaccagggttgctcttaagaatgatagctatgttctacatttggttttgccaagcaaagttgaccctcttgtgaaccttatgaaagttgaaaaggttcctgattctacatatgatatgattggtgggcttgaccagcaaattaaagagattaaggaggttattgaacttccaatcaaacatcctgagttatttgagagtctgggtattgctcaaccgaagggagttcttttatatgggccaccaggtacagggaagacattgttagccagagcggtggctcatcacactgactgtactttcattagggtttctggctctgaattagtacagaagtacattggagaaggttccaggatggttagagagctttttgttatggccagggagcatgcaccatcgattatatttatggatgaaattgacagtattggatctgctagaatggagtctggaagtggaaatggtgatagtgaagtccaaagaacaatgctggagcttcttaatcaactggatggatttgaagcatcaaacaagatcaaggttctgatggctaccaatcgaattgatatcttggatcaggcccttcttaggccaggaagaattgatagaaaaattgaatttccaaatcccaatgaagactcaaggtttgatatcttaaaaattcattcaagaaaaatgaacttaatgcgtggcattgatctgaagaaaattgccgagaaaatgaatggtgcttcaggtgccgagctgaaggcggtctgcacagaggcagggatgtttgcactgagagaaaggagagtccatgtgacacaagaagattttgagatggcagttgccaaagtcatgaaaaaggacaccgagaaaaacatgtcactccgcaagctctggaaataaatgttatggtttttaaacttctataacagtaaacacggaattctgtatgtttttttttataaattctatgacagcggaattctgtatggaattatgtcgaaaactatgaagatttgagaaccaatgcatcagtatttggagtt

SEQ ID NO: 4283 - DNA, 1567 bp, Distylium racemosum
aagaaaaaaaacagcagcagcaatatcatttaaataacaaaatggtgaagcagggcgagggtttgcgccaatattatctccagcacattcacgacctgcagctccaggtccgccagaagacgcacaacctcaaccgcctcgaggcccagcgcaacgatcttaactccaaagtgaggatgctgagggaggagctacagttgctgcaggagccgggatcatatgtcggtgaagttgttaaagttatggggaagtctaaagtactggtgaaggtgcatccagaaggaaaatatgttgttgacatagacaagaatattgacataacaaaaatcacaccttctacacgagtagctcttcgtaatgatagctatgtgcttcacttgattttgccaagcaaagtagatcctttggtgaatctgatgaaggtggagaaagtgccagattctacttatgatatgattggaggtcttgatcaacagatcaaggaaatcaaagaggttattgaactcccaattaaacatcctgaactatttgaaagtcttggaattgcgcaaccaaagggagtactgctgtatggaccacctggtacaggaaaaacactgttggcaagggcggttgctcatcacacagactgtacttttatcagagtttctggttctgaattggttcagaagtacattggagaaggatcaaggatggttcgtgaacttttcgtcatggcaagagaacatgctccttccataatctttatggatgagatcgacagcatagggtctgctcgaatggagtctgggactggcaatggtgacagtgaagtgcagagaactatgcttgaactacttaatcagcttgatgggtttgaagcatctaacaagattaaggttctgatggctaccaaccggatagatattcttgaccaagctcttcttcgacctggtcgaattgacaggaaaattgagtttcctaatcctaatgaagagtctcgttgggatattttgaaaatccattcaagaaagatgaacctgatgcgtggcattgatctaaagaaaattgctgaaaaaatgaatggtgcatcaggtgctgagcttaaggctgtatgtacggaagcaggaatgtttgcattgcgagaaaggcgagtccatgtgacacaggaggattttgaaatggctgtagccaaggttatgaaaaaggaaacggagaaaaacatgtctttgaggaagttgtggaagtaaggagggaaagaatcaaccaatttaccttgtgtctctatagattctgcaataattcaaatttttaactcttggatccttgttgcacgcggatatggtatttactggtggatcatttcacgtggcttctatgttgcgagagaatctatttgttcagctgtttgacaaaattttgatacacaaaaactgtatccttgaacttagcaaatattgtaagtgctattatgaattacatttcttattggaagcaaggatgttgtatttgttattattcttggaaatcatgcttggcatactttaagatattccaaaatgatatttcccttagggaagaatatgtt

SEQ ID NO: 4284 - DNA, 1488 bp, Valeriana officinalis
cgatggagatcgagaagccagcgatgattaagcagggtgagggactcaggcaatactatcatcaacacatccatgatcttcagcttcaggtcaggcagaaaactcacaatctcaatcggcttgaggctcagcgtaatgatctcaactccaaagtgaggatgctaaaggaggagttacagctacttcaagagcctggatcttatgttggagaagttgttaaagttatgggaaaatctaaagttttagttaaagttcatcccgaaggaaagtacgtggttgacatcgacaaaagcattgatataaccaagattacaccgtcaactagagttgccctacgtaatgatagctatgttcttcatttggttttgccaagcaaagttgatcctttggtcaaccttatgaaagttgaaaaggtccctgattctacatacgatatgattggtggtcttgatcagcaaatcaaggagataaaggaggttattgaactgcccatcaaacatcctgaactgtttgaatcgcttggaatagcccaaccaaagggagtgttgctctatgggccaccaggtacaggtaagacgttgttggctagggcagttgctcatcacactgactgtactttcatccgagtttccggctccgaactagttcagaagtacattggagaaggttctagaatggtcagagagctttttgttatggccagggaacatgctccatcgatcatattcatggatgagatagatagtattggatctgcaagaatggaatctggtagtggaaatggtgatagtgaagtgcagaggacgatgcttgagcttctcaaccagttggatggatttgaagcatctaacaagatcaaagttcttatggcaacaaaccgtattgatatcctggatcaagcccttctcagacctggtcgcatcgatagaaagattgaattcccaaatcccaacgaagagtcaaggtgggatatattgaaaattcattcgaggaggatgaacttgatgagggggattgatttgaaaaagattgctgagaagatgcacggtgcttcgggtgccgagctcaaggcagtatgcacggaagcaggtatgtttgcattaagggagaggagggttcacgtaacgcaagaagatttcgagatggcagttgccaaagtcatgaagaaggagaccgaaaagaacatgtcactacgcaagctatggaaatagttccttcttttttacattttatttactgttttactgctacacttttgtacggagtaattgctttaactttttataaaggtgtttaatcaattaactttgtttttcattattattagctaatacactttttcttgtgctgataccgtgttctttgttgttcttttaaagccgtaaactgtttctgttagctcgctttgcacttgtaattttcttactgtgctttgaactgtgtaagtttgaagttatttggggtaaaaatgtgagaatgattatatgg

SEQ ID NO: 4285 - DNA, 1762 bp, Aquilegia formosa
ctcgattcaactctctctctctctctctctctcttccatcttttcttgttaaaataagaaaaacgaaaaaaaaaaaaagaccaaaacttgattgattagaaagaagaaagaagaagttgtgttgagttaatcaatggcgacagtagcagtagatacagcaaaagcagtagaaattggaacaacagagatgatgatgtgtaacaacaacaacaacacatcagcaggaaaaacgaaacaaggtgaaggtttgaggcaatattatcttcaacatatccacgatcttcaacttcttttgcgtcagaagactcacaatcttaatcgacttgaagctcaacgaaacgagctcaatgctagagtgaggatgcttagagaagaattgcagttgcttcaggagcctggatcttatgtgggtgaagtggttaaagttatggggaagtcaaaggttctagtcaaggtacatccagagggaaagtatgttgttgatatcgataaaagcattgatatcaccaagatcacaccgtcaactagagttgctcttcgcaatgatagctatgtgcttcacttggttttgccaagcaaagtagatcctttggttaatctaatgaaagttgaaaaagttcctgactctacatatgacatgattggtggtcttgatcaacaaattaaagagataaaggaggttattgagctgccaatcaaacatcctgagctctttgagagtcttggaatagctcaaccaaagggtgtcctcctttatgggccacctggtacagggaaaactttgctagcaagggcagtggctcatcatactgactgcacctttatcagagtttctggttctgagttggttcagaaatatattggggagggatctagaatggtcagagagctctttgtaatggcaagagaacatgccccttcaatcatatttatggatgaaatcgatagcattggttctgccagaatggaatctggaactggaaatggtgacagtgaagtgcagcgcactatgcttgagttactcaatcagcttgatggatttgaagcatccaacaagatcaaggtattgatggctacaaatcgtattgatattctggatcaagccctccttaggcctggacgaattgacaggaaaattgagtttcctaacccaaatgaagagtcccgctttgatattttgaaaatacattcaagaagaatgaacttgatgcgtggaattgatttaaagaagatagcagaaaagatgaatggtgcatctggtgcagaactcaaggcggtttgcacggaagcagggatgttcgctttgagggaaaggagagtgcatgtgacacaagaggattttgagatggctgtagcaaaggtaatgaagaaagagagcgagaaaaacatgtccctgcgcaagttatggaagtagattacatgtcacgtttcattttctttttaaagttggatggagacaggaacctagacccagcatattctcaccaagttgtttgtgtaattctgttgaagtgccataattatcacaaactcttgttaagtgtgtttaaaatttcttgggcatgtcacagtaatgtaagttaaaagcctgtgcatgaacacatgctattgtttcttcatttctccgaaaagtgtttggattctatcagtatgtgctttgacctgtgtaacaggatgtcatgattgcccagactgtcccaccaaggtactctggacggtaagcagtaatggaaaattgaatggaaatttgccctggttcaat

SEQ ID NO: 4286 - DNA, 1652 bp, Phaseolus coccineus
ggtatttcccttttaccaaccgacatagcataacccaggaagagagaagagagaagagagaagaagagaaagaggatcaagaagctggtgatttgggtttcgctctgatttgaatcggtgaaaggcagagagatacctatctttctaattatggctcttgcgggagttgaagtgaagcatgtggaggccgtgccggaggagaattgctccgccaagcccaccaagcagggcgagggtctccgccactactattctctcaacatccacgagcatcagctccttctccgtcaaaagacgcataacctcaaccgtcttgaggctcagcgtaacgagctcaattccagggtgaggatgctacgcgaagagttgcagcttctacaggagcctggctcctatgtcggtgaagttgtcaaagtgatgggcaagaacaaagtccttgtcaaggtccacccagaaggaaaatacgttgtcgacattgacaaaagtattgacattacaaagatcactccatccactagagttgcacttcgcaatgatagctatgttcttcatttagttctgcccagtaaagttgatccgttggtcaatctgatgaaagttgagaaagttcctgattctacctatgacatgattggtggtttagaccagcaaatcaaagaaatcaaagaggtcatcgagctaccaattaagcatcctgagctctttgagagtcttggaattgcacaaccaaagggtgtcctgctgtatgggccacctggtacaggaaaaacgttgttggctagggcagtggctcatcatactgactgtacgttcataagggtgtctggttctgaattggttcagaaatacattggagaaggttctagaatggtcagggagcttttcgttatggccagggagcatgctccatcaattatcttcatggacgaaattgacagcattggatctgctcggatggaatctggaagtggcaatggtgacagtgaggtacaacgtactatgctggaacttctcaaccagttggatggatttgaagcttcaaataagatcaaggttttgatggccactaataggattgatatcttggatcaagctctccttagacctggacgtattgataggaagattgaatttcctaaccccaatgaagagtctcggctagatattttgaaaatccattcaaggagaatgaatttaatgcgtggcattgatttgaagaagattgctgagaagatgaatggagcatctggtgctgaacttaaggctgtatgcactgaagctggtatgtttgctttgagggaaaggagggtacacgtgactcaagaggatttcgagatggctgtggcgaaggtgatgaaaaaggagactgaaaaaaatatgtcattgcggaagttgtggaagtgatttttatttcatgtttctggtgccctttacttgtgaagacggacaacaaattcaccttaggttttcaatttacggtggcattggttttccttttgatttaagtttaccatgttatgtaccaaatcatgattctttccagttcagtttcttcattgtctttctcttcgaactgcacacaacatttatacactattttacaaaaattcttattaattctaaacaatctaacttcaaatactacctttttc

SEQ ID NO: 4287 - DNA, 1648 bp, Phaseolus coccineus
tggccgggggggtagttacccttttacctaaccgacatagcataacccaggaagagagaagagagaagaagagaaaagagaagaagagaagaagagaaagaggatcaagaagcttgtgatttgggtttcgctctgatttgaatcggtgaaaggcagagagatacctatctttctaattatggctcttgcgggagttgaagtgaagcatgtggaggccgtgccggaggagaattgctccgccaagcccaccaagcagggcgagggtctccgccactactattctctcaacatccacgagcatcagctccttctccgtcaaaagacgcataacctcaaccgtcttgaggctcagcgtaacgagctcaattccagggtgaggatgctacgcgaagagttgcagcttctacaggagcctggctcctatgtcggtgaagttgtcaaagtgatgggcaagaacaaagtccttgtcaaggtccacccagaaggaaaatacgttgtcgacattgacaaaagtattgacattacaaagatcactccatccactagagttgcacttcgcaatgatagctatgttcttcatttagttctgcccagtaaagttgatccgttggtcaatctgatgaaagttgagaaagttcctgattctacctatgacatgattggtggtttagaccagcaaatcaaagaaatcaaagaggtcatcgagctaccaattaagcatcctgagctctttgagagtcttggaattgcacaaccaaagggtgtcctgctgtatgggccacctggtacaggaaaaacgttgttggctagggcagtggctcatcatactgactgtacgttcataagggtgtctggttctgaattggttcagaaatacattggagaaggttctagaatggtcagggagcttttcgttatggccagggagcatgctccatcaattatcttcatggacgaaattgacagcattggatctgctcggatggaatctggaagtggcaatggtgacagtgaggtacaacgtactatgctggaacttctcaaccagttggatggatttgaagcttcaaataagatcaaggttttgatggccactaataggattgatatcttggatcaagctctccttagacctggacgtattgataggaagattgaatttcctaaccccaatgaagagtctcggctagatattttgaaaatccattcaaggagaatgaatttaatgcgtggcattgatttgaagaagattgctgagaagatgaatggagcatctggtgctgaacttaaggctgtatgcactgaagctggtatgtttgctttgagggaaaggagagtacacgtgactcaggaggatttcgagatggctgtggcgaaggtgatgaaaaaggagactgaaaaaaatatgtcattgcggaagttgtggaagtgatctttatttcatgtttctggtgcccttaacttgtgaagacggacaacagattcaccttaggttttcaatttacggtggcattggttttccttttgatttaagtttaccatgttatgtaccaaatcatgattctttccagttcagtttcttcattgtctttctcttcgaactgcacacaacatttatacactattttacaaaaattcttattattct

SEQ ID NO: 4288 - DNA, 1357 bp, Festuca arundinacea
  misc_feature (1105)..(1105): n is a, c, g, or t
ggacgaggcctcgtgcggggagggcctgcgccagtactacctgcagcacatccacgacctgcagctccagatccggcagaagacccacaacctcaaccgcctcgaggcccagcgcaacgacctcaactcccgagtcagaatgctccgggaagagctgcagctgctgcaagagccaggctcgtatgttggggaggttgtgaaggttatgggcaagtcaaaggttctggtgaaggtgcatccagaaggcaaatatgttgtagatcttgataagagcatcgatatcaacaagataactccttcaacaagagttgctcttcggaacgacagctatatgcttcaccttatcctgcccagcaaagtcgatccgctcgtcaatcttatgaaggtggagaaggttcctgactctacctatgatatgattggtggtcttgaccagcagatcaaagagatcaaggaggtgattgagcttcccattaagcatcctgagttgtttgagagtcttggaattgcccaaccaaagggtgtccttctttatgggcctccaggtacaggaaaaacattacttgctcgtgcagttgctcatcacaccgactgcaccttcatcagggtgtcaggttccgagttggttcagaagtatattggagagggttcccggatggttcgtgaactctttgtgatggctagggagcatgcaccatccattatatttatggatgaaattgactccattggttctgctagaatggagtcgggaaccggcaacggtgatagtgaggttcagcgcactatgcttgagcttctaaaccagcttgatggttttgaagcatcgaacaaaattaaggttcttatggcaacaaataggatagacatattggatcaagcactcctgaggcctggtcgtattgacaggaagatcgagtttccaaatcctaacgcagattcccgtggtgatattttgaagattcattcaagaaaaatgaatttgatgcgcggcattgatctgaaaaagattgctgagaagatgaatggagcttcaggagcagagctaaaggcggtctgcacagaagctggaatgtttgccctccgtgagagaagggtgcatgtnacccaggaggatttcgagatggcagtggcaaaggtgatgaagaaggatacggagaagaacatgtcactgcggaagctatggaagtgaagctctcattttagcatcctagctgttgttatcatgtatctgtttaagcctatagcagcacgttgccaaatgagctgcggtattcttgaattatctcaagaactgcacaatatacaatgtcatgcagcagcctccagattaaatttctttattgagcctcgtgcc

SEQ ID NO: 4289 - DNA, 1690 bp, Arachis hypogaea
ggggaacctttgttttgttcccttcttattattgacattcactcctccctacccatctaacaagagaagagacgagacgagagtacgagacccttttctttgtcctcaaatcgcttacgaagaagcgatccaaccatccattgagaaccccgttcttgcaattgaagtagagatgaaacatgcggcggaggctgcaccggaggaaaactgctctgccaagccagctgtcaagcagggtgagggtctccgccagtactactctctccacatccatgagctgcagctccttctccgccagaagacgcacaacctcaaccgtctggaggctcagcgcaacgagctcaattctagagtgaggatgctccgggaggaactgcagcttctccaggagcccggatcgtatgtcggtgaagttgtcaaagttatgggaaagaataaagtcctagtcaaggttcatccagaaggaaagtatgttgtagacattgataaaaatattgacattacaaagattactccatccacaagagttgcccttcgtaatgacagttatgtccttcatttagtattaccgagcaaagttgatccgttggtcaatctgatgaaagttgagaaagttcccgattctacctatgacatgattggtggcttagaccagcaaatcaaggagattaaagaggtcattgagctgccaattaaacatcctgaactgtttgaaagtcttggaatagctcaacctaagggtgttctactctatgggccacctggtactggaaaaacattgttggctagggcagtggcgcatcatactgactgtaccttcatcagggtatccgggtctgaattagttcagaaatacattggagaaggttccagaatggtcagggaactttttgttatggccagggagcatgctccatcaattatcttcatggacgaaattgacagtattggatctgctcgaatggaatctggaagtggcaatggtgatagtgaggtgcagcgcactatgctggaacttctcaaccagctagatggatttgaagcttcaaataaaatcaaggttttgatggccacaaaccggattgatatcctggatcaagccctccttagacctggacgaattgacaggaagattgaatttccaaacccaaatgaggagtctcggctagatattctgaaaatccattcaagaagaatgaacttaatgcgtggcattgatttgaagaagattgctgagaagatgaatggagcatctggtgcagagcttaaggctgtgtgcacagaagctggaatgtttgctttgagggagaggagagtacatgtgacacaggaggactttgagatggctgtggccaaggttatgaaaaaggaaacagagaagaacatgtcattgcggaagttgtggaagtgatttttctttcatgtttctagtacactatcctacaaaaacggacagaagacataccttaggcttgtttcaatttacagtagcgcacgctgtttttcatcttgcttattatgttgaccaagttctgtaccaaattatattattctttaaagttgagttcttcgttgtcggtgaccaagttatctttcgattttgatggcatgctaaaaaacagtgatgtttcatacttgaacaactatagactaaatcgagtctatgtatgttttgcaaataagattagcg

SEQ ID NO: 4290 - DNA, 1598 bp, Plantago ovata
gaggaaaccaaaccacagacaatataatattctccgatctatacacaaatcaaatcgatcctcgaatatagaatggccacagcagcgattgataatcggcagtcggatgattccaagcagcagcagctccaccagctaggcggagctggagacggtgaaggtctccgtcaatactaccagcagcgtattcaagatcagcagctgcttctccgtcagagggtctacgaccttcagagactcgaggctcagcgtaatgacctcaacggccgagtgagatcattaaaggaagagctgcagctccttcaggaaccaggatcctatgttggtgaagttgtcaaagtaatgggaaagtcaaaagttcttgttaaggtgcaccctgaaggcaaatatgttgttgatattgacaagagcattgacataaccaagattacaccttcaatgagagttgcattacgtaatgatagttatgtgctccacttgatcctgcccagtaaagttgatcctttggtgaacctgatgaaagttgagaaagttccagactctacctatgatatgattggtggccttgatcagcaaataaaagaaataaaagaggtgattgaactaccaattaaacatcctgaattattcgagagtctgggaatagctcaacctaagggagtcttactatatggacctcctggtactgggaaaactctgcttgctagggcagtggcccatcatactgactgtacttttatccgagtttcgggctctgaattagtacaaaagtacattggagaaggctctaggatggtgagagagctttttgtgatggccagagaacatgctccgtctatcatcttcatggatgagattgatagcatcggatctgctcgtatggaatctggaagcggcaatggagatagtgaggttcaacgaactatgttggaccttctcaaccagcttgatggttttgaagcatctaaataagataaaagtcttgatggctaccaacagaattgatattctggaccaagctcttctcaggcctggaagattgaccggaaaattgagttcccaaatcctaatgaagattcccgatgcgacatcttgaagattcactcgagaagaatgaatttgatgcgaggcattgatctgaagaagattgctgagaaaatgaacggggcatctggtgcagaacttaaggctgtttgtactgaagcgggtatgtttgctctaagagagaggagggtccatgttacccaggaggactttgagatggctgtcgccaaggtcatgaagaaggaaagcgagaaaaacatgtctttgagaaagctttggaagtaaattgtgtgtttactcttgtatccttcacgctgaggctatggatgatgcatcgaggctataacaatgttgttgagaatactgctttttgttgttctctagacactgttaagacagcattttactttatgcaactcttttgtgttggtactccacctacagttatttccagtgaacgactagaattgcagtatcttagacaccaaacactctagtctgtagtctgtaccttttcaatgaagtaactaaatgaagtaaacactatttatgaa

SEQ ID NO: 4291 - DNA, 1701 bp, Cephalotaxus harringtonia
gtttgtgctcagcgcatactctgcagccatgcgagtagacgaagaattgggcgaggttttccgaacacagacacagcaataaattcaatggaaaccctgaaaggaaagcaacaagagcagataaagagcaagaaaatggtgaagcagggcgagggtttacgccaatattatatgcagcacattcacgacctgcagctccaggttcgtcaaaagacgcacaatctcaaccgcctcgaggcccagcgcaacgatcttaactccaaagtacgagcgctgagggaggagttacagttgctgcaggagccgggatcatatgtaggtgaagttgttaaagtaatggggaagtctaaagtattggtgaaggtccatccagaaggaaaatatgttgttgatatagacaagaatattgacataacaaaaatcacaccttccacgagagtagctcttcgaaatgatagttatgttcttcacttgattttgcctagcaaagtagatcctttggtgaatctgatgaaggtggagaaagtgccagattctacttatgatatgattggaggtcttgatcaacagatcaaggaaatcaaagaggttattgaacttcccattaagcatccagaactatttgaaagccttggaattgcacaaccaaagggtgtgctgctgtatggaccccctggtacgggaaagacattactggcaagggcagttgctcatcatacagactgtacttttatcagagtttctggttctgaattggttcagaagtacataggagaaggatcaaggatggttcgtgagctttttgtcatggcaagagaacatgccccatcaatcatctttatggatgagattgacagtatagggtctgctcgtatggagtctgggtctggcaatggagacagtgaagtccagagaactatgcttgagctacttaatcagcttgatgggtttgaggcttctaacaagattaaggttctgatggctaccaaccgaatagatattcttgatcaagcccttcttcgacctggtcggattgacaggaaaattgagtttccgaatcccaatgaagagtctcgctgggacattttgaaaatccattcaagaaaaatgaacctgatgcgtggtattgatctaaagaaaattgctgaaaaaatgaatggtgcctctggtgctgaacttaaggctgtatgcacagaagctggaatgtttgcattgcgagaaaggcgagtccatgtgacacaggaggattttgaaatggctgtagccaaagttatgaaaaaggaaacagagaagaacatgtccttgaggaaattgtggaaataagggggggattgggaatcagtggatttactctctccacagctactgctgttataggtcaaagtcgcatttgttggtttcatattacaagctactattgttttaacagtggatcattgagcaaatgcacaagcatctgcagctgctattccacagatactaccgctatagttcaaagttgcaattattggtttcatatttcaagttactattgtatttaacggtggatcattaaccatatgcacaagctactattattttcccgggcaatatggaaatatgggatatttttgacttgatgctttggaaaaggttttgttttgccagagaatgtatttggaaagctctgagatttttcacgcacaaaatttcctattaaat

SEQ ID NO: 4292 - DNA, 1533 bp, Vinca minor
cctgaagtcctctgtgaatcaatcgttcatcaggaactgggtattgattgattgatcgatttttaatggcggcggcaacaataattgagagtagtaattggtcatcatcggaggaagcagccaccggcaatggcggcgcgctaaagcattaccatcagcagcagaaacaaggaggtcgtggggaaggtctcaggcaatattatttgctccgaatccatgatcttctgctccaagttcgtcacaaaagcgacgatttgctgcgtcttgaagcccagcgtaatgaacttaattccagagtcagaatgcttaaagaagagctccaacttcttcaagagccgggttcatatgttggtgaagttgttaaagtcatggggaaatcaaaagtcttagttaaggttcatcctgaaggaaaatacgtggttgacatcgacaagaatattgacatcacaaaactttctccatcgacccgagttgcattgaagaatgatagctatatgcttcacttgatattacctagtaaagttgacccccttgtgaatctaatgaaagttgaaaaagttcctgattcaacttatgacatgattggtggtcttgatcaacaaattaaagagataaaagaggtcatcgagttaccaataaaacaccctgaattgttcgagagtcttggaatagcacaaccaaagggagtcttgctctatggaccacctggtacgggtaaaacactgcttgccagagctgtcgcccatcatactgattgcaccttcatcagggtttctggttcagaattagttcagaaatatattggagaaggctctaggatggttagggagctcttcgtgatggcacgggaacatgctccatcaatcatcttcatggatgaaattgatagtataggttctgctcgcatggaatctggaagtggaaatggggatagtgaagttcaacggactatgttggagcttcttaaccaacttgatggatttgaagcctcaaacaagataaaagttttgatggccactaacagaattgacattttggaccaagcccttcttagacctgggagaattgacaggaagattgagttcccaaatcccaatgaagagtctaggtttgacatcctgaaaatacactcaagaaggatgaatctgatgcgaggaattgatctgaagaagattgcggagaaaatgaacggtgcctctggggccgaattgaaggctgtttgcactgaagctggaatgtttgctttgcgggagaggagagtccatgtcactcaagaggatttcgaaatggcagtggggaaagtcatgaagaaggattctgagaaaaacatgtcgttgaggaagctttggaagtaagtcgttacgctgtgctaccagaatggaggaacaaaacaccaattctatgtatcagactgtattacgttttccaaactttatttaattccataaaatgactttggattactttttttgtaagaaaaataaatgaattgttgtttcggatttctaagaatgctaatgcacattcaattcg

SEQ ID NO: 4293 - DNA, 1808 bp, Solanum lycopersicum
agaaaagaatctttaaaagcccaaagcagataaatgaaagggtttccaattgctagtatattcttcttcttcctcctttcactcccaaacccaattagtctttgagtctggacaacgcaaatcagtgcgatttcttcaaaacctttctgcaaaaatggcgtcagctgatgttgagaagagcaggatcgatatggagagagaggaagcctgttcggccaaaccaacgaagcaaggggaagggctgagacagtactatatgcagcatatccatgatctccagctccaagtccgcgtaaagactcacaatcttaatcgccttgaggcccagcggaacgaactcaattctaaagtgagaatgctcaaagaggaattacagttgcttcaagagcctggatcatatgttggtgaagttgttaaagtaatggggaagtcaaaggttctagtcaaagttcatcctgaaggcaagtatgttgtcgatattggcaaaaatattgatattacaaagatcactccatcaactagagttgctctgcgaaatgatagctatgtccttcatctaattttgcccagcaaagttgatccattggtcaaccttatgaaagttgagaaggtgccagattccacttatgacatgattggcggtcttgatcagcagatcaaagagataaaagaggttattgagcttcccattaagcatccggagttgtttgagtctcttggaatagctcaaccgaagggagtgcttctctatggacctccaggaactggaaaaacattgttggcgagggcagttgcacatcacactgattgtaccttcattagggtctctggttccgaactagtgcagaaatatattggagaaggttctcgaatggtgagagagctttttgttatggcgagggaacatgctccttctatcatttttatggatgagatagacagcattggatctgctaggatggaatcagggagtggcaatggtgacagtgaagtccagaggacaatgcttgaacttctcaatcagcttgatggatttgaggcatcaaacaaaatcaaggcaagctcaactgttctgatggccacaaaccgtatagatattctagatcaagcactccttagaccaggaaggatagacaggaagattgaattcccaaatcccaatgaagagtctcgtcaggacattttaaagattcattcgaggaagatgaacttgatgcgggggattgatttgaagaagattgcagagaagatgagtggtgcttctggggctgaacttaaggctgtatgtacagaagcagggatgtttgctctaagagagaggagggtgcatgtgacgcaagaagattttgagatggctgttgctaaagtaatgaagaaagagactgagaagaacatgtcactgcgaaagctgtggaagtagatgatggtcgatacgaaggatctgaaacgcatacacatctgagttgattgtctataattaccattgttcttggaacttttatttgaccccaggagcttacgacttgccctttagtattttcatgtttctcagtaagctatttcgttttctttggctgtttggggcgtccgcgtggctgattcagattttttctgtgttttttcctgcggctttagtatttgatactctggcttttagcttgtattcttgtttattgacatgctctacttctttttcggctctaacttaaaagccctgcctaggagttttacttgtactctttcaattttaagttacatgaaacgtgttttttttcattatttaattttaaattttcatattttaggcc

SEQ ID NO: 4294 - DNA, 1807 bp, Solanum lycopersicum
agaaaagaatctttaaaagcccaaagcagataaatgaaagggtttccaattgctagtatattcttcttcttcctcctttcactcccaaacccaattagtctttgagtctggacaacgcaaatcagtgcgatttcttcaaaacctttctgcaaaaatggcgtcagctgatgttgagaagagcaggatcgatatggagagagaggaagcctgttcggccaaaccaacgaagcaaggggaagggctgagacagtactatatgcagcatatccatgatctccagctccaagtccgcgtaaagactcacaatcttaatcgccttgaggcccagcggaacgaactcaattctaaagtgagaatgctcaaagaggaattacagttgcttcaagagcctggatcatatgttggtgaagttgttaaagtaatggggaagtcaaaggttctagtcaaagttcatcctgaaggcaagtatgttgtcgatattggcaaaaatattgatattacaaagatcactccatcaactagagttgctctgcgaaatgatagctatgtccttcatctaattttgcccagcaaagttgatccattggtcaaccttatgaaagttgagaaggtgccagattccacttatgacatgattggcggtcttgatcagcagatcaaagagataaaagaggttattgagcttcccattaagcatccggagttgtttgagtctcttggaatagctcaaccgaagggagtgcttctctatggacctccaggaactggaaaaacattgttggcgagggcagttgcacatcacactgattgtaccttcattagggtctctggttccgaactagtgcagaaatatattggagaaggttctcgaatggtgagagagctttttgttatggcgagggaacatgctccttctatcatttttatggatgagatagacagcattggatctgctaggatggaatcagggagtggcaatggtgacagtgaagtccagaggacaatgcttgaacttctcaatcagcttgatggatttgaggcatcaaacaaaatcaaggcaagctcaactgttctgatggccacaaaccgtatagatattctagatcaagcactccttagaccaggaaggatagacaggaagattgaattcccaaatcccaatgaagagtctcgtcaggacattttaaagattcattcgaggaagatgaacttgatgcgggggattgatttgaagaagattgcggagaagatgagtggtgcttctggggctgaacttaaggctgtatgtacagaagcagggatgtttgctctaagagagaggagggtgcatgtgacgcaagaagattttgagatggctgttgctaaagtaatgaagaaagagactgagaagaacatgtcactgcgaaagctgtggaagtagatgatggtcgataagaaggatctgaaacgcatacacatctgagttgattgtctataattaccattgttcttggaacttttatttgaccccaggagcttacgacttgcccttagtattttcatgtttctcagtaagctatttcgttttctttggctgtttggggcgtccacgtggctgattcagattttttctgtgttttttcctgcggctttagtatttgatactctggcttctagcttgtattcttgtttattgacatgctctacttctttttcggctctaacttaaaagccctgcctaggagttttacttgtactctttcaattttaagttatatgaaacgtgttttttttcattatttaattttaaattttcatattttaggcc

SEQ ID NO: 4295 - DNA, 1604 bp, Amborella trichopoda
gggggaagttcagaacaaacctcaaagagagagagagagataggagagagagagagagctctgaatctgtgaaaaaatggtgaagcaaggagaggggcttaggcagtactacttgcagcacatccatgatctacaattgcaggtgcgccagaagacccacaatctcaatcgtcttgaagcccaacgcaatgatctcaactccagagttcggatgcttagagaggagttgcagctgttgcaagagccaggctcatatgttggtgaagtggtgaaggtcatggggaagtccaaagttctggttaaggtgcaccccgaggggaaatatgttgtagatattgataagaacattgatataacaaaaattacaccgtccaccagagtcgctcttcgtaatgatagctatgttcttcatttaattttgcccagcaaagtggaccctctggttaaccttatgaaagttgaaaaggttcctgattctacttatgacatgattggtggccttgaccaacaaatcaaagaaataaaagaggtcattgagctgccaatcaaacatccagaactatttgagagccttggaattgcacagccgaagggagtcttactttatggacctcctggaactggaaagacgctgttagctagggctgttgctcaccatacagattgcacatttatcagggtttctggttctgagctggtacagaagtacattggagaaggttctagaatggttcgagaactttttgttatggctagagaacatgcgccttcaatcattttcatggatgagatcgacagtataggatctgctcgcatggaatctgggacaggcaatggggatagtgaagtccaaagaaccatgcttgaactcttgaatcaactcgatggatttgaagcatctaacaaaatcaaggttttgatggccacgaatcgaattgacattcttgaccaagcgcttcttcggcctggccgcattgaccggaagattgaattcccaaatcctaatgaggagtctcgtctggatattttgaaaattcattcgaggaaaatgaatctcatgcggggaattgatctcaagaagattgcagagaagatgaacggtgcctcaggggctgagctcaaggcggtttgcacggaagctggaatgtttgcgcttagagaacgccgagttcacgttacccaagaggatttcgagatggcagtggccaaggttatgaagaaggaaacagagaagaacatgtcattgaggaagttgtggaagtgagaaggccttctctttctcagcaattgaaatctgttctgtgtttcgttactcggatattcagctcttgtatatgtctggccttaattgaatttcttcctgttcttttggaatttatactttttttgcccttttggttaaatctgtatggattaatacgtgtaaaattcctatggtttggcatatagtccttaccttgagagaaaacggctttaaatttaattaatttcagtgctggacgattaggttctgatctgaaattgttaatttctctctcaatgctttaatccatcctagtaggtcagaacccgaaattactcccatcgatttctgtctctcttgc

SEQ ID NO: 4296 - DNA, 1528 bp, Amborella trichopoda
aaagcagggttcaagtgcgaagtttgaagagagagagagagagagagctgtgaaacggtgaaaaaatggtgaaacaaggagaggggcttaggcagtattacgtgcaacacatccatgatctacaattgcaggtgcgccagaagacccacaatctcaatcgtcttgaagctcaacgcaatgatctcaactctaaagtcaggatgcttagagaggagttgcagctgttgcaagagccaggatcatacgttggggaagtggtgaaggttatgggcaagtccaaggttttggttaaggtgcatcccgaggggaaatatgttgtagatattgataaaaacatcgatataacgaaaatcacaccgtccaccagagttgctcttcgtaatgatagctatgttcttcatctgattttgcctagcaaagtggaccctttggtgaaccttatgaaagttgaaaaggttcctgattctacatatgacatgattgggggccttgaccaacaaatcaaagaaattaaagaggttattgagctgccaattaaacatccagaactatttgagagccttggaattgctcagccaaagggagtcttactttatggacctcctggaactggaaagaccctattagcaagggctgttgctcatcatacagattgcacatttattagggtttctggttctgagctggttcagaagtacattggtgaaggatctcgaatggttcgagaactttttgttatggctagagaacatgcaccttcaatcatcttcatggatgagatcgacagtataggatccgcccgcatggaatctgggacaggcaatggggatagtgaagtccaaagaacaatgcttgaacttttgaatcaacttgatggatttgaagcatctaacaaaataaaggttttgatggccactaatcgcatcgacattcttgaccaagcccttcttcggcctgggcgcattgaccggaagattgaattcccaaatcctaatgaggagtctcgtttggatattttgaaaatccactcgaggaaaatgaatcttatgcggggaattgatctaaagaagattgcagagaagatgaatggtgcttccggggctgaactcaaggccgtttgcacagaagctggaatgttcgctcttagagaacgtcgggtgcacgttacccaggaggatttcgagatggcagtggccaaagttatgaagaaggaaacagagaagaacatgtcattgaggaagttgtggaagtgagaaagcttcattttttcaacgattcaactctgatagatgcttctttctgggattttccagctcttacacctcgagctttagtttaaatttctaccggtgcagtatgagtccataaattgcttccttctttggctgattttgtatggatctatacatgtaaaagttctgtgaattgctatatggttcttacctgaagttcatggttcatagccactttcaagaaaaatttccatgcgcctcaaaattattaaaaatctattaacttataaatccat

SEQ ID NO: 4297 - DNA, 1575 bp, Cephalotaxus harringtonia
ctgcacctgttccaaacttcgcaaagtaacaacgtatattgcgagggttttgttaaattgaaattgtgagagaagcagagaccggatttcagaagtctcgaggaaaagcttcaagcaatctcacagtaacaggatggtcaaacagggcgagggtttgcgtcaatattaccttcagcacattcacgacctgcagcttcaggtccgtcaaaagacgcacaatcttaaccgcctcgaggcccagcgcaatgatcttaattccaaagtgaggatgctaagagaggagttacaattgctgcaggagccagggtcatatgtaggcgaagttgtcaaagttatggggaaatctaaagtattggtaaaggtgcatcctgaaggaaaatatgttgttgatatagacaagaacattgacataacgaaaatcactccttctacacgagtagctcttcgtaatgatagttacatgcttcacttgattttgcctagcaaagtagatcctttggtgaacctgatgaaggtggaaaaagtgccagattctacttatgatatgattgggggtcttgaccaacagattaaggaaatcaaagaggttattgaacttccaattaagcatccagaactatttgaaagtcttggaatcgcacaaccaaagggtgtattgctgtatggaccacctggtacaggaaagacattgctggcgagggcagttgctcatcacacagactgtacttttatcagagtttctggttctgaattggttcagaaatacataggagaaggttcaagaatggttcgcgagctttttgttatggcaagagaacatgccccttccataatatttatggatgagattgacagtatagggtctactcgaatggagtccgggtctggcaatggtgacagtgaagtgcagagaactatgcttgagctgcttaatcagctcgatgggtttgaagcatccaacaaaattaaggttctaatggctaccaatcggatagatattcttgatcacgcacttcttcgacctggtcggattgacaggaaaattgagtttcccaatccgaatgaagagtctcgttgggatattttgaaaatccattcaagaaaaatgaacctgatgcgtggcattgatctgaagaaaattgctggaaaaatgaacggtgcttcaggtgccgaacttaaggctgtatgcacagaagcaggaatgtttgcgctacgagaaagacgagtccatgtgacacaggaggattttgaaatggctgtagccaaagttatgaaaaaggaaacagagaaaaacatgtctttgaggaaattatggaaataacgaggggaaggatcagaggatgtacttgtctatagctactgcaatagttcaaagctgcacctattggttccatttttcaagctactattttatttaatggtggatcattgagcatgcacaagagattatattacactcaagcaacacggaaataagtggatagcttaggactaactttaagttagtgcttttggatggggtttctgtgttgctagggaatgtatttgttgtgttgtttgaaggattttccatgc

SEQ ID NO: 4298 - DNA, 1365 bp, Elaeis guineensis
ggggggcggaggagaagggctgcggcagtactacctgcagcacatccacgatcttcagctccagctccgccagaagactcacaacctcaaccgtctcgaggcccagcgcaacgaactcaactcccgagtaagaatgcttcgagaggagctacaactacttcaagagcctgggtcatatgttggtgaagtggtgaaagttatggggaaatcaaaagtcttagttaaagttcatccagaagggaaatatgttgtggatattgataagaacattgatataacaaagatcacaccgtcaaccagagttgctcttcgcaatgatagttatgtgcttcacttaatcttgcctagcaaagtagatcctttggttaatcttatgaaagttgaaaaggttcctgattctacttatgacatgattggtggtcttgaccagcaaatcaaggagataaaggaggtcattgagcttccaattaaacatcctgaattatttgaaagccttggaatagctcaaccaaagggagtgttgctttatgggcctccaggtacagggaaaactctgctagcaagagcagttgctcatcataccgattgtaccttcattcgggtttctggttctgagttggttcagaaatacattggagagggctccagaatggttcgagaactctttgttatggctagggaacatgctccatcaatcattttcatggatgaaatcgacagcattggatctgcaagaatggagtcaggcactggcaatggcgatagtgaagttcaacgtaccatgcttgagcttctcaaccagcttgatggatttgaagcatcaaacaagatcaaagttctgatggccacaaaccggatagacatcttggatcaagccctcctcaggcctggccggattgatagaaaaattgagttccctaaccctaacgaagagtctcgtttggatatcttgaaaattcactcgagaaagatgaacctgatgcgaggtattgatcttaaaaagatcgcagaaaagatgaatggggcatctggagcagaactcaaggcggtgtgcactgaagcaggcatgtttgcactcagggagagaagagttcatgtaacccaggaggattttgagatggcagtagccaaggtcatgaagaaagagactgagaagaacatgtccctcaggaagctgtggaagtagatcttctctattttctcgctcttcttattgatgttccgaggggcataaattattgtacgtgatccttaaacctttttgaacttgaaactgttgcattttaagtggtgattcggtaaagtttatgcaaatgctgtaagtataccatgataggacatctaataatgatgggttagcttggt

SEQ ID NO: 4299 - DNA, 2359 bp, Brachypodium distachyon
aagcaaacttgctggaaaagaagctctctctcgttgaaggtgatcccgagtcgactcgcccgaacaaacaaagcgccggaggttcgatggcggcggtggagatggcaatctcgaagccctcgactctgccgggcgtcgacgacccggcgtcgtcggcggcgaaggggagggccggcggcggggaggggctgcgccagtactaccagcagcacatccacgacctgcagctccagatccggcagaagacccacaacctcaaccgcctcgaggcccagcgcaacgacctcaactcccgagttagaatgctccgggaagagttgcagctacttcaagaaccgggctcatacgttggagaggttgttaaggttatgggcaagtcgaaggttctagtgaaggtgcacccagaaggcaaatatgttgtagatctcgataaaagtatcgatattacaaagataaccccttcaacgagggttgcccttagaaatgacagctacatgcttcaccttatcctgcccagcaaagtcgatccactggttaatctgatgaaggtggagaaggttcccgactctacctacgatatgattggtggtctggatcagcagatcaaagagatcaaggaggttattgagcttcccattaagcatcctgaactgtttgagagccttggtattgcccaaccaaagggcgtgcttctttatgggcctccgggtacaggaaaaacattacttgcacgtgcagttgctcatcacactgactgcaccttcattagggtgtctggctctgagttggttcagaagtatattggagagggttcccgaatggttcgggaactcttcgtgatggctagggaacatgcgccgtcgattatatttatggatgaaatagactctattggatctgctagaatggagtcaggaactggcaacggtgatagtgaggttcaacgtactatgcttgagcttctaaaccaacttgatggttttgaagcatcaaacaaaattaaggttcttatggcaacaaataggatagacatattggatcaagctctcctgaggccaggtcgtattgacaggaagattgagtttccaaatcctaacgcagattcccgtggtgatatcttgaagattcattcaagaaaaatgaacttgatgcgcggcattgatctgaaaaagattgccgagaagatgaacggagcatcaggggcggagctaaaggcggtctgcacagaagctggaatgtttgccctccgtgagagaagggtgcatgttacccaggaggatttcgagatggcagtggcgaaggctctccccaacaccccgcccgtggactacccctgcttcaagctcgtccttgtcggcgacggcggcaccgggaagacgacgttcgtgaagaggcacatcactggggagtttgagaagaaatacgaaccaacgatcggcgtggaggtgcggccgctggacttccacacgagccacggcaagatcaggttctactgctgggacactgccggccaggaaaagtttggtggcctccgtgacggttactacatccatggccagtgcgcgatcatcatgtttgacgtcacctcccggctcacctacaagaacgttcccacctggcacagggacatctgcagggtgtgcgaaaacatcccgatcgtcctgtgcggcaacaaggtggacatgaagaacaggcaggtgaaggccaagatggtgaccttccacaggaagaagagcctgcagtactacgagatctctgccaagagcaactacaacttcgagaagccttttctctaccttgcaaggaagctctcaggggacatgaacctccggtttgtcgaggagacggccctcctgcctgccgatgtcactgttgatctcatcacgcagcaacagattgaggcggagatagcagctgccgcagcaatgcccctcccagatgacgatgaggacaacatggactgagctgatcgaccggaggctgtgcgtctgtgcctagtttagtactcttgaaagtatttcgtgagacttgcatgtctgtttttaggctttcagtaggctggtttctccagtggtccatatgactctctcagcagtagttgatctgatgagttcgactcttgagatttcgtttgcaagtatacttaagaaaacccaaagaatttgaagtttaaatcagtttctgatattctggagtgccgagtgtggtgctgttctatttttattcttattttttatagaaatatgaacaagaacaactgtggcctgcccacggaacaggcaacaccatgcagtggagctctgtagacccgattcttaactgtgtcatgccggttgcctaccgagagacagcttccgcg

SEQ ID NO: 4300 - DNA, 1977 bp, Pinus pinaster
ctcccagagtgttataaattctttaaaagctgcaaagcgcttttatttttcctcttcattttccgtcatttcgtctgagggtttgtagcgatgcgtgtagaggaactcggaggaattctgaaacctgcctcagacttggaggccgctgcaaacgcgaaggaaaaattgaaggagaaacatcagctccccaaagaatctaacagaatggtgaagcatggcgagggtttgcgccagtattaccttcaacatattcacgatctccagctccaggtccgtcagaagacgcacaatctcaaccgtcttgaagcccagcggaacgatcttaattccaaagtgagagcactgagggaggaattacagttgctccaggaaccgggatcgtatgttggtgaagttgttaaagttatggggaagtctaaagttttggttaaggtgcatcctgaaggaaagtatgtagttgatgtagacaagaacattgacataacaaaaatcacaccttctacaagagtagctcttcgtaatgatagctacgtgcttcatttgattttgcctagcaaagtagacccgttggtcaacctgatgaaggtggagaaagtgccggattctacatatgacatgattggaggacttgaccaacagattaaggaaatcaaagaggttatcgagcttcctatcaagcatccagaactgtttgaaagtcttggaatagctcaaccaaagggtgtactgttgtatggaccccctggcactggaaagacattgcttgcaagggcagttgctcatcacacagactgcacctttattagagtttcaggttctgaattggttcagaagtacataggtgaaggatcaaggatggttcgtgagctttttgttatggcaagagaacatgctccctcgattatatttatggatgaaattgacagtataggatctgctcgaatggagtctggcactggtaatggtgatagtgaagtccagcgaactatgcttgagctccttaatcaacttgatggctttgaggcatctaataagattaaggttctaatggctacaaaccggatagatattcttgatcaagcacttcttcgacctggtaggattgacaggaaaattgaatttcctaatcctaatgaagagtctcgttttgacattctgaaaatccactcaagaaaaatgaatctaatgcggggcattgatctaaagaaaattgctgaaaaaatgagtggtgcatcaggtgcagagcttaaggctgtatgcacagaagctgggatgtttgcattgcgggagcgacgtgtccatgttacacaagaagattttgaaatggctgtagctaaggttatgaaaaaggaaacagagaagaacatgtcactgaggaaactatggaagtaaggaaaggatcagtggattcgttggttcaatatatcaagctactgtgtgtatttcagtgggttaaacatgtccaagtggttgtattacttgcgatggcaacatggaaaataagtggatattttgcaagtgaaatttgtttctaaattcattttgggcttgaagatgccttggtctatatattctctgcgggaagcttggacttcgaatcaaaaaatttagttaatttccaaagcacaaaaacatcctcatctcttattttagcaagaattagaaatgtggttatagttattgttgaatatcatgtcagatatggcagtgcttttcaaattacggtttggaactttctcccagagatgcatatagtgttgcacctttgtaagaattttaaacgtgatttcgttttgagttagcaagatgcagcactgaaatgtagtattctggtattggatgagctagttattagtgtttaggccagactactgctatttaaatcagtgtctgtactatgtagtaacttctttggaaaagatggtatattaggtgataaatacaaaatggtgttataggcctacccttttctcatat

SEQ ID NO: 4301 - DNA, 1951 bp, Pinus taeda
tctcctcttcctcccggagtgttataaattctttgaaagctgcaagcacttttattttttcctttgtcatttttcgtcatttcgtctgagggtttgtagcgatgcgtgtagaggaactcggaggaattctgaaacctgcctcagacttggaggccgctgcaaacgcgaaggaaaaattaaaggagaaacatcagctccccaaagaatctaacagaatggtgaagcatggcgagggtttgcgccagtattaccttcaacatattcacgatctccagctccaggtccgtcagaagacgcacaatcttaaccgtcttgaagcccagcgaaacgatcttaattccaaagtgagagcgctgagggaggaattacagttgctccaggaaccgggatcgtatgttggtgaagttgttaaagttatggggaagtctaaagttttggttaaggtgcatcctgaaggaaagtatgtagttgatgtagacaagaacattgacataacaaaaatcacaccttctacaagagtagctcttcgtaatgatagctacgtgcttcatttgattttgcctagcaaagtagacccgttggtcaacctgatgaaggtggagaaagtgccggattctacatatgacatgattggaggacttgaccaacagattaaggaaatcaaagaggttatcgagcttcctatcaagcatccagaactatttgaaagtcttggaatagctcaaccaaagggtgtactgttgtatggaccccctggcactggaaagacattgcttgccagggcagttgctcatcacacagactgcacctttattagagtttcaggttctgaattggttcagaagtacataggtgaaggatcaaggatggttcgtgagctttttgttatggcaagagaacatgctccttcgattatatttatggatgaaattgacagtataggatctgctcgaatggagtctggcactggtaatggtgatagtgaagtccagcgaactatgcttgagctccttaatcaacttgatggctttgaggcatctaataagattaaggttctaatggctacaaaccggatagatattcttgatcaagctcttcttcgacctggtaggattgacaggaaaattgaatttcctaatcctaatgaagagtctcgttttgacattctgaaaatccactcaagaaaaatgaatctaatgcggggcatcgatctaaagaaaattgctgaaaaaatgagtggtgcatcaggtgcagagcttaaggctgtatgcacagaagctgggatgtttgcattgcgggagcgacgtgtccatgttacacaagaagatttcgaaatggctgtagctaaggttatgaaaaaggaaacagagaagaacatgtcactgaggaaactatggaagtaaggaaaggatcagtggattcgttggttcaatatatcaagctactgtgtgtatttcagtgggttaaacatgtccaagtggttgtattacttgcgatggcaacatggaaataagtggatattttgcaagtgaaatttgtttctaaattcattttgggcttgaagatgccttggtctatatattctctgcgggaagctaggactctgaatcaaaaaatttagttaatttcctaagtacaaaaacatcctcatctcttattttagcacgaattagaaatgtggttctaattaattgttgaatatcatgtcagatatggcagtgattttcaaattacggtttggaactttctcctagagatgcatatagtgttgcaactttgtaagaattttaaacgtgatttcgttttgagttagcaagatgcagcattgaaatgtagtattctgatattggatgagctagttattagtttttaggtcagactactgctatttaaatcagtatctgtagtaacttctttggaaaagatggtatattgggtgataaatacaaaa

SEQ ID NO: 4302 - DNA, 1920 bp, Pinus taeda
aattcggcacgagggtcatttcgtctgagggtttgtagcgatgcgtgtagaggaactcggaggaattctgaaacctgcctcagacttggaggccgctgcaaacgcgaaggaaaaattgaaggagaaacatcagctccccaaagaatctaacagaatggtgaagcatggcgagggtttgcgccagtattaccttcaacatattcacgatctccagctccaggtccgtcagaagacgcacaatcttaaccgtcttgaagcccagcgaaacgatcttaattccaaagtgagagcgctgagggaggaattacagttgctccaggaaccgggatcgtatgttggtgaagttgttaaagttatggggaagtctaaagttttggttaaggtgcatcctgaaggaaagtatgtagttgatgtagacaagaacattgacataacaaaaatcacaccttctacaagagtagctcttcgtaatgatagctacgtgcttcatttgattttgcctagcaaagtagacccgttggtcaacctgatgaaggtggagaaagtgccggattctacatatgacatgattggaggacttgaccaacagattaaggaaatcaaagaggttatcgagcttcctatcaagcatccagaactatttgaaagtcttggaatagctcaaccaaagggtgtactgttgtatggaccccctggcactggaaagacattgcttgccagggcagttgctcatcacacagactgcacctttattagagtttcaggttctgaattggttcagaagtacataggtgaaggatcaaggatggttcgtgagctttttgttatggcaagagaacatgctccttcgattatatttatggatgaaattgacagtataggatctgctcgaatggagtctggcactggtaatggtgatagtgaagtccagcgaactatgcttgagctccttaatcaacttgatggctttgaggcatctaataagattaaggttctaatggctacaaaccggatagatattcttgatcaagctcttcttcgacctggtaggattgacaggaaaattgaatttcctaatcctaatgaagagtctcgttttgacattctgaaaatccactcaagaaaaatgaatctaatgcggggcatcgatctaaagaaaattgctgaaaaaatgagtggtgcatcaggtgcagagcttaaggctgtatgcacagaagctgggatgtttgcattgcgggagcgacgtgtccatgttacacaagaagatttcgaaatggctgtagctaaggttatgaaaaaggaaacagagaagaacatgtcactgaggaaactatggaagtaaggaaaggatcagtggattcgttggttcaatatatcaagctactgtgtgtatttcagtgggttaaacatgtcgaagtggttgtgttacttgcgatggcgacatggaaataagtggatattttgcaagtgaaatttgtttctaaattccttttgggcttgaagatgccttggtctatatattctctgcgggaagcttggactcaatcaaaaagtttagttaatttccaaagtacaaaaacatcctcatctcttattttagcaagaactagaaatgtggttctaattaattgttgaatatcatgtcagacatggcagtgcttttcaaattacggtttggaactttctcctagagatgcatatagtgttgcacctttgtaagaattttaaacgtgatttcgttttgagttagcaagatgcagcactgaaatgtagtattctgatattggatgagctaattattagtttttaggtcagactactgctatttaaatcagtatctgtagtaacttctttggaaaagatggtatattaggtgataaatacaaaatggtgttataggcctaaaaaaaaaaaaaaaaa

SEQ ID NO: 4303 - DNA, 1882 bp, Pinus taeda
gcgatgcgtgtagaggaactcggaggaattctgaaacctgcctcagacttggaggccgctgcaaacgcgaaggaaaaattgaaggagaaacatcagctccccaaagaatctaacagaatggtgaagcatggcgagggtttgcgccagtattaccttcaacatattcacgatctccagctccaggtccgtcagaagacgcacaatcttaaccgtcttgaagcccagcgaaacgatcttaattccaaagtgagagcgctgagggaggaattacagttgctccaggaaccgggatcgtatgttggtgaagttgttaaagttatggggaagtctaaagttttggttaaggtgcatcctgaaggaaagtatgtagttgatgtagacaagaacattgacataacaaaaatcacaccttctacaagagtagctcttcgtaatgatagctacgtgcttcatttgattttgcctagcaaagtagacccgttggtcaacctgatgaaggtggagaaagtgccggattctacatatgacatgattggaggacttgaccaacagattaaggaaatcaaagaggttatcgagcttcctatcaagcatccagaactatttgaaagtcttggaatagctcaaccaaagggtgtactgttgtatggaccccctggcactggaaagacattgcttgccagggcagttgctcatcacacagactgcacctttattagagtttcaggttctgaattggttcagaagtacataggtgaaggatcaaggatggttcgtgagctttttgttatggcaagagaacatgctccttcgattatatttatggatgaaattgacagtataggatctgctcgaatggagtctggcactggtaatggtgatagtgaagtccagcgaactatgcttgagctccttaatcaacttgatggctttgaggcatctaataagattaaggttctaatggctacaaaccggatagatattcttgatcaagctcttcttcgacctggtaggattgacaggaaaattgaatttcctaatcctaatgaagagtctcgttttgacattctgaaaatccactcaagaaaaatgaatctaatgcggggcatcgatctaaagaaaattgctgaaaaaatgagtggtgcatcaggtgcagagcttaaggctgtatgcacagaagctgggatgtttgcattgagggagcgacgtgtccatgttacacaagaagatttcgaaatggctgtagctaaggttatgaaaaaggaaacagagaagaacatgtcactgaggaaactatggaagtaaggaaaggatcagtggattcgttggttcaatatatcaagctactgtgtgtatttcagtgggttaaacatgtccaagtggttgtattacttgcgatggcaacatggaaatagtggatattttgcaagtgaaatttgtttctaaattcattttgggcttgaagatgccttggtctatatattctctgcgggaagcttggaccctgaatcaaaaaatttagttaatttccaaagtacaaaaacatcctcatctcttattttagcaagaattagaaatgtggttctaattaattgttgaatatcatgtcagacatggcagtgcttttcaaattacggtttggaactttctcctagagatgcatatagtgttgcaactttgtaagaattttaaacgtgatttcgttttgagttagcaagatgcagcattgaaatgtagtattctgatattggatgagctagttattagtttttaggtcagactactgctatttaaatcagtatctgtagtaacttctttggaaaagatggtatattgggtgataaatacaaaatggtgttataggcctacccttttctcatat

SEQ ID NO: 4304 - DNA, 1560 bp, Zostera marina
gggggactctgttcagttcgtactttggtagcttgcgatttaggaaagagcggagatggcagcgatggaggtggaaaccaatcttgtggcgaagaaagtaattacgagtatggagatgcgttcgccgggaaaagtaagagccggagatggtctccggggatactacatgcagcatatcaacgatctcatgcttcaggttaatcagaagtcggataacctcggccgcctcaaagcccagaggaacgatcttaactccaaagtcaggatgcttaaagaggaattgcagttgctgcaagaacctgggtcttatgttggggaagtggttaaagtaatgggaaaatcaaaagtccttgtcaaggtccacccagaaggaaaatatgttgtcgacattgataagagcattgacataaccaaaattaccccgtcaactagagtagctctgcgcaatgatagttatgttctccatttagttttgcccagcaaagttgaccctttggtcaatcttatgaaagtggaaaaggttcctgattctacttatgacatgattggtggtctcgatcagcaaattaaagaaattaaagaggtgattgaactgccaatcaaacatcctgagctgtttgagagccttggtattgcccaaccaaagggtgtcttgttatatggaccacctggtacgggaaaaactcttcttgctagggctgtggcacatcacactgattgcacatttattcgagtctctggttctgaattggttcaaaaatacattggagaggggtcaagaatggttagggagctttttgtcatggcaagagaacatgcaccatctattattttcatggatgagattgacagtattggatctgctcgaatggaatcaggatctggaaatggggatagtgaagttcagagaactatgcttgagcttctcaatcaacttgatggttttgaagcctcaaataagatcaaggttctaatggcaacaaatagaattgatattcttgatcaagctctgttaaggcctggtcgtatagacaggaaaattgaatttcccaaccctaatggagagtctcgatgtgatatcttgaaaatacattcaagaaaaatgaatctgatgcgcggaattgatttaaagaaaattgccgaaaagttgaatggtgcttcaggggctgaacttaaggcggtatgcacagaatccggcatgtttgcactccgagagaggagggttcatgtgacccaagaagattttgagatggcagtcgctaaggttatgaagaaggagacagagaaaaacatgtctttaaggaagttgtggaagtaggtacaaattttaaaatattcaatatctccagtcttatttatcaaaaccaaaatgtgagacccttagttttttttcatataactggaatatttaaatcctccaaatcccaaaacaagtttatattctctgtattttatgatagtagacgcatcttcttttaaaatatgaaaatggcaaaaatatgaaacaagcaaacaaatcaccaaccatttttgtatctgtgtgattgtatcagattcaac

SEQ ID NO: 4305 - DNA, 1422 bp, Ambrosia trifida
cctaatactttaaaaactaattaggttcttataatccactctatcttcattcattcacatcaatcatatataatataatggtgtcagcggagatatcaacgaaagcgttaaaacaaatggattcaaaacctggagatggtctgaaacaatattaccagcaacatatccacgatgctcaactccaggttcgccacaagaccaataatctcaaccgtcttcaggctcagcgtaacgacctcaattccaaagtgaggatgcttaaggaagagttgcagctgcttcaagaacctggatcgtatgttggtgaagttgtcaaagtaatgggaaaatcaaaagttctagtgaaggtgcacccagagggtaaatatgtggttgatatcgataaaagcattgatattactaaaatcacaccatcaaccagggttgctcttaagaatgatagctatgttctccatttagttttgccaagcaaagttgaccctcttgtgaaccttatgaaagttgaaaaggttcccgactctacatatgatatgatcggtgggcttgaccagcaaatcaaagagattaaggaggttattgaacttccaatcaaacatccagagttatttgagagtctgggtattgctcaaccgaagggagttcttttatacgggccaccaggtacagggaagacattgttagccagagcggtggctcatcacactgactgtactttcattagggtttctggctctgagttagtacagaagtacattggagaaggttccaggatggttagagagctttttgttatggccagggaacacgcaccatcgattatatttatggatgaaatagacagtattggatctgctagaatggagtctggaagtggaaatggtgacagtgaagtccaaagaacaatgctggagcttcttaatcaactggatggatttgaagcatcaaacaagatcaaggttttgatggctacaaatcgaattgatatcctggatcaggcccttcttaggccaggaagaattgataggaaattgaatttccaaatcccaatgaagactcgaggtttgatatcttgaaaattcattcaagaaaaatgaacttaatgcgtggcattgatctagaaaaaaattgactgagaaaatgaatggcgcttcaggtgccgaactgaaggcggtctgcacagaggcagggatgtttgcgctgagagaaaggagagtccatgtgacacaagaagattttgagatggcagttgccaaagtcatgaaaaaggacaccgagaaaaacatgtcgctccgcaagctctggaaataaatgttacggtttttaaaggtctataacggtgaacacggaattctgtatgtttttttattaaattctatgaccgcggaattctgtatgggattatgtcgaaaactatggagattt

SEQ ID NO: 4306 - DNA, 1602 bp, Vigna unguiculata
ggataccgaccgacataacccaggaaagagagaagagaagagaagagagaagaagaaagaggattaagaaggtggtggtttgggttttgctctgattttcatcgctgaaaggcagagagagatctatctttgtatctatggctcttgcgggagttgaagtgaagcatgtggaggttgtgccagaggagaattgctccgccaagcccaccaagcagggcgagggtctccgccactactattctctcaacatccacgagcaccagctccttctccgtcaaaagacgcataacctcaatcgtcttgaggctcagcgtaacgagctcaattcaagggtgaggatgcttcgcgaagagttgcagcttcttcaagagcctggctcctatgtcggtgaagttgtcaaagtgatgggcaagaacaaagtccttgtcaaggtccaccccgaaggaaaatatgttgtcgacattgacaaaaatattgacattacaaagatcactccatccactagagttgcacttcgcaatgatagctatgttcttcatttagttctgcccagtaaagttgatccgttggtcaatctgatgaaagttgagaaagttcctgattctacgtatgacatgatcggtggtttagaccagcaaatcaaagaaatcaaagaggttatcgagctaccaattaagcatcctgagctctttgagagtcttggaattgcacaaccaaagggtgtactgctgtatgggccacctggtacaggaaaaacgttgttggctagggcagtggctcatcatactgactgtacgttcataagggtgtctggttctgaattggttcagaaatacattggagaaggttctagaatggtcagggaacttttcgttatggccagggaacatgctccatcaattatcttcatggacgaaattgacagcattggatctgctcgtatggaatctggaagtggcaatggtgatagtgaggtacaacgtactatgctggaacttctcaaccagctggatggatttgaagcttcaaataagatcaaggttttgatggcaacaaataggattgatatcttggatcaagctctccttagacctggacgaattgataggaagattgaatttcctaaccctaatgaagagtctcggctggatattttgaaaatccattcaaggagaatgaatttaatgcgtggcattgatttaaagaagattgctgagaagatgaatggagcatctggtgctgaacttaaggctgtatgcactgaagccggtatgtttgctttgagggagaggagggtacacgtgactcaggaggattttgagatggcggtggccaaggtgatgaaaaaggagactgaaaaaaatatgtcattgcggaagttgtggaagtgatttttattttatgtttctggtgcacttatcttgtgaagtcggacaacagaatcaccttagggtttcaatttacagtggcattggttttccttttgatttaagtttaccatgttatgtaccaaatcattattcttttcagttgagtttcctcattctgtgtcttcgaattgcacacaacatttatagagtattttacaaaaattcttattta

SEQ ID NO: 4307 - DNA, 1395 bp, Gnetum gnemon
atccaatcgaatcagagataacaatcaatgatggtgaaacaaggcgaagggctgaggcactactacctacagaacatccatgacctgcaactgcaggtccgccaaaagacacacaatctgaaccgtcttgaggctctgcgcaatgatctgaattccaaagtgaggatgctgcgggaggagttgcaattgttgcaggagccaggatcatacgtgggagaagttgtcaaggttatgggcaagtccaaggttcttgttaaggttcatcccgaaggaaagtatgtggtagatgtggacaagaatattgacattacgaagatcacaccttcggccagagttgctcttcgcaatgatagttatgttctgcacctgattcttcccagcaaggttgatcctttggtgaatctgatgaaggtggagaaggttccagattcaacctacgatatgattggaggacttgaccagcaaattaaggagattaaggaggtcattgagctgcccattaagcatccagagttgtttgaaagtctcggaatagctcagccaaagggtgttctcctctacgggccccctggtacggggaaaacgcttctggcaagagcagttgctcatcatacagactgcacttttatcagagtttcaggttccgaattggttcagaaatatattggagaagggtcaagaatggttcgagagctttttgttatggctagagagcatgctccatccattatctttatggatgaaatagacagtataggatctgcaagaatggaatctggatctggaaatggtgacagtgaagtgcaacgaactatgcttgagcttctgaatcagttagatggatttgaagcatcaaacaagatcaaggtcctcatggccacaaacagaatagacatactcgaccaagctcttcttagacccggtagaattgatagaaaaattgaatttcctaatccaaatgaagagtcccgttttgatattctgaaaattcattcgagaaagatgaatttgatgcgtggaattgatctaaggaaaattgcagaaaagatgaatggtgcttctggtgcagagctgaaggctgtgtgtacagaggctggcatgtttgctttaagagagagacgcgttcacgtcactcaagaggactttgaaatggcagtagcaaaagttatgaaaaaggaaacagagaagaatatgtcattaaggaagctctggaagtgagctttttgccgctgcttgcagaacaccaaaacgttgccttttgttgttttatcccgaattgtagacgaaactatggggaagattgttgcagaaatctggttttctttataaatggaaaatgaatatgttttaatgaaattgtatttcttggtttctgtacactcgagattcattttg

SEQ ID NO: 4308 - DNA, 1561 bp, Marchantia polymorpha
cgaataccaagccgaggaggctccttaccggagggcggggggagcaggagtgggcgggggcgacggtctgagaaactattatttggggcatacccatgaccttctgttgcaattgcgagtgaagactcataatcttcaccgtctcgaagctcagcgcaatgatctgaactcgaaagtgagaatgctcagagaggagttgcagttgttgcaagagcctggttcctacgtgggtgaagttgttaaagttgtgggcaagactaaagttcttgtgaaggttcaccctgaaggcaaatatgtcgttgatattgacaagaatattgatatcaacaaaatcactccttctactcgtgttgctcttcgtaatgacagctatgtgctacatcttatcttgcccagcaaggtagatcctctcgtcaatctgatgaaggtcgaaaaagttccagactctacttatgacatgattggtggacttgatcagcaaatcaaggaaatcaaggaggttattgagctgcccatcaaacatccggagctgtttgagagtcttggaattgcccaacctaagggtgttcttctatacggaccacccggaacgggaaagacactccttgccagagcggtggcacatcacacagactgtacatttatcagggtttcaggttccgagcttgtgcaaaagtacattggagagggttctcgtatggttcgtgaattgtttgtgatggctagagaacatgctccttctatcatcttcatggacgaaattgatagtattggatcagcacgaatggaatctggtaatggcaatggggacagtgaggttcagcgaactatgctggagctgcttaatcagcttgatggattcgaagcatcgaacaaaattaaggtattgatggccacaaatcgaattgatatcctcgatcaagctttactccgacctggacgtattgatcggaaaattgagttcccaaatccgagtgaggagtctcgattggacattcttaagattcattcgaggaggatgaatcttatgcgaggtatagacttgaagaaaattgcagagaagatgggcggcgcgtcaggagccgaattgaagtccgtgtgtacagaagcaggaatgtttgcactgcgggaacgtcgtgtacatgtgacgcaggaagactttgaaatggccgtagctaaggttatgaaaaaggagactgagaagaatatgtctttgaagaagctgtggaagtaggacggtttccttgaaatgttcacttattgtagagacaaaatgttgaactcctgtaatgataataaccattctcttctgagatatgtcatactggagattcagatcgggcaggactgccaatgatgacctgtcattagtttctgtcggtattgttttgggctcatcttgtacaaagatctgagatgaagtgaagctagttataaacttttgtcgatctctcgatccactacgtgcaccaatgacagaaaatggagaagatttccgggtgagtacctgacccgcagaagcacgaatggatatttcatgatgttcaaccgaaaaaaaaaa

SEQ ID NO: 4309 - DNA, 1956 bp, Taxus baccata
ttgtgaactttgcaaagtttccggtgcctacctaccttcctattttgcgagggtttgttaaattgaaattggtagagcagctgagacaggaaatctcaaccagaacaacacttctcccggaaaaagctatcaaacagtaaaataatggtgaaacaaggcgagggtttgcgtcaatattacctgcaacacattcacgacctgcagcttcaggtccgtcaaaagacgcacaacctgaaccgcctcgaagcccagcgcaatgatcttaattccaaagtgcggatgctgagagaggagttacagttgctgcaggagccgggatcatatgtaggtgaagttgtcaaagttatggggaagtctaaagtattggtaaaggtgcatcccgaaggaaaatatgttgttgatatagataagaacatcgacataacaaaaatcacaccctctacacgagtagctcttcgtaatgatagttacactcttcacttgattttgcctagcaaagtagatcctttggtgaacctgatgaaggtggagaaagtgccagattctacttatgatatgattgggggtcttgaccaacagattaaggaaatcaaagaggttattgaacttccaattaagcatccagaactatttgaaagtcttggaattgcacaaccaaagggtgtattgctgtatggaccccctggtacgggaaagacgttgctggcgagggcagtagctcatcatacagactgtacttttatcagagtttctggttctgaattggttcagaaatacataggagaaggttcaagaatggttcgtgagctttttgtcatggcaagagaacatgctccttccataatctttatggatgagattgacagtatagggtctactcgaatggagtctgggtctggcaatggtgacagtgaagtgcaaaggactatgcttgagctgcttaatcaacttgacgggtttgaagcatctaacaaaattaaggttctgatggctaccaatcggatagatattcttgatcaagctcttcttcgacctggtcggattgacaggaaaattgagtttcccaatccaaatgaagagtcacgttgggacatcttgaaaatccactcaagaaaaatgaacctgatgcgcggcattgatctgaagaaaattgctgaaaaaatgaatggtgcttcaggtgctgagctcaaggctgtatgcacagaggcaggaatgtttgcgctacgagaaagacgagtccatgtgacccaggaggattttgaaatggctgtagccaaagttatgaaaaaggaaacagacaaaaatatgtctttgaggaaattatggaaataaggaggggaaggatcagaggatgtactcgtttatagctactgcaatagttcaaagctgcaccttttcgtttcatatttgaagctactattttattttatggtggcttgttgagcatgcacaagcaattatattacacccaggcaacacggaagtaagtgggtagtttaatactaacttaaaattggtgcttttggatggggtttccgtgtcgcaagggaatttatttgttgagctgtttaaggggtttccatgcaaaaagcagcatgcctcaaagaaaatggcatatattgtcaacttgaatgtgttccatcttcctgttgggttggtagatgtgaataaatttctctagtaaaatgaagctagccagtggcaatgactacatagaaaatattggaaagtacctagagagcatcaagatctttagaattacccatatagacttacttttcatcattaccctttgtcaatgcttgaacatattgaggcatgcatgttcgctagtgccaaaagttatcacaccggggggagcagtgtctaactagtacatttggtcaaagttaaaagttcacaaaaagatccaagggatgtgcaaaaaattatgtgttaatacttcatcctcgtcta

SEQ ID NO: 4310 - DNA, 1385 bp, Ambrosia trifida
ggtgtcagcggaggatatacaacgaaaagacgttaaacaaataggattcaaaacctaggagatggtctgaacaatattaccagcaacacatccacgatgctcaactccaggttcgccacaagaccaataatctcaaccgtcttcaggctcagcgtaacgacctcaattccaaagtgaggatgcttaaggaagagttgcagctgcttcaagaacctggatcgtatgttggtgaagttgtcaaagtaatgggaaaatcaaaagttctagtgaaggtgcacccagagggtaaatatgtggttgatatcgataaaagcattgatattactaaaatcacaccatcaaccagggttgctcttaagaatgatagctatgttctccatttagttttgccaagcaaagttgaccctcttgtgaaccttatgaaagttgaaaaggttcccgactctacatatgatatgatcggtgggcttgaccagcaaattaaagagatcaaggaggttattgaacttccaatcaaacatccagagttatttgagagtctgggtattgctcaaccgaagggagttcttttatatgggccaccaggtacagggaagacattgttagccagagcggtggctcatcatactgactgtactttcattagggtttctggctctgaattagtacagaagtacatcggagaaggttccaggatggttagagagctttttgttatggccagggaacatgcaccatcgattatattcatggatgaaattgacagtattggatctgctagaatggagtctggaagtggaaatggtgacagtgaagtccaaagaacaatgctggagcttcttaatcaactggatggatttgaagcatcaaacaagatcaaggttttgatggctacaaatcgaattgatatcttggatcaggcccttcttaggccaggaagaattgataggaaaattgaatttccaaatcccaatgaagattcaaggtttgatatcttaaaaattcattcaagaaaaatgaaacttaatgcgtggcattgatctgaagaaaattgctgagaaaatgaatggtgcttcaggtgccgaactgaaggcggtctgcacagaggcagggatgtttgcactgagagaaaggagagtccatgtgacacaagaagatttgagatggcagttgccaaagtcatgaaaaaggacaccgagaaaaacatgtcactccgcaagctctggaaataaatgttatggttttaaacttctataacagtaaacacggaattctgtatgtttttttataaattctatgacagcggaattctgtatggaattatgtcgaaaattatgaagatttgagaaccaatgcatcagtatttggagttccctcaccaaaaa

SEQ ID NO: 4311 - DNA, 1640 bp, Cedrus atlantica
gacaagacctcggacttggaggccgctgcaaacacgaaggaaaaactgaaggagaagcatcagctccccaaagagtctaacaaaatggtgaagcaaggcgagggtttacgccaatattaccttcaacacattcacgatctccagcttcaggtccgtcagaagacgcacaatcttaaccgcctcgaagcccaacgaaacgatctcaactccaaagtgagagcgctgagggaggaattacagttgctccaggagccaggatcttatgttggcgaggttgttaaagttatggggaagtctaaggttttggttaaggtgcatcctgaaggaaagtatgtagttgatgttgacaagaacattgacataacaaaaataacaccctctacaagagtggctcttcgtaatgatagctatgtgcttcatttgattttgcctagcaaagtagatcctttggtcaacctgatgaaggtggagaaagtcccggattctacgtatgacatgattggaggtcttgaccaacagattaaggaaatcaaagaggttatcgagcttcctatcaagcatccagaactgtttgaaagtcttggaatagctcaaccaaagggtgtactgttgtatggacctcctggcactggaaagacattgctggccagggcagttgctcatcacacagactgcactttcatcagagtttcgggctccgaattggttcagaagtacataggagaaggatcaagaatggttcgtgagctcttcgttatggcaagagaacatgctccttctattatttttatggatgaaattgacagtataggatctgctcgaatggagtctggcacggggaatggtgacagtgaagtacagcgaactatgcttgagctccttaatcagcttgatgggtttgaggcatctaataagattaaggttttaatggccacaaaccggatagatattcttgaccaagctcttcttcgacctggtcggatcgacaggaaaattgaatttcccaatcctaatgaagagtctcgttttgatattctgaaaatccattcaagaaaaatgaatctaatgcgtggcattgatctaaagaaaattgctgaaaagatgagtggtgcatctggtgcagagcttaaggctgtatgcacagaagcagggatgtttgcattgcgggagcgacgtgtccatgttacgcaagaggattttgaaatggctgttgccaaggttatgaaaaaggaaacagagaagaacatgtcactgaggaaactatggaagtaagcaaagcaagggaaatattattggaacagttggtttcatatgtcaagctactgcgtggatttcatagtgggtaatcagacatgtccaagcgtttatattacttgtcatggcaacccggaaataagtggatagtttgcaagtggaatttgtttctagttcatttagggcttgaaactgtcttgatttatatcttctctgcaggaagcttggaatttgaattaaaaaattagttaatttccaaacacgaaaacattttcctatcttattttagcgcgaaaaagaaatatgatccaactaattgttgaatatcatgtcagatatgataaagttcttcaaatgagggttttgatctctcttttaaagatgca

SEQ ID NO: 4312 - DNA, 1579 bp, Fraxinus spp
gagcaaaagagtaattactaactattgaacataatcccataatttgatctactagaaacccactgattctctgattgaatggcgatagaaactcggcaggtggaggacgcgaagaaccaccaacaaggcggtaccggcgtcggcggggaaggtcttcggcagtactatcagcaacgcatacaggatcttcagctccaagtccgccagaaaactcacgatctacagcgcctcgaagcccagcgcaatgacctcaatggccgagtgaggtcattgaaggaagagcttcagcttcttcaggagcctggatcatatgttggtgaagttgtcaaagttatggggaaatcaaaggtccttgtcaaggtccatcctgaagggaagtacgtggttgatgttgacaagaatatcgatataactaagattacaccctcaactaggttgctttacgtaatgatagctatgtgttgcacttgatgttgcctagtaaagttgatcccttagtgaaccttatgaaagttgaaaaaagttccagactctacctatgatatgattggtggtctggatcagcaaattaagagataagaggtcattgaacttccaattaaacatcctgaattgtttgagagtcttggaatagctcagccgaagggagttttgctctatgggcctcctggtacaggtaaaacactgcttgcgagagcagtggctcatcatactgactgcacttttatccgggtttcgggttctgaactggttcagaagtacattggagaaggctctaggatggttagagaacttttcgtgatggccagggagcatgctccatcaatcattttcatggatgaaattgatagcataggatctgctcgcatggagtccggaagtggcaatggtgatagtgaggttcagcgaactatgctggagcttctcaatcaacttgatggatttgaagcatccaataagatcaaagtattgatggcaaccaatagaattgacattctggatcatgcgcttcttaggcctggaaggatcgacaggaagattgaattcccaaatcctaatggagagtctcgccaagacatcttaaagatacactccaggaaaatgaatttgatgcgagggattgatctgaagaagattgctgagaaaatgaatggtgcctctggtgcagaacttaaggctgtttgcactgaagcagggatgtttgctttgagagagaggagggttcatgtcactcaggaggactttgagatggcagtcgcgaaggtgatgaagaaggaaacagataaaaacatgtcgttgaggaagctttggaagtagattatttattcctatcggccacttaattgggtcttgtatttgagctgagagacgggaattgcacgataaaacacatcggaatatttgtgctggacctcatgagtcccattttgatgcttcaatttggttgtattattagattgttgtgaccatgtttgtcccttattatgtaggggatatcgatgttgttgctagaggtgttaaaagtataaattggataattatattaacatcgcaattttccgttttgcactttgtactg

SEQ ID NO: 4313 - DNA, 1437 bp, Zostera marina
atccgagaggcctcgccaagatggcagccatggaattggagacgaacgttgtggatattcattctccgacgaaggtgagaggggaagagggactaagaaagtactacatgcaacacattcacgatctccagcttcagtctcgtcagaaatccgacaatttcaatcgcctaaaggcccaaaggaacgatcttaacactaaagtgagaatgcttcgagaggagttgcaattgctgcatgagcccgggtcttatgttggtgaagtgattaaggtgatgggaaaatccaaagttctggtcaaggttcatcctgaaggaaaatatattgtcgatgttgataaaaacatcgatataacaaagataactccatccgctagagtagctttacggaatgacagttatgttcttcacttaattttacccagcaaagtggaccctttagtcaatctaatgaaagttgaaaaagttccggattctacttatgatatgattggtggtcttgatcagcaaattaaagaaattaaagaggttatcgaacttcctatcaagcatcctgaattatttgagagtcttggaattgctcaaccgaagggtgttttgctttatggaccacctggtactggaaaaaccctccttgcaagggccgtggctcatcatactgattgtacatttattcgagtttctggttctgaattggtccagaaatacataggagagggatcgagaatggttcgagaactctttgttatggcaagagagcatgcaccatccattattttcatggatgagattgatagtattgggtctgcacgaatggagtctgggtctggcaatggagacagtgaagtgcagcgaactatgttagaacttctcaaccagcttgatggatttgaggcctcaaataagattaaggttttgatggcaacaaataggattgatattctcgatcaagcccttctaagacctggtagaatagaccgaaaaatcgagttccccaatccaaacgaggagtctcgttgggatatattgaaaatccattcaagaaaaatgaatttaatgcgtggaattgatttgaaaaagattgctgcaaagttgaacggtgcttcaggagcagaattgaaggcggtctgcaccgaagcaggtatgtacgcattgagagaaagaagagtccatgttacccaggaggattttgagatgtcagttgcaaaggttatgaagaaggacgcagagaaaaacatgtctttgaggaaattgtggaagtagtagtagcagtagtagtaaaagcaagtgaaaaccaatcattatgaaaatccgaaacaatgtcccactattttatctattcctccatttattgaatttttcgcaattaaatgtattatttgcattgacttgatattagagaaatacaattgtgatatatgtgaaattgccaatcaattcg

SEQ ID NO: 4314 - DNA, 1485 bp, Beta vulgaris
cacaaacaagaaaaaaggaagagaaaaaatggcgacagctctcaccgaaagaaatactcctgcaacaatgggaggaagcaccactcatggcgatggtttaagacaatattatcttaaacgaatcaatggacttgaacatcttcatcgtcaaaaaactcttgatcttagtcgtctcgaagctcatcgtaatgaactcaattctcaagtgaggatgctcaaagaggaattaatgctgcttcaagagcctggatcatatgttggtgaagttgtcaaagtcatggggaagtccaaggtcttggttaaggtccatccagaaggaaaatatgtagttgatgttgataagagcattgacataacaaaactcacaccttccaccagagtcgctcttcgcaatgacagttatgtcctccatctggtcttacctagtaaagttgatcctttggttaaccttatgaaagttgagaaagttcctgactctacttatgatatgattggaggcttggaccaacaaatcaaagagataaaggaggttattgagcttccaatcaagcaccctgaattgtttgagagtcttggtattgctcaaccaaagggtgttttgttatatggtccacccggtacgggcaagacgctgcttgctagggcagtggcacatcacactgactgtacatttataagggtatctgggtcggagttagtacagaaatatattggagagggttctcgaatggttagagaacttttcgtcatggcaagagaacatgctccatctattatttttatggatgagattgacagtattggatcggcaaggatggaatctggatccggaaatggtgatagtgaagttcaaagaactatgctggagcttctcaatcaattagatggatttgaagcatcaaaaaagatcaaagttttgatggccacaaatcgtattgatattttggatccagctctccttagacctggaaggatcgatagaaaaattgagttccccaatcccaatgaagattctcgctgtgacatcttgaagatccactcaagaaaaatgaatttgatgcgagggattgatttgaagaagattgcagaaaaaatgaatggtgcttctggtgcagagcttaaggctgtatgcactgaagcaggcatgtttgctttgagggagaggaggattcacgtcacacaggaagatttcgaaatggcagtggcaaaggtcatgaagaaggacactgagaaaaatatgtccttgagaaaattgtggaagtaaaaatatatcatcatgtcttgtgtattttttcatgagataactgaaaagaaaagatcatatgatctcatgcttagttcctagctaattgactatagctagaagagattaatgtataccttgctgtttttatatctttggtagatagtttggagacttgcctttttaaagttacattcgagcaagaggataggatgaattattggatcaaaaaaaaaaaaaaa

SEQ ID NO: 4315 - DNA, 1554 bp, Ceratodon purpureus
gtagaccagtgctgtgagttgggcaaaccctagagcggagctgcattcgatcgtcgggcgttgttcgggacccatttccatcgctgccacggggtttgttgctgcctgcgcttgatcgggggcgtatttgtgtggattctgcaggagagtaggcgtcatggggcgagcggaggaggcgcccaacagggcggtgcgctcgggggaggggctgcgccactactacctctcgcatattcacgacttgctgctgcaattgcgcgtcaagacgcataacttgcaccgcctggaggctcagcggaacgatctcaattccaaagtgcggatgttgagggaggagcttcagctgttgcaagagccggggtcgtatgtgggagaagttgtgaaggttatggggaagaccaaagttcttgtaaaggtgcatccggaagggaagtatgttgtcgatcttgacaagagcatcgatatcaataagatcactccgtcgacgagagtcgcgcttcgaaatgacagctatgttttgcacctaattcttcccagtaaggtggatccgttggtcaatctgatgaaagttgagaaggttccggactctacgtacgacatgatcggaggacttgatcagcaaattaaggaaattaaagaggtcattgaacttcccattaaacatccggagctttttgagagtctgggtattgctcagccaaagggtgttctgttgtatggaccgcctggaaccggaaagactctacttgcccgggctgtggcacatcatacagactgtacattcatccgagtttcaggctctgagcttgtgcagaagtacattggagaaggttcacgcatggtgcgtgaactgtttgtcatggctagagaacacgcaccatccatcatcttcatggatgaaatcgacagcattgggtcagcccgtgtggagtctgggaatggtaatggagatagcgaagtgcagcggaccatgttggagctgttgaatcagcttgatgggtttgaagcctctaataagattaaggtgttgatggcaaccaaccgaattgatatcctagatcaagctcttctacgtcctggacgaattgaccggaaaattgagtttcctaacccaacagaagagtctcgtttggacattcttaaaattcattcgaggaagatgaacttgatgcgagggattgatctaaagaaaattgccgaaaagatgggaggtgcatctggggctgagctcaaggctgtatgcacagaagctggcatgtttgctttacgtgaaagacgtgtacatgtaacacaagaggactttgagatggctgtggctaaggtcatgaagaaggaaacagacaagaacatgtctctgaagaagctgtggaagtgattcaaatattggattacacgatcttgagagctggctatgtacatacttatgtggccagtcgactgtaatagttctcaactgctctgcttcgctttacttgggcaggtagtcagttatttctctgtcaagtttcaagtacagtcttgacaggttcaccagaacacctcgagttttggttg

SEQ ID NO: 4316 - DNA, 1508 bp, Podocarpus macrophillus
caaacctattaggccagggttcgaatcccgctatgcaagtcgaacagatacaacctcaactcctgaagcgagaaattcaacccaaagagaaatacctctcaagagaatccaacaaaatggtgaagcagggagagggtttgcgccaatattatctccaacacattcacgatctgcagattcaagttcgccagaaaacgcacaatctcaatcggctcgaagctcagcgcaatgatcttaactctaaagtgaggatgctgagggaggagttacagttgctgcaagaaccgggatcatatgttggagaagttgtgaaagtaatgggaaagtctaaagtattggtgaaggtgcatccagaaggcaaatatgtcgttgatatagacaagaacattgatataacaaaaattacaccttctacaagagtagccctccgcaatgacagttatgtgcttcacttgattttgcctagcaaagtggatcctttagtgaatctgatgaaagtagagaaagtgccagattctacatatgatatgattggaggtcttgatcaacagatcaaggaaatcaaagaggttattgaactcccaatcaagcatccagaactatttgaaagccttggaatagcacaaccaaaaggtgtactgctgtatgggccacctggtactggaaagacattgctggcaagggctgttgcgcatcatacggactgtacttttatcagggtttctggttctgaattggtccagaagtacataggagaaggatcaaggatggttcgtgagctttttgtcatggcaagagaacatgccccatccataatttttatggatgagattgatagtatagggtctgcacgaatggagtctgggactggaaatggtgacagtgaagtgcagagaactatgcttgagctacttaatcagcttgatggatttgaagcatccaacaagattaaggtcctgatggctactaacaggatagatattcttgatcaagctcttcttcgacctggtcgaattgacaggaaaattgagtttcctaatcctaatgaagagtctcgctgggacatcttgaaaattcactcgagaaagatgaatctgatgcgtggcattgatctaaagaaaatcgctgaaaaaatgaatggagcatcaggcgccgaacttaaggctgtatgtacagaagcaggtatgtttgcattacgagaaagacgagttcatgtgacacaagaggattttgaaatggccgtggccaaagttatgaagaaggagacagagaagaatatgtctctgagaaagttatggaagtaacaaaggcaaggaccaggcaatagcatacatcctcttagatttgctggagtagttcaaagttgtaacatctaaatatatatttcaaactactgttgaatttaatgatatgtcatttgatgtggctggttcaacaatatttttcatgaccaattattctttcataatatttacacagtgctgatatgaattacatttttaaatgag

SEQ ID NO: 4317 - DNA, 1492 bp, Artemisia annua
cacaaaacacaaactcaaaacaacctcatcaacaatggcgacagtagacacactaccaatgaaaccatccgacacaaacatcaacaaagaaccaatgttctgttcatcaacagcacctttagaaccaggtgtagatttgaaacagtactacactcgacatatttatcatcttcagaatctgcgtcgtaagaaggccaatgaccttactcgactcgaggcgcagcgtaacgagcttaacgctaaagtgaggacgcttaaggaagagatacacctgcttcaagagcctggatcttatgttggcgaagttgttaaagtcatgggaaaatcaaaagttctagtgaaggttcacccggagggtaaatacgtggttgatattgacaacagcattgacatcactcagcttacaccaacaaccagggttgcgcttcgaaatgacagttacgtcctacatttgattttgccaagcaaagtagatcctctggtgaaccttatgaaagttgagaaggttcctgattctacttatgacatgattggtgggcttgaccagcaaattaaagagatcaaagaggttattgaacttccgatcaaacatccagagttatttgagagtttgggtattgctcaaccaaagggagttctgttatatgggccacctggtactgggaagacattgttggccagagctgtggcacatcatactgattgtactttcattagggtctctggttctgaactagtacaaaagtatatcggagaagggtccagaatggttagagaactttttgttatggccagggaacatgccccgtcaatcatatttatggatgaaatcgacagtattggatctgctagaatggagtctggaagtggaaatggtgacagtgaagtccaacgaaccatgctggagcttcttaatcaactggatggatttgaggcatcaaacaaaatcaaggttttgatggctacaaatcgtattgatattctggaccaagctcttctcaggccaggaagaattgataggaaaattgaattcccaaatcccaacgaagactcgagggctgatatcttgagaatccattcacgaaaaatgaacttaatgcgtggcattgatctgaaaaagattgctgagaagatgaacggtgcttcaggtgcagaacttaaggcggtttgcactgaggcaggaatgtttgcattgagagaaagaagagttcatgtgacacaagaagatttcgagatggcagtggctaaggtaatgaaaaaggaaactgagaaaaacatgtcacttcgcaagctctggaaataggtgttacccattcttctatcttcacgtggtgatctgagatctgaaaaccacggatcacattttaggattttctagccctttatgctttttgtaagatcttgtattcttgcaattttatttccaattgcataatgtacattctggaatttgtgttcatttcattatggaattaagcttaaaacttggttc

SEQ ID NO: 4318 - DNA, 1360 bp, Ambrosia trifida
aataataatggtgtcagcggagatatcgacgaaaagcgttaaaacaaatggattcaaaacctggagatggtctgaaacaatattaccagcaacacatccacgatgctcaactccaggttcgccacaagaccaataatctcaaccgtcttcaggctcagcgtaacgacctcaattccaaagtgaggatgcttaaggaagagttgcagctgcttcaagaacctggatcgtatgttggtgaagttgtcaaagtaatgggaaaatcaaaagttctagtcaaggtgcacccagagggtaaatatgtggttgatatcgataaaagcattgatattactaaaatcacaccatcaaccagggttgctcttaagaatgatagctatgttctccatttagttttgccaagcaaagttgaccctcttgtgaaccttatgaaagttgaaaaggttcctgattctacatatgatatgattggtgggcttgaccagcaaattaaagagattaaggaggttattgaacttccaatcaaacatccggagttatttgagagtctgggtattgctcaaccgaagggagttcttttatatgggccaccaggtacagggaagacgctgttagccagagcggtggctcatcacactgactgtactttcattagggtttctggttctgaattagtacagaaatacattggagaaggttccagaatggttagagagctttttgttatggccagggagcatgcaccatcgattatatttatggatgaaattgacagtattggatctgctagaatggagtctggaagtggaaatggtgatagtgaagtccaaagaacaatgctggagcttcttaatcaactggatggatttgaagcatcaaacaagatcaaggttctgatggctaccaatcgaattgatatcttggatcaggcccttcttaggccaggaagaattgatagaaaaattgaattcccaaatcccaatgaagactcgaggtttgatatcttaaaaattcattcaagaaaaatgaacttaatgcgtggcattgatctgaagaaaattgccgagaaaatgaatggtgcttcaggtgccgagctgaaggcggtctgcacagaggcagggatgtttgcactgagagaaaggagagtccatgtgacacaagaagattttgagatggcagttgccaaagccatgaaaaaggacaccgagaaaaacatgtcactccgcaagctctggaaataaatgttatggtttttaaacttctataacagtaaacacggaattctgtatgtttttttataaattctatgacagcggaattctgtatggaattatgttgaaaactatgaagatttgagaaccaa

SEQ ID NO: 4319 - DNA, 1339 bp, Ambrosia trifida
attcaaaacctggagatggtctgaaacaatattaccagcaacatatccacgatgctcaactccaggttcgccacaagaccaataatctcaaccgtcttcaggctcagcgtaacgacctcaattccaaagtgaggatgcttaaggaagagttgcagctgcttcaagaacctggatcgtatgttggtgaagttgtcaaagtaatgggaaaatcaaaagttctagtgaaggtgcacccagagggtaaatatgtggttgatattgataaaagcattgatattactaaaatcacaccatcaaccagagttgctcttaagaatgatagctatgttctccatttagttttgccaagcaaagttgaccctcttgtgaaccttatgaaagttgaaaaggttcccgattctacatatgatatgatcggtgggcttgaccagcaaatcaaagagattaaggaggttattgaacttccaatcaaacatccagagttatttgagagtctgggtattgctcaaccgaagggagttcttttatatgggccaccaggtacagggaagacattgttagccagagcggtggctcatcacactgactgtactttcattagggtttctggctctgaattagtacagaagtacatcggagaaggttccaggatggttagagagctttttgttatggccagggaacatgcaccatcaattatatttatggatgaaatagacagtattggatctgctagaatggagtctggaagtggaaatggtgacagtgaagtccaaagaacaatgctggagcttcttaatcaactggatggatttgaagcatcaaacaagatcaaggttttgatggctacaaaccgaattgatatcctggatcaggcccttcttaggccaggaagaattgataggaaaattgaatttccaaatcccaatgaagactcgaggtttgatatcttgaaaattcattcaagaaaaatgaacttaatgcgtggcattgatctagaaaaaattgctgagaaaatgaatggcgcttcaggtgccgaactgaaggcggtctgcacagaggcagggatgtttgcgctgagagaaaggagagtccatgtgacgcaagaagattttgagatggcggttgccaaagtcatgaaaaaggacaccgagaaaaacatgtcactccgcaagctctggaaataaatgttacggtttttaaagttctataacggtgaacacggaattctgtatgttttttttataaattaattctatgacagcggaattctgtatggattatgtcgaaaactatggagatttgagaaccaatgcatacagtatttcgggttccctac

SEQ ID NO: 4320 - DNA, 1572 bp, Nuphar advena
cgaaagcgtgcagaggaagcaagaagccctaaattcaccctctgtgagcgatcgttacttctcctccggacgtcggtttccgatcccattcatctctttcttaccgaggctagttatttgcaaaacaaagagttgtttgtcctggacattgggtcgccaatggcggtagcagaggtagggcgtatgactgaccttcagaagagcaaacaatttgattcagatgctgaagtagatcgtgtatcctcagaagagtcaacaagaatggttaaacatggtgaaggcctcaggcaatattatctccaacacattcatgatcttcaacttcaagtccgtcagaaaagccacaacctcaatcgactggaagctcagagaaatgaacttaactcccgagtgaggatgctcagggaggagttgcaacttctccaggaacctggatcctatgttggtgaagttgtgaaggtcatggggaagtcaaaggttttggttaaggttcatccagaaggaaaatatgttgtcgatattgataagaacattgatatcacaaaaatcacgccttccaccagagttgcacttcgtaatgatagttatgttctccatttgattttgccaagcaaagtggatccattggttaatcttatgaaggtcgaaaaggttcctgattctacttatgatatgattggtgggcttgatcagcaaatcaaggaaattaaagaggttattgagcttccaatcaagcatcctgaattatttgagagtcttggaatagctcagcctaaaggtgtattactttatgggccgcctggaactggaaagactcttcttgcaagagcagttgcacaccatactgattgcacatttattagggtttcgggttcagagctggtccagaaatacattggagagggatctagaatggttcgagaactttttgttatggccagggagcatgctccttccatcatttttatggatgagattgacagcattggatctgcaagaatggaatctggtactggtaatggggatagtgaagttcaacgcaccatgcttgagcttctcaatcaacttgatggcttcgaagcatcaaataaaataaaggttttaatggctacaaatcggattgacatccttgatcaagcccttctacggcctggacgtattgacaggaagattgagtttccaaatcccaatgaagagtctcgttttgatatcttgaaaattcattcgagaaagatgaaccttatgcgtgggattgatctgaagaagatcgcagagaagatgaatggtgcatcaggtgctgagctcaaggctgtgtgcacagaggctggaatgtttgcgcttagggagcggagagttcatgtcacacaggaggattttgagatggcagtggccaaggttatgaagaaggaaacagagaagaacatgtcactgaggaagttgtggaagtaaactgttgtcaagtttcaacagcgatgatgatcaaactaaaaatgttctgtttttgctttgtgtactagctattgcttactgaaacttgattttagcaattgtaactgcatgtgtttttaactc

SEQ ID NO: 4321 - DNA, 1616 bp, Fagus grandifolia
ccgagctattattaaaagaagtgaaacaaagagagcaacttttttcaattcagatcgcaaatcgaaaccctaactcattccgatggcgatcgaaacgaaacatccggaggcggtgccggcggacgagacttgctcggcgaagtgctccaagcaaggggagggtctcaagcagtactatctccaacacattcacgagcaccagctccaggttcgccaaaagacccacaatctcaaccgcctcgaggcccagcgtaacgagttcaattctcgagtgagaatgctaagggaagaactacagctactccaggagcctggatcatatgttggtgaagttgtcaaagtaatggggaagaataaggttttagttaaggttcattctgaaggaaaatatgttgttgacatcgataaaaatattgacatcacaaagataactccatcaacaagagttgctcttcgcaatgacagttatgtgcttcatttaatcttgccaagcaaagttgatcctttggtcaacctaatgaaagttgaaaaggttcctgattcaacatatgacatgattgggggtcttgaccagcaaattaaagagataaaggaggtcattgagcttccaatcaaacatcctgaattatttctagagagtcttggaatagctcaaccaaagggtgtactgctatatgggccacctggtacagggaaaacgctgttggctagggcagtggcacatcatacagattgtactttcatcagggtttctggttctgaattagttcagaagtacattggagaaggttccagaatggttagggaacttttcgttatggccagggaacatgctccatctatcatatttatggatgaaatagacagtattggatctgctcgaatggaatctggtagtggcaatggtgatagtgaagtgcagcggactatgctggagcttctcaaccagctggatggatttgaagcatcaaacaaattaaggttcttatgcctacaaatcgtattgatattctcgatcaagctctccttaggccagggcgaattgataggaagattgaatttcctaatcctaaccgggagtctcgatttgatattttaaaaatacattcaagaagaatgaatctgatgcgtgggattgacctgaagaaaatagctgagaaaatgaacggtgcatctggtgcagagctcaaggctgtgtgcacagaagctgggatgtttgctctgactgctgagaggagggttcgactggtaacacaagaagattttgagatggcagtagcaaaggtaatgaagaaggagaccgagaaaaacatgtcattgcggaagctatggaagtagtgttcttatagattactgtttgtttcactccaccatcccttagaccatttgatctgtggagtcgtcattcacacacaaaaccaagagttgtgttcttctatgtatgggtataaaaaaactagagtacggtgcctacactctgttgttgaagattttaaagtaccactggcatctttgtttattttattagttatatattcttttgtgatacatctttagattatgtaatatcggtcgtgctttccttaagaatctgacaacaatgtcccttgacaatg

SEQ ID NO: 4322 - DNA, 1719 bp, Beta vulgaris
ccatcacctacggatcataggctactagtattatggtcaccgacccatttcaccggctgaaacactgaaactcaccatcggaaaaacactccaaacacaccacacacaaaagaggagagagaaagaaatggcgacagcagaagtagaaaagaagacggtaaaacaaggagaaggactgcgacagtactaccttcagcatatccatgaacttcagcttcgtatccgtgacaaatctcacaatcttcaacgtcttgaagctcagcgcaacgagctcaattctcgagttagagcactgaaagaggagttacaattgcttcaagaaccaggctcatatgttggtgaagtcgttaaagtgatgggaaaatccaaggttcttgtcaaagtgcatcccgaaggcaaatatgttgttgatattgataaaaatattgacatcactaagctcacaccttctacgagagttgcattgcgtaatgacagctatgtcttgcatttggtattgccaagtaaagtggaccctctggtcaatctgatgaaagttgagaaagttcctgattctacgtatgacatgattggtggtcttgaccaacaaattaaagaaattaaggaggtgattgagctaccaataaagcatccagaactatttgagagtctgggaattgctcaaccgaagggtgttctcctttatggtcctcctggaactggtaaaaccctattggcaagagctgttgctcatcatacagattgtactttcatcagggtatcaggttctgagttagttcagaagtacattggtgaaggatctcggatggttagagaactttttgttatggccagagagcatgctccgtcaattatctttatggatgagattgacagtatagggtctactagaatggagtctggttctggaaatggtgatagtgaagttcagagaacaatgttagagcttctcaaccaacttgacggctttgaagcatcaaacaagatcaaggtgctgatggccacaaatcgcattgatatcttagatccagctcttctcaggccaggaagaattgataggaagattgagttcccaaatcccaatgaagagtcacgttttgacattttgaaaatccattcaagaagaatgaatttgatgcggggaattgatcttaagaagattggagagaagatgaatggtgcatctggtgcagagcttaaggcggtttgtacggaagctggcatgttcgctctgcgggagagaagaattcatgtaacacaggaagactttgagatggcagtggctaaggttatgaagaaggatacagacaaaaacatgtctctgcgcaaactgtggaagtagaaccagaaatctccttgtaatttgtgtgtagtcacatatctcattcccatccaatgtagaatgtcacacgcatctgtaatatagtaatgggtttaaaataagggaatggaaatggaaatgtgggtggatgagttatgagtatggattttggtaatggatatttgcttgtttggcatgtgttaataaggaagagaaatggtaaagatcggaaattaccatcgcgtgtatctggtttgcagtgtttagcatttattctctcttttccagtacatttcagcgatgtattctcatttcttttcagggctggactgtgtatacacgactgcagtgtccttttaactatctaaacagaaagaaagtcttgtgttatgttgtaa

SEQ ID NO: 4323 - DNA, 1422 bp, Amborella trichopoda
  misc_feature (55)..(55): n is a, c, g, or t
  misc_feature (118)..(118): n is a, c, g, or t
  misc_feature (139)..(139): n is a, c, g, or t
  misc_feature (141)..(141): n is a, c, g, or t
  misc_feature (145)..(146): n is a, c, g, or t
  misc_feature (187)..(187): n is a, c, g, or t
  misc_feature (193)..(193): n is a, c, g, or t
  misc_feature (199)..(199): n is a, c, g, or t
  misc_feature (214)..(214): n is a, c, g, or t
  misc_feature (220)..(220): n is a, c, g, or t
  misc_feature (229)..(229): n is a, c, g, or t
  misc_feature (233)..(233): n is a, c, g, or t
  misc_feature (247)..(247): n is a, c, g, or t
  misc_feature (280)..(280): n is a, c, g, or t
  misc_feature (286)..(286): n is a, c, g, or t
  misc_feature (295)..(295): n is a, c, g, or t
  misc_feature (301)..(301): n is a, c, g, or t
  misc_feature (319)..(319): n is a, c, g, or t
  misc_feature (350)..(350): n is a, c, g, or t
  misc_feature (352)..(352): n is a, c, g, or t
  misc_feature (361)..(361): n is a, c, g, or t
  misc_feature (377)..(377): n is a, c, g, or t
  misc_feature (382)..(382): n is a, c, g, or t
  misc_feature (418)..(418): n is a, c, g, or t
  misc_feature (433)..(433): n is a, c, g, or t
  misc_feature (460)..(460): n is a, c, g, or t
  misc_feature (469)..(469): n is a, c, g, or t
  misc_feature (484)..(484): n is a, c, g, or t
  misc_feature (520)..(520): n is a, c, g, or t
  misc_feature (526)..(526): n is a, c, g, or t
  misc_feature (652)..(652): n is a, c, g, or t
  misc_feature (658)..(658): n is a, c, g, or t
  misc_feature (662)..(662): n is a, c, g, or t
  misc_feature (703)..(703): n is a, c, g, or t
  misc_feature (718)..(718): n is a, c, g, or t
  misc_feature (874)..(874): n is a, c, g, or t
  misc_feature (881)..(881): n is a, c, g, or t
  misc_feature (896)..(896): n is a, c, g, or t
  misc_feature (899)..(899): n is a, c, g, or t
  misc_feature (908)..(908): n is a, c, g, or t
aaacagtgaaaaaatggtgaaacaaggagaggggcttaggcagtattacgtgcancacatccatgatctacaattgcaggtgcgccagaagacccacaatctcaatcgtcttgaagcncaacgcaatgatctcaactcnanagtnnggatgcttagagaggagttgcagctgttgcaagagccaggntcatangttggngaagtggtgaaggtnatgggnaagtccaangttntggttaaggtgcancccgaggggaaatatgttgtagatattgataanaacatngatataacnaaaatnacaccgtccaccagagtngctcttcgtaatgatagctatgttcttcatntnattttgccnagcaaagtggaccctntggtnaaccttatgaaagttgaaaaggttcctgattctacntatgacatgattggnggccttgaccaacaaatcaaagaaatnaaagaggtnattgagctgccaatnaaacatccagaactatttgagagccttggaattgcncagccnaagggagtcttactttatggacctcctggaactggaaagaccctattagcaagggctgttgctcatcatacagattgcacatttattagggtttctggttctgagctggttcagaagtacattggngaaggntctngaatggttcgagaactttttgttatggctagagaacatgcnccttcaatcattttnatggatgagatcgacagtataggatccgcccgcatggaatctgggacaggcaatggggatagtgaagtccaaagaacaatgcttgaacttttgaatcaacttgatggatttgaagcatctaacaaaataaaggttttgatggccactaatcgcatngacattnttgaccaagcccttnttnggcctgggngcattgaccggaagattgaattcccaaatcctaatgaggagtttcgtttggatattttgaaaatccactcgaggaaaatgaatcttatgcggggaattgatttaaagaagattgcagagaagatgaatggtgcttccggggctgaactcaaggccgtttgcacagaagctggaatgttcgcttttagagaacgtcgggttcacgttacccaggaggatttcgagatggcagtggccaaagttatgaagaaggaaacagagaagaacatgtcattgaggaagttgtggaagtgagaaagcttcattttttcaacgattcaactttgatagatgcttctttttgggattttccagctcttacacctcgagctttagtttaaatttctaccggtgcagtatgagtccataaattgcttccttctttggctgattttgtatggatctatacatgtaaaagttctgtgaattgctatatggttcttacctgaagttcatggttcatagccactttcaag

SEQ ID NO: 4324 - DNA, 1460 bp, Secale cereale
aaagaagctcaccctcgaacccgagcgaccagactcgagccaaccccagagcggcggagcagacgaggggaaatcccgatggcggcggtggcgatggacatcgcgaagccctcggcgctgccggcgagcgtcgacgacccttcggcggcgtcggccaagggcagggccggcggcggggagggctgcgccagtactacctgcagcacatccacgacctgcagctccagatccggaccaagacgcacaacctcaaccgcctcgaggcccagcgcaacgacctcaactctcgagttagaatgctccgggaagagttgcagcttcttcaagaaccgggctcatatgttggcgaggttgtgaaggttatgggcaagtcaaaggttctagtcaaggtccatccagaaggcaaatatgttgtagatcttgataaaagtattgatatcacaaagataaccccttaaacaagagttgctcttcgaaacgaacagctacatgcttcaccttatcctgcccacgcaaagtacgatccactcggttaagtcttattgaaggtggagaaggttacctgactctacctatgatatgattggtggtcttgatcagcaacttaaagtaagatcaaggaggtggattgagcttcctatcaagcatcctcgagctgtttgtagaggtctcggaattgcccaacccaaacgggtaggtcctccctttacttgggccgtccaggtacagggaaaacgaattacttgctcgagcagttgctcatcacaccgactgcaccttcatcagggtgtcaggttcggagttggttcagaagtatattggagagggttcccggatggttcgtgaactctttgtgatggctagggagcatgcaccatccattatatttatggatgaaatagactctattgggtctgctagaatggagtcgggatccggcaatggtgatagcgaggttcagcgtaccatgcttgagcttctgaaccaacttgatggttttgaagcatcgaacaaaattaaggttcttatggcaacgaataggatagacatattggatcaagctcttctgaggcctggtcgtatcgataggaagatcgaatttccaaatcctaatgcggattcccgtggtgatattttgaagattcactcaaggaaaatgaacttgatgcgtggcattgatctgaaaaaaattgccgagaagatgaacggagcatcaggagcagagctaaaggcggtctgcacagaagctggaatgtttgccctccgcgagagaagggtgcacgtcacccaggaggattttgagatggccgtggcaaaggtgatgaagaaggataccgagaagaacatgtcgctgcggaagctatggaagtgacggtcccccgttttagctatctcagtcttttgccggcatgtggtgggttggtttaagcttatagcggcactatttgccagatgggctg

SEQ ID NO: 4325 - DNA, 1678 bp, Abies balsamea
ttttctctcagggtttgtagctatgcgagtagaggaacttggaggaattctgagacaagcctcggacctagaggccgctgcaaacgcgaaggaaaaactgaagcaaaagcatcaaatccccaaagaatctaacagaatggtgaagcaaggtgagggtttacgccaatattaccttcaacacattcacgatctccagctccaggtccgtcagaagacgcacaatcttaatcgcctcgaagcccagcgaaatgatctcaactccaaagtgagagcactgagggaggaattacagttgcttcaggagccaggatcgtatgttggcgaagttgttaaagtcatggggaagtctaaggttttggttaaggtgcatcctgaaggaaagtatgtagttgatgtggacaagaacattgacataacaaaaatcacaccttctacaagagtagctcttcgtaatgatagctacgtgcttcacttgattttgcctagcaaagtagatcctttggtcaatctgatgaaggtggagaaagtcccggattctacgtatgacatgattggaggtcttgaccaacagattaaggaaatcaaagaggttattgagcttcctatcaagcatccagaactgtttgaaagtcttggaatagctcaaccaaagggtgtactgctgtatggaccccctggtactggaaagacattgctggccagggcagttgctcatcacacagactgcacttttatcagagtttcaggctctgaactggttcagaaatacataggagaaggatcaaggatggttcgtgagctttttgttatggcaagagaacatgctccttctattatctttatggatgaaattgacagtataggatctgctcgaatggagtctggcactggcaatggtgacagtgaagtccagcgaactatgcttgagcttcttaatcagcttgatgggtttgaggcatctaataagattaaggttctaatggctacaaaccggatagatattcttgatcaagctcttcttcgacctggtcggattgacaggaaaattgaatttcccaatcctaatgaagagtctcgttttgacattctgaaaatccattcaagaaaaatgaatctaatgcgtggcattgatctaaagaaaattgctgaaaaaatgagtggtgcgtcaggtgcagagcttaaggctgtatgcacagaagcaggaatgtttgcattgcgtgagcgacgtgtccatgttactcaggaggattttgaaatggctgttgctaaggttatgaaaaaggaaacagagaagaatatgtcactgagaaaactatggaagtaaagaaagcaagggaaggatcaatggggtggttggatttcattgtgggtaatgagacatgtccaagcattaatattacttgccatgacaacacggaaataagtggatagtttgcaagtggaatttgttttataaattcatttggggcttgaagatgtcttggtttatatcttctctgcaggaagcatggaatttgaatcaaaaaaattagttaatttccaagtacaaaaacatcttcctatcttattttagtaagaacaagaaatgtgatccaactaattgttgatatcatgccagatatgatgagggttttgaacttttttaaagatgcatatagtatttgcacttctgtaagaa

SEQ ID NO: 4326 - DNA, 1500 bp, Silene vulgaris
gaattgagctaccctctcacgcaagaaagatcgaaacttcgaagctaagctatggcgacggcggaagtagagaagaaggctgtgaaacaaggcgaaggtcttagacaatactacgttcaacgtatccatgaacgtcagcttgaagctcgtactaaaactttcaatcttcagcgtcttgaagctcagcgtaacgagcttaattccagagtgagagcactaaaggaggagttacagctgcttcaagaacctggttcttatgttggcgaagtagttaaagtgatgggaaaatcgaaggttcttgtcaaagttcatccagagggcaaatatgtcgttgatattgataagaatattgacatcactaaactcacaccatccacaagagttgcattacgaaatgacagctacgtcctccatctaattttgccgagtaaggtagaccctttggtcaaccttatgaaagtcgagaaagtccctgattctacatatgatatgattggtggtcttgaccagcaaattaaagagataaaagaggtcattgagctgccgataaaacaccctgagttgtttgagagtcttgggattgcccaaccaaagggtgttctcctttacggtcctccaggaactggcaagaccctgctggcgagggctgttgctcaccatactgattgtaccttcattagggtatctggttctgaacttgttcagaaatacattggggaaggttctcggatggtcagggaactttttgttatggccagggaacatgctccatcaattatttttatggatgagattgacagcatagggtccgctagaatggagtccggttccggcaatggtgacagtgaagttcagcgaacaatgcttgaacttcttaaccaacttgatggattcgaagcttcaaataagatcaaggtcttgatggccacaaatcgaattgacattctggatccagctcttcttaggcccggaagaattgataggaaaattgaattcccaaatcccaatgaagattcgcgtgctgacattttgaaaatccattcaagaaaaatgaacctaatgcgtggaattgatcttaaaaagattgccgagaaaatgaatggtgcctctggtgcagagttgaaggcggtgtgcacagaagctggtatgtttgctctaagagagaggagaatccatgtgacccaagaggactttgagatggcagtggccaaggtcatgaaaaaggataccgacaaaaacatgtccctgcgcaagctttggaagtaggcgcttgctgatggagtctggtgtcgagagggggaaacccttatcttgcttccttgtagtcaacaaaatgttcttcgcatgttttctcacttgttcctgaacataactttatccatccatgtgagtctgaatagttgatactgtactaggccgggatgcgttttattcatcgtttggaagtccagcctgatagttttcaaagcagtattatgtatcgaatgcttttgttttttt

SEQ ID NO: 4327 - DNA, 1684 bp, Pseudotsuga menziesii
gcccgtctctctctgttcggagggtttgtagctatgcgagtagaggaacttggagggattctgagacaagcctcggacttagaggccgctgcaaacgcgaaggaaaaactgaaggagaagcatcagttccccaaagaatctaacagaatggtgaagcaaggcgagggtttacgccaatattaccttcaacacattcacgatctccagctccaggtccgtcagaagacgcacaaccttaaccgcctcgaagctcagcgaaacgatctcaactctaaagtgagagcgctgagggaggaattacagttgctccaggagccgggatcgtatgttggcgaagttgttaaagttatggggaagtctaaggttttggttaaggttcatcctgaaggaaagtatgtagttgatgtagacaagaatattgacataacaaaaatcacaccttctacaagagtagctcttcgtaatgatagctacgtgcttcacttgattttgcctagcaaggtagatcctttggtcaacctgatgaaggtggagaaagtgccagattctacgtacgacatgattggaggtcttgaccaacagattaaggaaatcaaagaggttatcgagcttcctatcaagcatccagaattgtttgaaagtcttggaatcgctcaaccaaagggtgtgctgttgtatggacctcctggtactggaaagacattgctggccagggcagttgctcatcacacggactgcacttttattagagtttcgggttctgaattggttcagaagtacattggagaaggatcaaggatggttcgtgaactttttgttatggcaagagagcatgctccttcgattatctttatggatgaaattgacagtataggctctgctcgaatggagtctggcacaggcaatggtgacagtgaagtccagcgaactatgctcgagctccttaatcaactggatgggttcgaggcatctaacaagattaaggttctaatggctacaaaccggatagatattcttgaccaagctcttcttcgacctggccggattgacaggaaaattgaatttcccaatcctaatgaagagtctcgttttgacattctaaaaattcattcaagaaaaatgaatttaatgcgtggcattgatctaaagaaaattgctgaaaaaatgagtggtgcatcaggtgcagagcttaaggctgtatgcacagaagcagggatgtttgcattgcgggagcgacgtgtccatgttacacaagaggattttgaaatggctgttgcaaaggttatgaaaaaggagacagagaagaacatgtcactgaggaaactatggaagtaaggaaagcatggaaaggatcaatggaacggtcgattcaatatattatgctaactgcttgtatttcatagtgtataatcagacatgtccaagtgtttacattacttgccatggcaacatggaataagtggatattttgcttggaatttgttttctgattcatttaggcttgaagatgtcttgatttatatattttctgcggtaaagcttggaatttgaatcaaaaaatcaaaaacatcttcctatcttattttagcgagaactagaaatgtgattataattgttgaatatcatgtcaaatatgacaaggtttttcaaatgaattttaattgcgatttgattttgctctagc

SEQ ID NO: 4328 - DNA, 1607 bp, Sciadopitys verticillata
ggagtcttcgaccatgttaatcactccaaattataaaaggcttcgattgctttttctgcagcattttggcgagggtttgatacccaagcgtgctgtgtagtgatatggaagtagatgccgcaggacgaaaattcatagattttttaggcccacctgctgctattccaaaggaaaagctcaaagaaaaacaagaataccagaattcaaaggaatctaacaaaatggtgaagcagggtgagggtttacgtcaatattatatgcagcacattcatgacctgcagatccaggtccgtcaaaagacgcacaatcttaaccgccttgaagcccagcgcaacgatcttaattccaaagtgaggatgctgagggaggagttacagttgctgcaggaaccggggtcatatgtaggtgaagttgtgaaagttatgggaaagtctaaagtattggtgaaggttcatccagaaggaaagtatgttgttgatatagacaagaatattgacataacaaaaatcacaccatctacacgtgtagctcttcgtaatgatagttatgtgcttcatttgattttgcctagtaaagtagatcctttggtaaacctgatgaaggtggagaaagtgccagattctacttatgatatgattggaggtcttgatcagcagatcaaggaaatcaaagaggttattgagcttccaattaagcatccagaactatttgaaagtcttggaattgcacaaccaaagggtgtgctgctgtatggacccccaggtacagggaagacattgctagcaagggcagttgctcatcatacagactgtacttttatcagagtttctggttctgaattggttcagaagtatataggagaaggatcaaggatggttcgtgagctctttgtcatggcaagagaacatgctccatccataatatttatggatgaaattgacagtatagggtctgctcgaatggagtctgggtctggcaatggtgatagtgaagtgcagagaactatgcttgaacttcttaatcagcttgatggttttgaggcatctaataagattaaggttctaatggctaccaaccggatagatattcttgatcaggctcttcttcgtccaggtcgaattgacaggaaaattgagtttcctaatcctaatgaagagtctcgttgggatattttgaaaatccattcaagaaaaatgaacctgatgcgtgggattgatcttaagaaaattgctgaaaaaatgaatggtgcatcaggtgctgagcttaaggctgtatgcactgaagcaggaatgtttgcattgcgagaaagaagagtccatgtgacacaagaagattttgaaatggctgtagccaaagttatgaaaaaagaaacagagaagaatatgtctttgaggaaattatggaaataaggaggtaaactattattggatgtactttcttttttccatacctactgaaatacttcaaagttgcaacaattggatccatatttcaagctactgatttattaaatggtggatcgttgagcttgcaaaagcagttaaattcattgtccaggcaacatagaaatgaaatggatagttttcaagaatcatggtactctggat

SEQ ID NO: 4329 - DNA, 1402 bp, Cicer arietinum
aacaacatatgagtttgcttttgatcgcatcatcatcatcatcgagagagcgatttctgttttcgtgctattgcttccctctttccatttccgtctctacaatagaagctcatcaccgtcttcgtttattgctgtgctcaatttcaactaaataagagaaaagtgcttgaacgacgagagttgatttgatcgatggctacagtgggagtagaagtgaaacaagcacagggtgcactggaggagaattgctctgccaaacctaccaaatcgggcgagggtctccgccagtactattctcagcacattcatgatctacaactcctcctccgccaaaagacccataacctcaatcgtctcgaggctcagcgtaacgatctcaattctagggtgaggatgcttcgagaagaactgcagcttcttcaggagcctggttcatatgttggtgaagttgtcaaagttatgggcaagagcaaagtgctagtcaaggttcatccggaaggaaaatatgttgttgatattgataaaaatattgacattacgaagcttactccatcaactagagttgcactccgcaatgacagttatgtgcttcatttagttctgccaagcaaagttgatccattggttaatctgatgaaagttgagaaagttcccgattctacgtatgacatgattggtggtctagaccaacaaatcaaagaaataaaggaagtcattgagctacctattaaacatcctgagctgtttgaaagtcttggaatagctcaaccaaagggtgtcttgctctatgggccacctggtacaggaaaaacattgttggctagggcagtggcacatcatactgattgtacattcatcagggtgtctggttctgaattagttcagaaatacatcggagaaggttctagaatggtcagagaacttttcgttatggccagggagcatgcaccatcaattatcttcatggacgaaattgacagtattggatctgctcggatggaatctggaagtggcaatggtgatagtgaggtgcagcgcactatgcttgaacttctcaaccagttggatggatttgaagcttcaaataagatcaaggttttgatggccacaaaccggattgatattctggaccaagctctcctaagacctggacggattgatcggaagattgaatttccaaaccctaatgaagagtctcgcctggatattgtgaaaatccattcaagaagaatgaatttaatgcgtgggattgatttgaagaagattgctgagaagatgaatggagcatcaggtgccgagcttaaggctgtgtgcacagaagctggaatgtttgctttgagagagaggaggatacatgtggcacaggaagattttgagatgtctgtggccaaggtgatgaaaa

SEQ ID NO: 4330 - DNA, 1943 bp, Physcomitrella patens
cggaaccctagaatctccgtttcgagattgtttcgtctcaacccagcactgtttcgcagtgatcgatcaaccccttctcaagactggttatcctgcctgccctctacgtttctactgctggggttttcgtgaattttcaatccgaaccatggggcgggccgaagaggtacctaacaagtcggccaggtcgggagaggggttgcgacattactatctctcgcacatacacgacctgctccttcaattgcgagtgaagacgcacaatctgcaccgacttgaggctcaacgcaacgatctcaattctaaagtgcggatgttgagggaagagctgcaactgttgcaagagcccgggtcgtatgttggagaggttgtcaaggttatgggaaaaaccaaagttctcgtgaaggtgcatccagagggcaagtacgtggtagatcttgacaagagcatcgatatcaataaaattactcctaccactagagtcgctcttcggaatgacagttatgttttacatttaattcttcctagcaaggtggatccgttggtgaatcttatgaaagttgaaaaggttcctgactccacgtacgatatgattggaggccttgatcagcaaattaaggagatcaaagaggtcatagagcttcccatcaaacacccagagcttttcgagagtctgggcattgctcaaccaaagggggttttgttgtacggccctcctggaactggaaagacgcttcttgcccgggctgtagctcatcacacagactgtacgttcatccgagtttcaggatctgagcttgtgcagaagtacattggtgaaggttcacgtatggtacgggagctgtttgtaatggctagggaacatgcaccatcaatcatcttcatggatgaaattgatagtattggatcagctcgtgtggagtctgggaatggcaatggagatagtgaagttcagcggacaatgttggagttgttgaatcagcttgatgggtttgaagcgtcgaacaagattaaggttttgatggcaaccaatcgaattgatatcttggatcaagcccttttgcgtcctggacgaattgaccggaagatcgagttccccaatccaactgaagagtctcgattggacatccttaaaattcattcaaggaagatgaacttaatgcgaggtattgatttgaagaagattgctgaaaagatgggaggcgcatctggagctgagcttaaggcaattactggccctgctgtgtgcacagaagcaggcatgtttgctctacgtgaacggcgtgtacatgtaacacaagaggattttgaaatgtctgtggcgaaggtgatgaagaaggatactgataagaacatgtcccttaagaagctatggaagtgattcaagttatgttttaggtggccttggtagctggttatgtacatatacatgtggccagtttattggagcagtccttaaaatctacctatctcaacttatgcaggtagccattttaatgaaatgtagagatttagtgtccagacttgagactgatgaaagaatccaccagtattttggttgtgaattccttcattttcatagcaggaagtttctcactctgcctcttctagcaattgtggttgggagagaaaccattctttgtgggtggcatctctgatgttctttgccaggttgcccctaccagtctttggttttccatgcacaattagtttgatttaattttcttactagactatgcagacattcagtctcgctagcatatcgatgtgatgtgcttcccgaatgaatgaaacgcctcacattggcatcttttcgggttgcaaacgtcagtgacttactttcatttcaatttctacttgacaccaacacgagattagtaacttcttaagaaacaaaatcaaacatgattttatcacagaagtttttgattttgattttcttg

SEQ ID NO: 4331 - DNA, 1307 bp, Flaveria ramosissima
aaattcaatctccattgaaacacaaatcttcaagcttcacaatcatacatctcacaggcaccaatggcgacagcggagatagcgatgaacacatcggactccggtgagaaagaagatagctatttatcgagacacacgggttcgaaaccaggtgaaggcttgaagcagtattaccagcagcatattcacgatgcacagcttcaggttcgtcagaagacgcataatctcaatcgccttgaggctcagcggaacgagttgaattctcgagtaaggatgcttaaggaagagttgcagatgcttcaagagccaggatcttatgttggtgaagttgtcaaagtaatgggaaaatcaaaagttctagtgaaggtgcacccagagggtaaatatgtggttgatattgataaaagcattgacattactaagatcacaccatcaaccagggttgctctgaagaacgatagctatgttcttcatttagttttacctagcaaagtggatcctctggtcaaccttatgaaagttgaaaaggttcctgattctacatatgacatgattggtgggcttgaccagcaaattaaagagattaaggaggttattgaacttccaatcaaacatccagagctatttgagtctcttggtattgctcaaccaaagggtgttctgttatacgggccaccaggtactgggaagaccctgttggcgagagcagtggctcatcacactgattgtactttcatcagggtttctggttctgagttagtacagaaatatattggagaaggttccagaatggttagagaactttttgtaatggccagagaacatgccccgtcgattatatttatggatgaaattgacagtattggatctgctcgaatggaatctggaagtgggaatggtgacagtgaagtccaaaggacaatgttggagcttcttaatcagctggatggatttgaagcgtcaaacaagatcaaggttttgatggctacaaatcgtattgatatcctggatcaggcccttctcaggccagggagaatcgacaggaaaattgaattcccaaatccaaatgaagattcgaggtttgacatcttgaaaatccattcaagaaagatgaacttgatgcgcggcattgatctgaaaaaatcgccgagaagatgaatggtgcttcaggtgcagaactcaaggcggtttgcacagaggccgggatgtttgcattgagagaaaggagagtgcacgtgacgcaagaagatttcgagatggcagtggccaaagtcatagaaaaaggaaccgaaaagacatgtcactcg

SEQ ID NO: 4332 - DNA, 2199 bp, Arabidopsis lyrata
atttaggtgaaataataatgctttgcgtgagggtttctgagattctgatcgaagaaaattaatctctctctccttcttcttcttcttcttcttactagagatctctgtcttggataatttgctgctatcactgagaaaatggcagccgtagaagttgattcgaggcgtcctgagacagcgatggaagaaacctgtaacgtgaaaggagcggcggcgaaacaaggggaagggcttaagcagtactatctccagcacatccatgagctccagcgccagctccgtcagaagactaataacctcaatcgccttgaagctcagaggaatgaactcaattccagagtaagaatgctcagagaagagttgcagctgcttcaagaacctgggtcctatgtgggtgaagtggtaaaagtgatgggaaaaaacaaggtcttggttaaggttcatccagaggggaagtatgttgttgatattgacaaaagtatagatataacaaaaatcactccatcaacgagagttgctcttcgtaatgatagctatgttctccacctggtcttgccaagtaaagtagatccgctggttaaccttatgaaagttgaaaaggttccagactccacatatgacatgattggtggtcttgaccagcaaattaaggaaataaaggaggtcattgagctgccaatcaagcatcctgaattgtttgagtctcttggaattgcgcagccaaagggtgtgttgttatatggtccacctggaactgggaagacacttttggctcgggctgttgcacatcacactgactgtactttcatcagagtttctggttcagagctggtccagaaatacattggagaaggttctaggatggtcagagaactttttgtgatggcaagggagcatgcaccatcaatcatcttcatggatgaaatcgatagtattgggtctgctcgtatggaatctggaagtggaaatggtgacagtgaggtgcaaaggactatgcttgagcttctcaatcaacttgatggattcgaagcgtcaaacaaaatcaaggttttgatggcaacaaatcgtattgatattctggatcaagctcttctcaggcctggaaggattgataggaaaattgaattccctaatcctaatgaagagtcacgttttgatatcttgaagattcactcgaggaaaatgaatttgatgcgtggaatcgatctgaaaaagattgcagagaagatgaatggtgcttcaggtgctgagctgaaggctgtgtgcacggaggcgggcatgtttgcgctgcgggagaggagagtgcacgtgacacaggaagactttgagatggcggtggccaaggctctacctaaccagcaaaccgtagattatccaagcttcaagctcgtcattgttggtgatggaggcacagggaagactacttttgtgaagagacatcttactggggagtttgagaagaagtatgaacctactattggtgtggaggttcatccattagatttcttcacaaactgtggcaagatccgtttttactgctgggacactgctggacaagagaaatttggtggcctcagggatggatactacattcatggtcaatgtgccataataatgtttgacgtcacagcaaggctcacatacaagaacgttccgacatggcaccgtgatctctgcagggtgtgtgaaaacatcccgattgttctgtgtgggaacaaagttgatgtgaagaacaggcaagtgaaggcaaagcaggtgacattccacaggaagaagaatctgcagtactatgagatatcggcaaagagcaactacaactttgagaagcccttcttgtaccttgctagaaaactggctggggaccaaaaccttcactttgtggagacaccagctcttgctccaccagaggttcacattgacattgctgatcagcagaagaacgaagccgagctcttacaggcggcagcccagccactccctgatgacgatgatgatgtctttgagtaaatcttctaaatgtctgctgtgggaagctctagcttgttccttttggtgttttctctatgtttgttttggtgttacatataaatcaatcgagtctttcttataacaaaaattagggaaatatttttggatggttctttgatcaatatccaaagctaagttgtttcttcccaagaatatgaggtgattggaaaa

SEQ ID NO: 4333 - DNA, 1617 bp, Papaver somniferum
aagaagaacacgaaatctaaacttcattaacaggaaacctaaacctctgaagctctctaatggcggcagcagaagtacaaaggaaacagatagtacaaaggaagcatatagaatcaaatggttcatcatttatcgatgcgataaacttaaagaatgccatgatggccaagaataaaccaggtgaaggtcttagacaatattaccttcaacatattcacgatcttcagcttcaagttcgacagaagtctcataatttgaatcgtcttgaagctcagcgtaatgatctcaattctagagtgaggatgctcaaagaagagttgcagttgcttcaggagcctggatcttatgtaggagaggtggtgaaagttatggggaaatcgaaggtgttagttaaggttcacccagaagggaagtatgtcgtcgacattgataaaagcattgacatcacaaaaattacccccacaacaagagttgctcttcgtaatgatagctatgtgctccacttggttttgcccagtaaagtagatcctcttgtcaacctcatgaaagttgaaaaagttccagactctacatatgacatgattggtggtcttgatcagcaaatcaaagagatcaaagaggtcattgagctgccaattaagcatcctgagctttttgagagtcttggaattgctcaaccaaagggagtcctgctttacggtccacctggaacagggaaaacacttctcgcaagggcagtggctcatcataccgactgtaccttcattagggtttctggttccgagctggttcagaaatacattggagaaggatctagaatggtcagagagcttttcgttatggctagggaacatgcgccttcaatcattttcatggacgaaattgacagtattggatcagcccgtatggaatctggaactggtaatggtgatagtgaagtgcagaggaccatgcttgagcttcttaatcagttggatggatttgaagcatcaaacaagatcaaggttctgatggctacaaataggattgatattctggatccagcactcctaaggcctggacgtattgacaggaaaattgagtttccaaatcccaacgaggagtctcgatgggatattttgaaaatccactcaaggagaatgaacctgatgcgtggaattgatctgaagaagatagcagagaagatgggtggggcatctggcgctgagctgaaggctgtgtgcacagaagcaggaatgtttgctctaagggagaggagagtgcacgtaacacaggaagatttcgagatggcagtggcgaaggtaatgaagaaagagacagataagaacatgtccctgcggaagttatggaagtagacctctttttatgtccctgcggaagttatggagtatttctttccagtgggattcagacatgggatggtttatcagaactgaaatttgagggcgtcttttttttaatctgactcatctgtatctgactgattctaactcgtctgaatttgttccagtgtttaactttaagatatatgtttgttttaacgttttagtattttatgttacactctaaaactaaaaccagatcagaagaagtgtttacgctaatatatttttgctt

SEQ ID NO: 4334 - DNA, 1731 bp, Cryptomeria japonica
  misc_feature (586)..(586): n is a, c, g, or t
  misc_feature (1462)..(1462): n is a, c, g, or t
ggatgaatttatttgatgagggcttagcctgcaatactactcggcagccatgcgggtggacgaagaactgggagcggcatttccgaacacagacagcaccggtgcaataaattcgatgggaaccctgaaggaaaaacagcaggagcaaataaaaaacaagaaaatggtaaagcagggcgagggtttgcgtcaatattatatgcagcatattcacgaccttcaacttcaggttcggcaaaagacgcacaatctcaatcgcctcgaggctcagcgcaatgatcttaactccaaagtaagggcgctgagggaagagttgcagttgctacaggagccgggatcatatgtaggtgaagttgttaaagttatgggaaagtctaaagttttggtgaaggtacatccagaaggaaaatatgtagtcgatattgacaagaatattgacataacaaaaatcacaccttccacacgagtagctcttcgtaatgatagttatgttcttcacttgattttgcctagcaaagtagatcctttagtgaatctgatgaaggtggagaaagtgccagattccacttatgatatgattggaggncttgatcaacagattaaggaaatcaaagaggttattgaacttcccatcaagcatccagaactatttgagagtcttggaattgcacaaccaaagggtgtacttctgtatggacctcctggaacaggaaagactttgctggcaagggcagttgcacatcatacagactgcacttttatcagagtttctggttctgaattggttcagaaatacataggagaaggatcaaggatggttcgtgagctttttgtcatggcaagagaacatgccccatccataatctttatggatgagattgacagtataggctctgctcgtatggaatctggatctggcaatggcgacagtgaagtccagagaactatgcttgagctacttaatcaacttgatgggtttgaggcatctaacaagattaaggttctgatggctaccaaccgaatagacattcttgatcaagcacttcttcgacctggtcgaattgacaggaaaattgagtttcctaatcctaatgaagagtctcgttgggatattttgaaaatccattcaagaaagatgaacctgatgcgtggcattgatctaaagaaaattgcagaaaagatgaatggtgcatctggtgctgagcttaaggctgtctgcacagaagcaggaatgtttgcactgcgagaaagacgggtgcatgtgacacaggaggattttgaaatggctgttgccaaggttatgaaaaaggaaacagagaagaacatgtctttgaggaaattatggaaatgagtggaagaatcatttatctccacagctaccagtactccagttcaatgttgcagttattggttccatatttcaagttacaaatgtattaacagtgaaccattgagcacgcanagtcatttatcttattttccaggcaacatggaaattattggatagttttcattcttgaagtaattaagtgctttgaatatgctttctgtgctgcaagaaaatgtatttggctatttcagaggatgttttcatgctaaaaggaaacttattaaatctgtataacagttctgatatgaataacatttaccaaagagcacgaggttgtattttttattttttgtttgcgtatcatgcatggtatttcagaaattcaaatgaaatttttgtcc

SEQ ID NO: 4335 - DNA, 1312 bp, Actinidia deliciosa
  misc_feature (1046)..(1046): n is a, c, g, or t
  misc_feature (1088)..(1088): n is a, c, g, or t
aattccgcacgaggcgcaaaacctacgcatcaaagattcgaacttctcatcttccccaatttctagggtttcgaattcctctgaagcccccaacaatggcgaccgcagcgatcgaaccgatccaaacagacaccgcatcgtccggagagacttgcttctccaaaacgtcgtcgtcgaagcaaggcgagggcctgaggcagtactacctccaacacatacacgatcttcagctccacgttcgccaaaagacccacaatctcaatcgcctcgaagctcagcgcaacgatctcaattccaaagtgaggatgcttaaagaggaactacagttgctgcaagagcctggctcatatgttggcgaagtagtcaaagttatgggaaaatcaaaggtcctagtgaaggttcatccagaagggaagtatgttgttgatattgataagaacatagacatcacaaagctcacaccatcaagtagagttgcccttcgcaatgacagctatgtgcttcacttggtattgccaagtaaagtagatcctctggtaaaccttatgaaagttgaaaaagttccggattctacatatgacatgattggtggccttgatcagcaaatcaaagagataaaggaggtcattgaattaccaatcaagcatccagaactgtttgagagtcttggaatagcacagccaaagggagttttgctgtatgggccacctggtactgggaaaacccttttggcaagggcagtggctcatcatactgattgtacctttataagagtttctggctctgagttggttcaaaagtatattggtgagggctctcgaatggttagagaactttttgttatggccagagaacatgctccatcaatcatatttatggatgaaatcgatagtattggatctgctcgaatggaatctggatctggcaatggtgatagtgaagtccagcgaacaatgctggagcttctcaatcaactggatggatttgaagcgtctaacaaaatcaaagttttaatggctacaaatcgcattgacatcctggatcangcccttctaaggcctggaagaattgacaggaagatagagttnccgaatcccaatgaagagtcccgttgggatatcttgaaaatacactcaagaaaaatgaacttaatgcgtggtattgatttgaagaagatagcagagaagatgaatggtgcatcgggtgcagaattgaaggcggtttgtactgaagctggtatgtttgcattgagggagaggagggttcatgtaacccaggaagattttgaaatggctgtggctaaagtgatgaa

SEQ ID NO: 4336 - DNA, 1723 bp, Cycas rumphii
cttttcttactccgaacccatggaagagcgatgcaggtggaggaactgggaggaattctgatacaagcctcagactcagaggcaaatattagcacaaacacaaaggataagttcaaggagaagcacggttctaaggatctccccagaatggtgaagcagggtgagggtttacgccaatattatctgcagcatattcacgacctgcaactccaggtccgtcagaagacgcacaatcttaaccgactcgaagcccagcgcaatgatctcaactccaaagtgaggatgctcagagaggaattgcagctgttgcaggagccgggttcatatgttggcgaagttgttaaagttatgggaaaatctaaagtcttggttaaggtacatcctgaaggaaagtacgttgttgatatagacaagaacattgacataacaaagatcacaccatctacacgagtggctcttcgaaatgacagctatgtgcttcacttgattttgcctagcaaagtggatcctttggttaacctgatgaaggtggagaaagtaccggattctacatatgacatgattggcggccttgatcagcagattaaggagattaaagaggtcattgagcttccaattaaacatccagaattgtttgaaagtcttggaatagctcaacctaagggtgtcttgctgtatgggccacctggtactggaaagacactgctagcaagagcagttgctcatcatacagactgcactttcatcagggtatctggttcagaattggttcagaagtatattggagaagggtcaaggatggttcgggagctgtttgtcatggcaagagagcatgctccttcaattatcttcatggatgagattgacagtatagggtctgcccgaatggagtctggcactggcaatggtgacagtgaagtgcaacgaactatgcttgagcttcttaatcagctcgatggcttcgaagcctctaacaagattaaggttttgatggctacaaaccggatagatattcttgaccaagcgcttcttcgacctggtcggattgatagaaaaattgagtttcccaatcctaatgaagagtctcgttgggatattctgaaaatccattcaaggaaaatgaacttgatgcgtggcattgatcttaaaaaaattgctgaaaagatgaatggtgcatcaggggccgagcttaaggctgtatgcacggaagcagggatgtttgcattgcgcgagcgacgagtccatgtaacacaggaggattttgaaatggcagtagccaaggttatgaaaaaggaaacagagaagaacatgtcactgaaaaagctctggaagtaagggagatggggcatagactgttgggtgtattctgtttcttagtatttcacctgcctactggtactctggatgtctcattggtggtggatacttctggtagaaacttccatgttctatgctaccattttcatttcgtaatggatccttcatcatgtatgaccattttaaatttttataatttccatggcaatgtggaaataagttgctaaattgcaatgattttagcatttgtgggaggttgaaagttcctttgtagtctgttggaagctatttatgatttttgctttagatttttatggctaaatctgccaaagaattgaattaaaatatccctactgaaatgttttgaaattcagtttagacacattttggtattgaattcttttaa

SEQ ID NO: 4337 - DNA, 1214 bp, Selaginella moellendorffii
aaggaatggggcggtgtggcgagggattccacgactactacacatctcggatccacgatgcctcgcagcagctgcgcatcaagggcaacaatctcgcgcgcctggaagcgcagcgaaacgatctcaactccaaagttagaatgcttcgagaggagctacagctattgcaagagccgggatcgtatgttggtgaggtcgtcaaagtgatgggaaagagcaaagttcttgtgaaggtgcacccagaaggaaagtatgtcgtagatgttgacaagagcatcgacatgagcaagatcactcccaccactcgagttgctcttcgaaacgatagctatgtgctgcacttgatccttcccagcaaagtggatcctctcgtgaatttgatgaaggttgagaaggtcccggactccacgtacgatatgatcggtgggcttgaccagcaaatcaaagagatcaaagaggttattgagcttccgatcaagcatcctgagctttttgagagcctgggtattgcacagccgaagggagtgctactgtatggccctcctggaactggaaaaactttgctggctcgggccgtggctcaccatactgactgtacattcataagagtttcagggtccgagctagtccagaaatacatcggagaagggtcgaggatggtgcgagagcttttcgtcatggcaagagagcatgctccatccattatctttatggacgagattgacagcattggctcgtcccgtatggagtctggcaatggcaacggggacagtgaagtgcagagaacaatgctggagctgctcaatcaactggatggtttcgaggcctccaacaagatcaaagttctcatggctacaaacaggatcgacatccttgatcccgctctcctccggcccggacgaatagaccgcaagatcgagtttccaaacccaactgaagagtcccgtctggatatcctcaagatccattcgcgcaagatgaatctaatgcgggggatcgacctgaagaagatcgccgagaagatgaacggtgcctcgggagcggagctaaaggcggtgtgcacggaggctggaatgtttgctctgcgagagaggcgcgttcatgtcacccaggaagacttcgacatggcggtggccaaagtgatgaagaaggagaccgaaaagaacatgtctttgagaaagctatggaagtgagttaaatcaaaatctcttact

SEQ ID NO: 4338 - DNA, 1338 bp, Selaginella moellendorffii
ctatagtattttatttgtgctctctcgaggctagggttttcaaggaatggggcggtgtggcgagggattccatgactactacacatctcggatccacgatgcctcgcagcagctgcgcatcaagggcaacaatctcgcgcgcctggaagcgcagcgaaacgatctcaactccaaagttagaatgcttcgagaggagctacagctattgcaagagccgggatcttatgttggtgaggtcgtcaaagtgatgggaaagagcaaagttcttgtgaaggtgcacccagaaggaaagtatgtcgtagatgttgacaagagcatcgacatgagcaagatcactcccaccactcgagttgctcttcgaaacgatagctatgtgctgcacttgatccttcccagcaaagtggatcctctcgtgaatttgatgaaggttgagaaggtcccggactccacgtacgatatgatcggtgggcttgaccagcaaatcaaagagatcaaagaggttattgagcttccgatcaagcatcctgagctttttgagagcctgggtattgcacagccgaagggagtgctactgtatggtcctcctggaactggaaaaactttgctggctcgggccgtggctcaccatacggactgtacattcataagagtttcggggtccgagctagtccagaaatacatcggagaagggtcgagaatggtgcgagagcttttcgtcatggcaagagagcatgctccatccattatctttatggacgagattgacagcattggctcgtcccgtatggagtctggcaatggcaacggggacagtgaagtgcagagaacaatgctggagctgctcaatcaactggatggtttcgaggcctccaacaagatcaaagttctcatggctacaaacaggatcgacatccttgatcccgctctcctccggcccggacgaatagaccgcaagatcgagtttccaaacccaactgaagagtcccgtctggatatcctcaagatccattcgcgcaagatgaatctaatgcgggggatcgacctgaagaagatcgccgagaagatgaacggtgcctcgggagcggagctaaaggcggtgtgcacggaggctggaatgtttgctctgcgagagaggcgcgttcatgtcacccaggaagatttcgacatggcggtggccaaagtgatgaagaaggagaccgagaagaacatgtctttgagaaagctatggaagtgagttaaatcaaaatctcttactaaaatggagctctttatacgtttggacggaatgattagtttaatagaccaaaaaactgagctcaactcttgagctcaaaagtc

SEQ ID NO: 4339 - DNA, 1770 bp, Solanum phureja
gttttccctgccaacaagaaacgtagctttaaaagcccaaaaccgatggggaaattctagttgctgctatattcttctttcactcccaaaccctccggacaacgctaatcactgcgatttcttcaaaacctatctgcaaaaatggcgtcagttgatgttgagaagagcaggagcgatatggagagagaggaagcctgttcggcgaaaccaacaaagcaaggggaagggctgagacagtactatatgcagcacatccatgatctccagctccaagtccgcgtaaagactcacaatcttaatcgccttgaagcccagaggaacgaactcaattctaaagtgagaatgctcaaagaggaattacaattgcttcaggagcctggatcatatgttggtgaagttgttaaagtaatggggaagtcaaaggttctagtcaaagttcatcctgaaggcaaatatgttgtcgatattggcaaaaatattgacattacaaagatcactccatcaactagagttgccctgcgcaatgatagctatgtccttcatctaatattgcccagcaaagttgatccattggtcaacctcatgaaagttgagaaagtgccagattccacttatgacatgattggtggtcttgaccagcagatcaaggagattaaagaggttattgagcttcctataaagcatcctgagttatttgagtctcttggaatagctcaaccaaagggagtgctgctctatggacctccaggaactgggaaaacattgttggctagggcagttgcacatcacactgattgtaccttcattagggtctctggttccgaactagtgcagaaatatattggagaaggttctcgaatggtgagagaactttttgttatggccagggaacatgctccttctatcatttttatggatgagatagacagcattggatctgctaggatggaatcagggagtggcaatggtgacagtgaagtgcagaggacaatgcttgaacttctcaatcagcttgatggatttgaggcatcaaacaaaatcaaggcaagctcagcgtgctgtttcaattgtatattgcttgggtataactttattgatgttctgatggccacaaaccgcatagatattctagatcaagcactccttagaccaggaaggatagacaggaagattgaatttccaaatcccaatgaagagtctcgtcaggacattttgaagattcattcgaggaagatgaacttgatgcgggggattgatttgaagaagattgctgagaagatgagtggtgcttctggggctgaacttaaggctgtatgcacagaagcagggatgtttgctctaagagagaggagggtgcatgtgacacaagaagattttgagatggctgttgctaaagtaatgaagaaagagactgagaagaacatgtcactgcgaaagctgtggaagtagatgatggtcgatatgaaggacctgaaacgcatacacatctgagttgattgtctataattacttttgttggaacttttatttgaccccaggagcttacgacttgcccttggtattttcatgtttctcagtaaactgtttcattttctttggccgtatggggcattcacagatgtaattcaaaaatgttcagtgtttttccgcgcagctttagtatttcactcccggcttctaacttattcatgtttattgacatgtttaataaagagaaaaagacttgtgaaacttgtggtgtctattgtggctatgcaagtcctgaaattt

SEQ ID NO: 4340 - DNA, 1869 bp, Picea glauca
aggccgggggatacatattaataaaggaaaggtatcttcttttcttcttagcgttataaattctttcaacgcacaagtgctttcatttactttctgtcatttttcccgtttcatttttgtctgagggtttgtagctatgcgagtagaggaacctggaggaattctgagacaagcctcggacttggaggccgctgcaaacgccaaggaaaaactgaaggagaagcaacaactcctcaaagaatctaacaaaatggtgaaacaaggcgagggtttacgtcagtattaccttcaacacattcatgatctccagctccaggtccgtcagaagacgcacaatcttaaccgcctcgaagcccagagaaacgatctcaactctaaagtgagagcgctgagggaggagttgcagttgctccaggagccgggatcgtatgttggcgaagttgttaaagttatggggaagtctaaggttttggttaaggtgcatcctgaaggaaagtatgtagttgatgtagacaagaacattgacataacaaaaatcacaccttctacaagagtagctcttcgtaatgatagctatgtgcttcacttgattttgcctagcaaagtagatcctttagtcaacctgatgaaggtggagaaagtgccggattctacatatgatatgattggaggacttgaccaacagattaaggaaatcaaagaggttatcgagcttcctatcaagcatccagaactgtttgaaagtcttggaatagctcaaccaaagggtgtactattgtatggaccccctggcactggaaagacattgcttgccagggcagttgctcatcacacagactgcacttttatcagagtttcgggttctgaattggttcagaagtacataggagaaggatcaaggatggttcgtgagctttttgttatggcaagagagcatgctccctctattatctttatggatgaaattgacagtataggatctgctcgaatggagtctggcactggcaacggtgacagtgaagtccagcgaactatgcttgagctccttaatcagcttgatgggttcgaggcatctaataagattaaggttctaatggctacaaatcggatagatattcttgaccaagctcttcttcggcctggtcgaattgacaggaaaattgaatttcccaatcctaatgaagagtctcgttttgacattctgaaaatccattcaaggaaaatgaatctaatgcgtggcatcgatctaaagaaaattgctgaaaaaatgagtggtgcatctggtgcagagctcaaggctgtatgcacagaagcaggaatgtttgcattgcgggagcgacgtgtccatgttacacaagaggattttgaaatggctgttgctaaggttatgaaaaaggaaacagagaagaacatgtctctgaggaaactatggaagtaaggaaagcaaggaaagggtcagtggaacggttggttcaatttatcaagctaccgtgtgtttcatattgggtaatcaaacatgtccaagcgtttatattacttgccatgggaacatggaattaattggatatttggcaagtggaatttgttttttaattcatttctggcttgaagatgtcgtggtttatatcttctctgcaggaagcttgaaatttgaatcaaaaaatttagttaaaatccaagtacaaaaacatattccgatcttattttagcgagaactagaaacgtgattctaagttcttactataattgttgaatatcatgtcatatatgacaaggtttttcaaatgactgttttgaactctcttaaagatgcatatagtgttgcacttctgtaagaattttaatcgtgatttgattttgagctagcaa

SEQ ID NO: 4341 - DNA, 1978 bp, Picea glauca
  misc_feature (1835)..(1835): n is a, c, g, or t
gtcttcttttcttcttagcgttataaattctttcaacgcacaagtgctttcatttactttctgtcatttttcccgtttcatttttgtctgagggtttgtagctatgcgagtagaggaacctggaggaattctgagacaagcctcggacttggaggccgctgcaaacgccaaggaaaaactgaaggagaagcaacaactcctcaaagaatctaacaaaatggtgaaacaaggcgagggtttacgtcagtattaccttcaacacattcatgatctccagctccaggtccgtcagaagacgcacaatcttaaccgcctcgaagcccagagaaacgatctcaactctaaagtgagagcgctgagggaggagttgcagttgctccaggagccgggatcgtatgttggcgaagttgttaaagttatggggaagtctaaggttttggttaaggtgcatcctgaaggaaagtatgtagttgatgtagacaagaacattgacataacaaaaatcacaccttctacaagagtagctcttcgtaatgatagctatgtgcttcacttgattttgcctagcaaagtagatcctttagtcaacctgatgaaggtggagaaagtgccggattctacatatgatatgattggaggacttgaccaacagattaaggaaatcaaagaggttatcgagcttcctatcaagcatccagaactgtttgaaagtcttggaatagctcaaccaaagggtgtactattgtatggaccccctggcactggaaagacattgcttgccagggcagttgctcatcacacagactgcacttttatcagagtttcgggttctgaattggttcagaagtacataggagaaggatcaaggatggttcgtgagctttttgttatggcaagagagcatgctccctctattatctttatggatgaaattgacagtataggatctgctcgaatggagtctggcactggcaacggtgacagtgaagtccagcgaactatgcttgagctccttaatcagcttgatgggttcgaggcatctaataagattaaggttctaatggctacaaatcggatagatattcttgaccaagctcttcttcggcctggtcgaattgacaggaaaattgaatttcccaatcctaatgaagagtctcgttttgacattctgaaaatccattcaaggaaaatgaatctaatgcgtggcatcgatctaaagaaaattgctgaaaaaatgagtggtgcatctggtgcagagctcaaggctgtatgcacagaagcaggaatgtttgcattgcgggagcgacgtgtccatgttacacaagaggattttgaaatggctgttgctaaggttatgaaaaaggaaacagagaagaacatgtctctgaggaaactatggaagtaaggaaagcaaggaaagggtcagtggaactgttggttcaatttatcaagctaccgtgtgtttcatattgggtaatcaaacatgtccaagcgtttatattacttgccatgggaacatggaattaattggatatttggcaagtggaatttgttttttaattcatttctggcttgaagatgtcgtggtttatatcttctctgcaggaagcttgaaatttgaatcaaaaaatttagttaaaatccaagtacaaaaacatattccgatcttattttagcgagaactagaaacgtgattctaagttcttactataattgttgaatatcatgtcatatatgacaaggtttttcaaatgactgttttgaactctcttaaagatgcatatagtgttgcacttctgtaagaattttaatcgtgatttgattttgagctagcnagatgcagggctgagatgcagtattctaaacttggatgagctagttatgagttagtttttaggtcgaatactgctgtttaaatcagtctctgtagtaacatcttttgagaagatggtttattaggtgataaatacaaaatgat

SEQ ID NO: 4342 - DNA, 1776 bp, Solanum lycopersicum
ccaatccaggacccccattgctatccccatgtattgttttcccttccaacaagaaacgagctttaaaatccccaaaccgatacgggaaattccaattgctgcgctatattcttctttcagtgccaaacccaattagtccggacgacgcaaatcacagcgatttcttcaaaacctatctggaaaaatggcatcagttgatgttgagaagaggaggagcgatatggagagagaggaagcctgttcggccaaaccaacaaagcaaggggaagggctgagacagtactatatgcagcacatccatgatctccagctccaagtccgcgtaaagactcacaatcttaatcgccttgaagcccagaggaacgaactcaattctaaagtgagaatgctaaaagaggaattacaattgcttcaggagcctggatcatatgttggtgaagttgttaaagtaatggggaagtcaaaggttctagtcaaagttcatcctgaaggcaaatatgttgttgatattggcaaaaacattgacattacaaagatcactccatcaactagagttgccctgcgcaatgatagctatgttcttcatctaattttgcccagcaaagttgatccattggtcaacctcatgaaagttgagaaagtgccagattccacttatgacatgattggtggtcttgaccagcagatcaaggagattaaagaggttattgagcttcctataaagcatcctgagttatttgagtctcttggaatagctcagccaaagggagtgctgctctatggacctccaggaactgggaaaacattgttggctagggcagttgcacatcacactgattgtaccttcattagggtctctggttccgaactagtgcagaaatatattggagaaggttctcgaatggtgagagaactttttgttatggccagggaacatgctccttctatcatttttatggatgagatagacagcattggatctgctaggatggaatcagggagtggcaatggtgacagtgaagtgcagaggacaatgcttgaacttctcaatcagcttgatggatttgaggcatcaaacaaaatcaaggcaagctcagcatgctgtttcaattgtatattgcttgggtataacttttttgatgttctgatggctacaaaccgtatagatattctagatcaagcactccttagaccaggaaggatagacaggaagattgaatttccaaatcccaatgaagagtctcgtcaggacattttgaagattcattcgaggaagatgaacttgatgcgggggattgatttgaagaagattgctgagaagatgagtggtgcttctggggctgaacttaaggccgtatgtacggaagcagggatgtttgctctaagagagaggagggtgcatgtgacgcaagaagattttgagatggctgttgctaaagtaatgaagaaagagaccgagaagaacatgtcactgcgaaagctgtggaagtagatgatggtcgatatgaaggacctgaaacacatacacatctgagttgattgtctatatttactgttgttcttggaacttttatttgaccccaggagcttccgacttgcccttaatattttcatgtttctctgtaagctgtttaatcttctttggccgtatggggcattcgcagctgtaattcaaaaatgtccagtgtttttccgcgcagctttagtattcgactctcggcttctaacttatatttgcttttattgacagcaataaagagataaaagacttgtgga

SEQ ID NO: 4343 - DNA, 1355 bp, Euphorbia peplus
tatccatgaacttcagcttctaccaaccgacaaaagtctcacaatcttaatcgtcttgaggcccagcgtaatgagctcaattccagagtgagaatgctcagagaagaactacagttgcttcaggaaccgggatcatatgttggtgaagttgtcaaagtaatggggaaaaataaggtgttagttaaggttcatcctgaaggaaagtatgtcgttgatatcgacaaaagtattgatatcacaaagatcacaccttcaacaagggttgcccttcgtaatgacagctatgttcttcatttggtcttgcctagcaaagtagatccactagtcaacctgatgaaagtagaaaaggttccagattctacatatgacatgattggtggccttgaccaacagattaaggagataaaggaggtcattgaacttccaattaaacatcccgaactgtttgagagtcttggtattgcgcagccaaagggtgttcttctttacggtccccccggtacagggaaaaccctattagctagggcagttgcgcatcatacagattgtactttcatcagggtttctggttctgaattggttcagaagtacataggtgaaggctctcgaatggtccgagaactttttgtcatggccagagaacatgctccatctattattttcatggatgaaattgatagtatcggatctgctagaatggaatctggaagtggaaatggagatagtgaggtgcaacggactatgctggagcttctcaatcaattggatggttttgaagcatccaacaagattaaggttttgatggcgaccaaccggattgatattctagatcaagctctccttaggcctggtcgaattgacaggaagatagaatttccaaatcctaatgaagagtcacgtcaagatatcttgaaaatccattcaagaagaatgaacttgatgcgcgggattgatttgaagaagattgccgagaagatgaatggtgcatctggtgcagagctcaaggctgtatgcacagaggcaggaatgtttgcacttagggagagaagggtgcatgtaacacaggaggattttgagatggctgtagccaaggttatgaaaaaggagacagagaagaacatgtcgttgcggaagctttggaaataaaactgttgtgttgttatttaaacaaactgtatcgcagcgggtgccgattagaaattatcagagggctacagagacgtactcatagcttaaattgaggggttggcctttagatttcgtttgtaatcaaactcatgcttcacacttgtgtataacttatttactacatttagttgctattttcctacttaataacttgatcaagtcaaatt

SEQ ID NO: 4344 - DNA, 1554 bp, Humulus lupulus
cttaatcgtcttgaagctcagcgtaacgagctcaattccagagtgaggatgcttagggaagagctacaactacttcaggagcctggatcctatgttggagaagtagtcaaagtaatggggaaaaacaaggttttagtcaaggttcatccagaagggaaatacgttgttgatattgataaaagcattgatatcacaaagattacaccatctactagggttgctctccgaaatgacagctatgttcttcatttggtcttgccaagtaaagtagatcctttagtcaaccttatgaaagttgaaaaggttccagattctacatatgatatgattggtggacttgatcagcagatcaaagaaatcaaggaggtcattgaacttccaatcaaacatcctgagttgtttgagagtctcggaatagctcaaccaaagggggtccttctgtatgggccacctggtacagggaaaacactattggctagggctgtggctcatcatactgattgtaccttcatcagggtatctggttctgaattagttcagaagtacattggagaaggctctagaatggttagagaactttttgtcatggcgagggaacatgctccatctattatttttatggatgaaattgatagtattgggtctgctcgaatggaatctggaagtggcaatggagatagtgaggtgcagcggactatgttggagcttctcaaccagctggatgggtttgaagcatcaaacaagatcaaggtattgatggcaacaaatcgtattgatattttggatcaagccctccttaggccagggagaattgacagaaagattgagtttccaaatcctaatggtgattctcgtttcgacatcttgaaaattcattcaaggagaatgaatttaatgcgtgggattgatctgaagaagattgcagagaagatgaatggggcatctggtgcagagctgaaggctgtatgcacagaagcagggatgtttgctttgagggagagaagggttcatgtaactcaggaagactttgagatggcagtggccaaggttatgaagaaggatactgagaaaaacatgtcgttgcgcaagctatggaagtagttctttaactgaatactatgctgtgaaaggcaacaaggcagacaagaaaatttgctggcgcttatgcttttttcacatgcaaagttctcaagccctccgactgcgctgacgctcgactttgtgcatgtttattgtttttcagagttggtaactgggtattttctttcaccgtctggtctctgtgaatggattcgtaggagacacttttatgaaatttcatcgcttgagtgcttcatttcatgttctcattgattctaggctcgaagttagcacgacccatcaagaaaattgtgaaaacctgattggaccgaatcactgattgatgtaatggtccatagtgaaatgtttttcacttttcatgcctaataaataaatcatatatagatgtagactaggtgcgatcaaagtgtaattttatgacataaattttaaataaataaataatattatata

SEQ ID NO: 4345 - DNA, 1604 bp, Pteridium aquilinum
tttaagcgaggcaggctctctcaggagaaagaaagagacgagcgaggttgtctgtgttgggtgagaaaccatggggcgagagggcgatgggctgaggcagtattacatcgcccacataaatgaactcaacctgcagctgcgccagaagatgcacaatctcaaccgccttgaggcccagcggaatgattacaacgccagagtgcgtatgctcaaggaagaattgcagttgctccaagaaccagggtcgtatgttggtgaagttgttaaagttatgggcaagaaaaaggtccttgtaaaggtgcatcctgaagggaagtatgtggtggatattgacaaagacatagatattacgaaaatcactccttctacacgtgttgctcttcggaatgacagttatgtcctgcatttgattttgccaagcaaagttgatccattggtcaacttaatgaaggttgaaaaggttccagattctacatatgacatgattggtggtctggatcaacagattaaggagattaaagaggttattgagctgcctatcaagcatcctgagctctttgagagccttggtatagctcaaccaaagggcgtccttctgtatggaccccctggcacaggcaaaactctacttgcaagagctgtagctcatcatactgattgtactttcattcgagtctcgggctcagagcttgtgcaaaaatatattggagagggttcacgaatggttcgagaactatttgtgatggcaagggagcatgctccctcgatcatattcatggatgaaatcgatagcataggctctgcgagaatggagtcaggaaatggcaatggtgatagcgaggtccaaaggacaatgttggagcttctcaaccaactagatgggtttgaagcatccaataaaatcaaggtgttaatggcaaccaacagaattgacattcttgatcatgcgcttcttcggcctggtcgtattgacagaaaaattgagtttcctaatcctactgaagagtcacgttgcgatatcctaaaaatccattcgcggaagatgaatctcatgagagggattgacctgaaaaaaattgcagagaagatgactggtgcctcgggtgcagagttaaagtcggtctgtacagaagctggtatgttcgcattgcgagaacgccgggtacatgtgactcaggaggactttgacatggcagtcgcaaaggtgatgaaaaaggagaccgagaagaatatgtcattgaagaagttatggaagtaagaaagggagaaagggggggggatttatgtgaagtggaacatctccagaagatttcaatccagttggttgactgtagcttgttcacacacaggcccgtccatagctggcaaagcttgttcagtcatctgctatgcgcaacagttaactgttttggtgacaaatgatttttgtcagtttaagggacaattaagtcatggtattttgttacagatataatcagtgctgacatatgttgaggtacccacctcgcagtgtagctgtgtgggcttgtccaaaaacttgtgattaagcaagctttccattggggcttggtgctgacagttttatagacgggttcatgtgcaaa

SEQ ID NO: 4346 - DNA, 1495 bp, Sequoia sempervirens
gacctgcagcttcaggtccgtcaaaagactacacaatcttaaccgtcctcgaggcccagcgcaatgatcttaattccaaagtaaggatgctgagagaggagttacagttgctgcaggagccgggatcatatgtaggtgaagttgtcaaggttatggggaagtctaaagtattagtaaaggtgcatcctgaagggaaatatgttgttgatgtagataagaacattgacataacaaaaattactccttctacaagagtagctcttcgtaatgatagttacatgcttcacttgattttacctagcaaagtagatcctttggtgaacctgatgaaggtggagaaagtgccggattctacttatgatatgattggaggtcttgatcaacagatcaaggagatcaaagaggttattgaacttccaattaagcatccagaactatttgaaagtcttggaattgcacaaccaaagggtgtattgctctatggaccccctggtacaggaaagactttgctggcaagggcagttgctcatcatacagactgtacttttatccgagtttctggttctgaattagttcagaaatatattggagaaggttcaagaatggttcgcgagctttttgtcatggcaagagaacatgctccttccataatctttatggacgagattgacagtatagggtccactcgaatggagtctggatctggcaatggtgatagtgaagtgcagagaactatgcttgagctgcttaatcagcttgatgggtttgaggcatctaacaagattaaggttctgatggctactaatcggatagatattcttgatcaagctcttcttcgtcctggtcggattgacaggaaaattgagtttcccaatccaaacgaagagtctcgctgggacattttgaaaatccattcaagaaaaatgaatctgatgcgtggtattgatctgaagaaaattgctgaaaaaatgaatggtgcttcaggtgctgagcttaaggctgtatgcacagaagcaggaatgtttgcattacgagaaagacgagtccatgtgacacaggaggattttgaaatggctgtagctaaagttatgaaaaaggaaacagagaaaaacatgtcattgaggaaattatggaaatgaggggaatgatcagagggtgtacttgtctatagccacttcaatagtttaaagctgcacctattggttccatagtttcagcaactgttttcatttatggttgatcttcaaacgtgcataagcaattatattatgctcaggcaacatcggaaaactcggtgcttttggatggggtttctgtgttgctagggaatgtattttttgagctgtttgagagggtttctatcctttaagcatgtcttttttattgccaatataaagaatattttccaatgaccacatgaatgcgttatcattctattcattgtggcaaattcggtatagaatggatattcaaatattattcttttgaaagaaag

SEQ ID NO: 4347 - DNA, 1442 bp, Silene vulgaris
gaagacaatgttgaatcaaccagagggttttagtcaatacttcgctcaccgtatccatgaacgcagccttgaagctctcaccaaaacgttcaatctccaacgtcttcatgctcagcgtaacgacctcaattctcgagttagatcagtcaaggaggaaatacaactgcttcaagtaccaggttcctatgttggtgaagtggttaaagtgatgggaaaatcaagagtcctggttaaagttcatccagagggcgaatatgttgttgatattgacaaaaatattgacatatctaaactcactccatccacgagagttgcattgcgaaatgacagttatgtcctccatttaattctgccgagtaaagtagaccctctggtcaatcttatgaaagttgagaaagttcctgattcgacctacgacatgattggtggtcttgatcagcaaatcaaagagataaaggaggtcattgagcttccaattaaacaccccgagttgtttgagagtcttggaatcgctcaaccaaagggcgttctcctttacggtcctccaggaacgggcaaaaccctgttggcaagggctgttgctcaccatactgattgcacctttattagggtatcaggttccgaacttgttcagaagtacattggtgaaggctctcggatggtcagggaactttttgttatggccagagagcatgctccatcaattatttttatggatgagattgatagcataggttctgcgaggatggagtctggttctggcaatggtgatagcgaagttcaaagaacaatgctggaacttctcaaccaacttgatggttttgaagcttcaaataagatcaaggtgttaatggctaccaatcgaattgatatattggatcaagctcttcttaggccaggaagaatcgatagaaagatagaatttccaaatcccaatgaagattcgcgtggtgacatcttgaaaatccattcaagaaaaatgaacttaatgcgaggcattgatcttaagaagattgcagaaaagatgaatggtgcatcgggtgcggagcttaaggcggtatgcacagaagcgggaatgtttgctctaagagagaggagaattcatgtgactcaggaggactttgaaatggccgtggccaaggttatgaagaaggataccgacaaaaatatgtccctacgcaagctatggaagtagcctcttgtagtctcagtcatgcatgtttaaatctggacaagttcgagaatgaagcatcagggctttgtggtgtgttgagacttgagaggcggacactcctatatggcattcaattgcacccccgatctcacaggttagacggtcttaaccctgatcgcgacattagcatgtcttcttcctagcaatttgtttattattatttttatcaagttgtcaaaaaacatttattgtaataaatctgaaaaac

SEQ ID NO: 4348 - DNA, 1377 bp, Papaver somniferum
aatctctgaagctctctaatggcggcagtagaagtacaaaggaagcacatagaatcaaatggaggaaattcatcatttatcgatgcgataaacttaaagaatgccatgactgccaagcataaaccaggtgaaggtcttagacaatactaccttcaacatattcacgatcttcagcttcaagttcggcagaagtctcataatttgaatcgtcttgaagctcagcgtaatgatctcaattctagagtgaggatgctcaaggaagagttgcagctgcttcaggagcctggttcttatgttggagaggtggtgaaagttatggggaaatcgaaggtgttagttaaggttcacccagaagggaagtatgttgtcgacattgataaaagcattgacatcacaaaaacttaccccacaacaagagttgctcttcgcaatgatagctatgtgctccacttggttttgcccagtaaagtagatcctcttgtcaacctcatgaaagttgaaaaagttccagactctacatatgacatgattggtggtcttgatcagcaaattaaggagatcaaagaggtcattgagctgccaattaagcatcctgagctttttgagagtcttggaatagctcaaccaaagggagtcctgctttacggtccacctggaacaggaaaaacacttctggctagggcagtggctcatcataccgactgtaccttcattagggtttctggttctgagctggttcagaaatacattggagaaggatctagaatggtcagagagcttttcgttatggctagggaacatgcgccttcaatcattttcatggacgaaattgacagtattgtatcagctcgtatggaatctggaactggtaatggtgatagtgtagtgcagaggaccatgcttgagcttctcaatcaatttgaagcatcaaacaagatcaaggttctgatggctacaaatagtattgatattctggatccagcactcctaaggcctggacgtattggcgggaagaagagtttccaaatcctagcgaggagtctcgatgggatattttgaaaatccactcaaggagaatgaacctgatgcgtggaattgatctgaagaagatagcagagaagatgggtggggcatctggtgctgagctgaaggatgtgtgcacagaagcaggaatgtttgcgctaagggagaggagagtgcacgtaacacaggaagatttcgagatggcagtggcgaaggtaatgaagaaagagacagataagaacatgtccctgccgaagttatggaagtagacctctttttacgctctctgaacacgatcactccccaatgtttttctttattgtatttctgtccagtgggattcaaacatgggaa

SEQ ID NO: 4349 - DNA, 1378 bp, Zea mays
acaccgagcagcaagcaccaccaccgcccgggcggccactccacttcctcccctgctgcactgacgcgcccagcgccaaagcatcctttcacctcaaagataaggaggccgtaacctgtcggggccctcccccaatctccagcgacgccgtccccccaactcgccacccatggccatgtcgttccacttccacccgctggccgcctcgcgcgtccacttctccccactcccgttcgccgccgccgcgggggcgccctccccctcctcctccgtcgccatcgcggcgcaccaccagcacggtcgccgccgcttctccgccatcgtggccacggcggccgccgcgtcggcggcgaccacggagttcgacttcaaggcgtacatgggggagcgcgcggtcgcggtgaaccgggccctggacgcggccgtccccgccggggagccccccgcggcgctgcacgacgcgatgcgttacgcgctgctggcgggcgggaagcgcgtgcgccccgcgctgtgcctggccgcgtgcgccgtggtgggcgggccggagccctgggccatgccggccgcggcggccgtcgagatggtgcacaccatgtcgctcgtccacgacgacctcccctgcatggacgacgacgacctccgccgcggcaagcccacctgccacgtcgtctacggcgagcccatcgccgtcctcgccggggacgcgctgctctcgctctccttccaccacatggccagcgtcgggtcctaccctccggacgtggacccggagaagcaccccgcccgcgtcgtccgagccattggggagctcgcgcgctgcatcggatccgagggactcgtcgccggccaggttgtcgatctcgagatgacgggcacatcagagacggtgcccctcgaacgcctcgagtacatccacctccacaagaccgccgcattgctcgaggcctcggtggtgattggggcgatcatcggaggcggcacggacgagcagatcgagaggctgcggaagtacgcgaggtcgatcgggctgctgttccaggtggtcgacgacatactcgatgtcaccaagtcgtcagaggagctcggcaagacggcggggaaggacctggcaagcgacaaaacgacgtacccgaagctgctggggctagaaaagtcgcgggagttcgcggaggagttgctctctgatgccgtagagcagcttgcttgcttcgacaaggagaaggcagcgcctctgttgcatctggccaactatatcgcccataggcagaactgagaatttgaggtgattgcgtactctattgtcggacctgttgtaactttgtcaggccgtcgcccgtcgaactggggttcgaggaatatatccaaatcgtcatgtgat

SEQ ID NO: 4350 - DNA, 1787 bp, Zea mays
ggggtatggtcgtatggagagggaaggagaagaggaagcaagcccctgttcatcacatcacatgctgcgtcagacactggttcaacagaactgacccgagaacctgttcatatagatggaaagtgagacacggtggccgtagcgtcccacgctcgctcctttaaaaaggtgctcatgccgtcgtgccaacagcccaacaccaccacgcctagcaccaagcaccaccaccgcccgggcggccactccacgtctccacttgccgtgctgcaccgacgcggccagcgccaaagcttctcttcacctcaagaattcaagacaaggcagatcgcaacctctcgaggccacccccaatctccaacgttgccgtcccccgcactttacccccaagcccaacccaactcgccacccatggccatggcgtttcacttccacccgctggtcgcctcgcgcgtccacttctctccgctcccgttcgccgccgctacgggggcaccctccccctcttcctccgtcgccatcgcggcgcactaccaccaccacggccgccgccgcttctccgccatcgtggccacggccaccaccacggagttcaacttcaaggcatacatggaggagcgcgcggtcgcggtgaaccgggcgctggacgcggccatccccgccgggggcctccccgcggcgctgcacgacgcgatgcggtacgcgctgctggcgggcgggaagcgcgtgcgccccgcgctgtgcctggccgcgtgcgccgtggtgggcgggccggagtcctgggcgatgccggccgcggcggccgtcgagatggtgcacaccatgtcgctcgtccacgacgacctaccctgcatggacgacgacgacctccgccgcggcaagcccacctgccacgtcgtctacggcgagcccatcgcggtcctcgccggggacgcgctgctctcgctctccttccaccacatggccagcgtcggatcctaccctccggccgttgacccggagaagcaccccgcccgcgtcgtccgagccattggcgagctcgcgcgctgcatcggatcggagggactcgtcgccggccaggttgtggatcttgagatgacaggcacgtctcaaactgtgccccttgaactcctcgagtacatccacctccacaagactgctgcattgctcgaggcctcggtcgtgatcggggcgatcatcggaggcggcacggacgagcaaatcgaggcgctgcggaaatacgcgaggtcaatcgggctgctgttccaggtggtcgatgacatactcgacgtcaccaagtcgtcggaggagctaggcaagacggcggggaaggacctggcaagtgacaagacgacgtaccctaagctactggggctagccaagtcgcgggagtttgcagagaagttggtctctgacgcaacagagcagctcgcttgcttcgacgaggagaaggcagcacccctgttgcacttggccaactatatcgcccacaggcagaactgaagatttgtggtgatgcttattctgttcttgctcactgtcgatctgtaacattgtataaggcagttgatattggttctgagaaatatttccaaatcgtcatttggtgtatactagctgtagctctgtaccttgatgtaatgaggctgttatattttttttctccattgaagaatgcaaataaatatggaagaattgtacacatgccttattgtgacgtagacctttgatatgtttcaggaagcattggtgtactgtgaatatgtataatactacctcggttcataaat

SEQ ID NO: 4351 - DNA, 1527 bp, Setaria italica
caccgcaccaccaccgcccgggcggccactccacttccactgacgcggccccggccagcgtccaaagcttccctcacctctaagataaggagatcgcaacatctcggggccacccccaatctccacgacgccccccatcccccccgcacttaataccatcgccgcccaaagccgttcgccacccatggccatggccttccaccccctggccgcctcgcgcgtccgcctcgcccccctcctcccgggcgccgccgccgcgccctcgcccgcctccgtcgcggcgcaccaccaccaccaccggcgccgcttctccgccatcgtggccacggcggccgcctcggcgaccacggagttcgacttcaagtcctacatggggtcgcgcgcggaggcggtcaaccgcgcgctggacgcggccatcccggcgggggaggaccccgtgtcgctgcacgaggcgatgcggtacgcgctgctggcgggcggcaagcgggttcggcccgcgctgtgcctcgccgcgtgcggcgtcgctggcggccgggaggcctgggcgctggcccccgcggccgcggtcgagatggtgcacacgatgtccctcgtccacgacgacctgccctgcatggacgacgacgacctccgccgcggcaagcccacctgccacgtcgtctacggcgagcccatcgcggtcctcgccggggacgcgctgctctcgctcgccttccaccacatggccagcgttggctcctacccgccggacgtcgacccggacaagcaccccgcccgcgtcgtccgcgccattggcgagctcgcgcgatgcatcggctcggagggcctcgtcgccggccaggtcgtcgatcttgagatgaccggcacatctgaaattgtgccccttgaacgcctcgagtacatccatctccacaagaccgctgcattgcttgaggcctcagtggtcattggggcaatcatcggcggtgccacggatgagcaaattgagcggctgcggaagtatgcaaggtcaatagggcttctgttccaggtggtcgatgatatacttgatgtgaccaagtcgtcggaggagctagggaagacagcggggaaggacttggcaagtgacaagacgacataccctaaattgttggggttagacaagtcaagggagtttgcagaaaagttgctttctgatgcaaaggagcagcttgctggtttcgacaaagagaaggcagcacctctattgcatttggcctactatatcgcccataggcagaactgaggtgatgcttactctgctgttgatcttgttgatttgtaactttgtaaggtcattgaacctgggtttcaggaacatccgaatcatcatgtgatgtatactagctgtagctttctatctttggtgtaaggagtctgtttagttgaaaatatgaatatcatatcaaattataaaagtgattgaagccaatctttctgccttatgcatgcatgacaccatcaaaatgctccaagcaatgttatttggaaattattcagttgcatagc

SEQ ID NO: 4352 - DNA, 1635 bp, Brachypodium distachyon
gtccgtcacccggtgccaaagtttcccctcttcgcttcaagttctagataagagacgctgagacggtcgcaaccccccccaccccccccacccccaccccacccacacccgcggtggtgccatcccatctccatactcctctccgcgtccccccactaaaactcccacccccttaacccccaagccatggcggccttccacccccttgtcgcctcgcgcgtccacctctccccgctcctccccgccgccgctggccccgcggcggcggttgcggccgggctgtccttccaccggcgccgcttctctgccatcgtcgccgcggcgaccgcccccacggcgacggagttcgacttcaaggcgtacatgggggagcgggcggtggccgtgaaccaagcgctggacgcggccatcccggccggcgagccccccgccgcgctccacgacgcgatgcggtacgcgctgctggctgggggcaagcgcgtgcgcccggccctgtgcctggcctcctgcgtcgtggtcggtgggcgcgaggcctgggcgatggcccccgccgccgcggtggagatggtgcacaccatgtcgctcgtccacgacgacctcccctgcatggacgacgacgacctccgccgtggcaagcccacctgccatgtcgtgtacggcgagcccatcgccgtgctcgcgggtgacgccctgctctcgctctccttcgggcatatggccagcatggactcctaccctcccgacgtcgaccccgagaagcaccctgctcgcgtcgtccgaggcattggggagctcgcgcgatgcatcggatcagagggcctcgtcgccggccaggttgttgatcttgagatgactggctcaactgagactgtaccccttgaccgccttgagtacattcatctccacaagactgctgcattgcttgaggcgtctgtggttattggtgcaatcatagggggtgggtcggatgagcagattgagcggttgcgaaagtatgctagatcaatagggttgctgttccaggtggttgatgacatacttgatgtcaccaagtcatcagaagaactagggaagacagcagggaaggacttggcaagcgacaagacaacatacccaaagttattagggttggagaaatcaagggagtttgcagagaagttgctttgtgatgcaaaggagcaacttgcagattttgacaaagagaaggcggcaccgctgttgtacttggccaattatattgcctatcggcagaactgaggtgatggtgactctgttgttcattgttgatttgtaactttgtaagatcgcgaagtttgggatttcaggaatatccagagttcttcgtctgatatatactagctgtagttttctaccttgttgtcatgagaatagttagttgacaaatgtcatattgggatattttgttgacagatatcaatgtcccatttagatattcaaaacattataatggtaatcagcctttatgcctatagtttctggatgataaccgatcggttgatttctaaagagtaacattttgtttgttttctttttatgacaattgcatgcattgcattgttgctatgctccttgcactcctgtaggctaaatgttcggcaacaaagagcatgttca

SEQ ID NO: 4353 - DNA, 1492 bp, Panicum virgatum
agaaaaaagtgtgcctcgctccaccccaccaccaccgcccgggcggccactccacttccactgacgcggccccgcccctgccctgccctgccacggccagcgtccaaagcttcccttcacctcaagataaggggatcgcaacatctcggggccacccccaatctccacttaaccccatcgccgcccgaagccgttcgccactcgccgccaatggccatggccttccaaacccttgccgcctcgcgcgtccgcgtcggccccctcctccccgccgccgccgccgcggcgcccacgccctcctccgtcgcggcgccccgccaccacccccggcgccgcttctccgccatcgtggccgtggcgcccgcggcggcgcccgcagcggcgcccgcggagttcgacttcgactcctacatgacggaacgctcggagatggtcaaccgcgccctggacgcggcaatccccgagggggagccccccgcagcgctgcacgaggcgatgcggtacacgctgctggcgggcggcaagcgggtgcgccccgcgctgtgcctcgccgcgtgcggcgtcgtgggcgggcgggaggagtgggcgctggcccccgccgccgcggtcgagatggtgcacaccatgtcgctcgtccacgacgacctgctctgcatggacgacgacgacctccgccgcggcaagcccacctgccacgtcgtctacggcgaggcaatcgcggtcctcaccggggacgcgctgctctcgctcgccttccaccacgtcgccagccctggctcctacccgccggacgtcgacccggagaagcaccccgcccgcgtcgtccgcgccactttcgagcttgcgcgctgcatcggctccgagggcctcgtcgccggccaggttgtggatcttgcgaatactggtgcatctgaagttgtgccccttgaacgcctggagtacatccacctccacaagactgctgcattgcttgaggcctcagtggtcatgggggcaatcatgggcggtggcacggatgagcaaattgagcggctgcggaagtacgcgaggtcaatagggcttctgttccaggtggtcgatgatatacttgatgtgaccaagtcgtcggaggagctagggaagacagcagggaaggatttggcaagcgacaaggctacatacccgaaattgttggggttagagaagtcacgggagtttgcagaaaaattgctttccgatgcaaaggagcagcttgctggttttgacaaagagaaggcagcacctctgttgcatttggcctactatatcgcccataggcagaactgaggtgattgcttactctgttgttgttcttgttgatctgtaactttgtaaggccattgtacttgggtttcagaaatatccgaatcatcatgtgatgtatactagctgtagctttctaccttgctgtaagaaggctattcagttgaaaatatgaatatcaaatcaaattagtaaaacctgattgaaacca

SEQ ID NO: 4354 - DNA, 1423 bp, Secale cereale
cccctctttgcttcatctacagataagagaaggtcgagcagcccacgggggccatctccaccctctccgcccactccaccccgcactagaaaaccccgagagccatggcagcgttccaccccctggtcgcctcgcgcgtccgcctcaccaccccgctcctccccgtcgccgctcccgccgccgccgccgcagccggggtctccttccaccgccgccgcttctccgccatcgtcgccgcggcgaccgcccccgcggccaccgggttcgacttcaactcctacatgggggagcgggcggtggccgtgaacagcgccctcgacgccgccgtcccggccggcgagccccccgcggcgctccacgacgcgatgcgctacgcgctgctggctgggggcaagcgcgtgcgcccggccctctgcctggccgcctgcgtcgtgtccggcggccgcgaggcctgggcgatggcccccgccgccgcggtcgagatggtgcacaccatgtcgctcgtgcacgacgacctcccctgcatggacgacgacgaccttcgccgcggcaagcccacctgccacgtcgtcttcggcgagcccatcgccgtgctcgccggcgacgccctgctcgcgctcgccttcgagcacatggctagcgtcgactcctaccctccggacgtcgaccccgccaagcacaccgcccgcgtcgtccgcgccattggtgagctcgcgcgctgcatcggatcagagggcctcgtcgccggccaggttgttgatctggagatgactggctcaactgagactgtaccactcgaccgccttgagtacatccatctgcacaagactgctgcattgcttgaggcctcagtggttattggagcaatcatcgggggtggctcggaagagcagattgagcggttgcgcaagtacgcgagatcaatagggttgctgttccaggtggttgatgacattcttgatgtcaccaagtcatcagaggagctagggaagacagctgggaaggacttggcgagtgacaagacgacatacccgaagttactagggttggagaagtcacgggaatttgcggagaagttgctttctgatgcaaaggagcaacttgctgattttgataaagagaaggcagcaccgctattgtacttggccaactatattgcctatcggcagaactaaggtgatggttattctgttgtttgttgttgatctgtaactttgtaagaacatcaagtctgggatttgaggaatatctgaattcttcccctcatatatactagtttagttttctaccgttgtgtcatgagaatatttaggtgacaaaagccacatgagttaggtggcaaataccaaagtcccattgagagagccaagtcattataatgggaatcagcctttatgtcatatactgtctggatgataataaa

SEQ ID NO: 4355 - DNA, 2259 bp, Oryza sativa
ttcgtcagttcgtcacttgtcgccgagggagactggaatgcaaatcaaacgcacacgccttgcacgacgcactcatgcgcacctgctccccctataaatcgagcacaaaaagcctgtctctcctccccacaggtagtggaacggagccaccgcccaactcgcccccaaagttgcccatctagataagaagaagcgtcgcaactcacggtcgcagtgccacgccccacttcatatcctttccctcccccaactgaacgaaaaaaacaacagagaaaaactcctccctcctcctccccctctgaagccatggctgccttccccccgctcgccgcctcccgcgtccgcatctcccctctcatccccgccgccgcgatggctgggacagcaggggcggcggcggcgtcgtacgcgcagcaccggcggaggttctgcgccatcgtggcgaccgcggcggcgtcaccggtgccggccgcggcggcggcggcggcgacggggtttgattttaacgcgtatatgggtgagaaggctgcggcggtgaaccgggcgctggacgcgtcgatcccggcggacgagccgcccgcggcgctccacgaggcgatgcggtacgcgctgctggcgggcgggaagcgggtgcggcccgcgctgtgcctggcggcgtgcgcggtggtcggggggcgggaggcctgggcgatgcccgccgccgccgccgtcgagatggtgcacaccatgtcgctcgtccacgacgacctcccctgcatggacgacgacgacctccgccgcgggaagcccacctgccacgtcgtctacggggagcccatcgccgtgctcaccggcgacgcgctgctctccctctccttccaccacatggccaggttcgactcctaccctccggacatcgacgctgacaagcaccccgcccgcgtcgtccgcgccattggcgagctcgcgcgctgcataggctccgagggcctagtcgccggccaggttgttgatcttgagatgactggatcgaccgaaactgtacctcttgaacgtcttgagtacatccatctccacaaaactgctgcattgcttgaggcatcagtggttattggggcaatcttgggaggtggctctgatgagcagattgaaagtttgcgcatgtatgcgagatcgataggattgttgttccaggttgttgatgatatacttgatgtgaccaagtcttctgaggagctcggcaagacagcagggaaggacttggcgagtgacaagacgacatacccgaaattacttgggctggagaaatcacgggagtttgcagaaaagttgctttctgatgcaagggaacaactttcaggatttgatcaagagaccgcagcaccacttctgcacctggccaattatattgcctatcggcagaactgaggtgatgggtactccattgattattgttgatttgtaactttgtaagctcattaagattcagatttgaggaatatctgaattatcttgtgatacgtgctagttgtagtttcttatcttgagaagaatatctggttgacaaatgtcaatttcctagttagtcagtcaaaacggaataatgaaaatcagcctctctgccctataccccaattgcttgattcttgacaattgaacacatcatatcataaaggaagaaaatatcttcattgttttgattgattatcatagttcatgttcatacctgttttagtgtttatcctacgcaattgatttcgttttatgtgattgtatcaggttcgttttacaatgagtgtcaatgtaagctttgattcagggatgagcttgtcttggaaattgttctgttgaacatgtgtttcagtgatgttcttctgtttacagcaattgggatcaatgtttctctaacagctatatatatgtatattcttggttccaagcatgcagaaaacttcaatcagagaaagtgtttagttacagtgccgtagtaaataaatcggttataattgattcctgtctataggtgtgcattcagtcttttggtcaattcgctttgtagcaaaattcagttagtcaaaactcaggaatgaattgttattgggaaaaggcaagaccgaaattcggttaatcctgtctattgctcaaaaacctatacaagcctttcatagtgaatgtagcccctgcataaggtttcctgtacaggtacagtaggaccttgactaaatgtttttcattggaataatggaatggttataagctgcacctttcttgttcttttct

SEQ ID NO: 4356 - DNA, 1478 bp, Triticum aestivum
cggacgcgtgggtcgacggacgcgtgggtttgcccgcccggtgccgaagtttcccctctttgcttctacagataagagaaggcctcgcagcccacgggcggccatctccatcctctccgcccactccaccccgcactgaaaaaaccccgagagccatggcagcgttccaccccctggtcgcctcgcgcgtccgcctcgccaccccgctcctccccgccgccgcgcccgccgccgccgcggccggggtctccttccaccgccgccgcttctccgccatcgtcgccgcggcgaccgcccccgcggccaccgggttcgacttcaactcctacatgggggagcgggcggtggccgtgaacagcgccctggacgccgccgtcccggccggcgagccccccgcggcgctccacgacgcgatgcgctacgcgctgctggccgggggcaagcgcgtgcgcccggccctctgcctggccgcctgcgtcgtgtccggcggccgcgaggcctgggcgatggcccccgccgccgcggtcgagatggtgcacaccatgtcgctcgtgcacgacgacctcccctgcatggacgacgacgacctccgccgcggcaaggccacctgccacgtcgtgtacggcgagcccatcgccgtgctcgccggcgacgccctgctcgcgctcgccttcgagcacatggccagcgtcgactcctaccccccggacgtcgaccccgccaagcacaccgcccgcgtcgtccgcgccattggtgagctcgcgcgctgcatcggatcagagggcctcgtcgccggccaggttgttgatctggagatgactggctcaaccgagactgttccacttgaccgccttgagtacatccatctgcacaagactgctgcattgcttgaggcctcagtggttattggagcaatcatcgggggtggctcggaagagcagattgagcggttgcgcaagtacgcgagatcaattgggttgctgttccaggtggttgatgacattcttgatgtgaccaagtcatcagaggagctagggaagacagctgggaaggacttggcgagtgacaagacgacatacccaaagttactagggttggagaagtcacgggaatttgcggagaagttgctttctgatgcaaaggagcaacttgctgattttgataaagagaaggcagcaccgctattgtacttggccaattatattgcctatcggcagaactaaggtgatggttattctgttgtttgttgttgatctgtaactttgtaagaacatcaagtctgggatttgaggaatatctgaattcttcccctcatatatactagtttagttttctaccattgtgtcatgagaatatttaggtgacaaaagccacatgagttaggtggcaaataccaatgtcccattgagatagccaagactttataatgggaatcagcctttatgtcctatactgtctggatgataataaatcaattg

SEQ ID NO: 4357 - DNA, 1310 bp, Triticum aestivum
ttcgtgaaattattcgcttgcatggtgtgccaaatactattgtttcagatcgtgatactaaatttcttagccacttttgaagatgtttatgggctaagttggggactaaactgctttttagtactacttgtcaccccaaactgatggacaaactgaagtagtcaatagaacattgtccactatgcttagggctgttttgaagaataataagaaaatgtggcaggaatgcttgcctcatattgaatttgcttataatcattcattgcattctactactaagatgtgcccttttgaagttgtgtatgggttcctacctcgtacacctatggattggtggcctctttcatcttcggagaaggttaattttgatgctaaacaacgtgctgaatggattttaaaaatgcatgagttaactaaggaaaacattgagcgtatgaatgctaaatataaacttgctggagataagggtagaaaacatgttgtgtttgcacctggagatcttgtttggttacatttgcgtaaggatagatttcctgatttgcgcaaatcaaagttaatgccacgtgctgatggtccctttaaggtgttagagaaaataaatgataatgcatataaacttgagccgcctgcagattttgggggttgtcccacttttaacattgcagatttgaagccttattttggtgaggaagatgagcttccgatgaggacaacttcatttcaagaaggggaggatgataaggacatcaataccattgttacacccacagtccctgctgctatacatactggaccaattactagagctcgtgcacgccaattgaattaccaggtactttcgtttcttggtaatgattctaatgttcatgagaatatgatgctgcctaaattggatacatttgttttgcttacaaatgaagggcctagcttggagaaggatgaacattggagcaagaacaagcatggagatgatggcatgcgcaagggaaacaagaacggagttacaagtgatgatttcaggactttgaagccaccataatgagtgcatgaagccttggacgaaatatacaagatgccacttcataaatttcgtccagaggctattctaggtgttgcgtcaccttattattgggccaggcccatgtaatttcgaaatacataagtataggctatttttagagtccgtatgtgtggggaaacaaaagttagggttggtttcggacccctccatcaaggaccatgaaattccccctctctcctccatatatacaacccttagggcatcatttacgactttgggatttgtttag

SEQ ID NO: 4358 - DNA, 3809 bp, Brassica rapa
tgcacctagtactttcatgagactaatgaacgaagttttacgtgctttcattggacgatttgtggtagtctattttgatgatatactgatttatagcaaatctttggaagaacatttggaacatttacgtgctgtttttattgctctacgtgatgcacgtttgtttggtaaccttgggaagtgcaccttttgcaccgaccgagtatcttttcttggctatgttgttactccacagggaattgaagttgataaagccaagattgaagctattgagagttggccgcagcccaaaacggtcacacaagtgcggagttttcttggactcgctggtttctataggcgttttgtgagagatttccgaaccattgctgcaactcacaacgagcttacaaagaaggatgtgccttttgtttggggtaccgcacaggaagaagccttcacggtattgaaagataagttgacacatgctcctttactccaacttcctgattttaataagacttttgagcttgaatgtgatgctagtggcattggattaggaggtgtgttattacaagatggcaaacctgttgcatacttttctgaaaaattgagtgggcctagtctgaattattctacttatgataaagaactatatgctcttgttcggactttagaaacatggcaacattatttgtggcccaaagaatttgttatacattctgatcatgaatctttgaaacatattaaaagtcaagctaaactgaatcgtagacatgctaaatgggttgaattcattgaaactttcccttatgtcattaaacacaagaagggtaaagaaaatgttattgctgatgcattgtctcgtcgctatactatgctttcacaacttgacttcaaaatatttggtttggagaccatcaaagatcaatatgtgcatgatgctgattttaaagatgtattgcagaattgtaaagaaggaagaacctggaacaagtttgtcgttaatgatggatttgtgttccgtgctaacaagctatgcattccagctagctctcttcgtcttttgttgttgcaggaggcgcatggaggaggattaatgggacactttggcgtgaagaagacggaggacgtacttgctacacatttcttttggccaaagatgagacgggatgttgagcgttttgttgctcgctgcactacatgtcaaaaagctaagtcacgactcaatcctcatggtttatatatgcctttgcctgtacctagtgttccttgggaggatatatctatggactttgttttaggtttacctcgaacaaagaaggggagggatagcatatttgttgtcgtggatagattctcgaaaatggcacactttataccatgtcataaaagcgatgatgctgttaatgttgctgatttgttctttcatgaaattattcacttgcatggtgtgccaaatactattgttttagatcgtgatactaagtttcttagccacttttggagatgtttatgggctaagttggggactaaactgctttttagtactacttgtcacccccaaactgatggacaaactgaagtagtcaatagaacattgtctactatgcttagggctgttttgaagaataataagaaaatgtgggaagaatgcttgcctcatattgaatttgcttataatcgttcgttgcattctactactaagatgtgcccttttgaaattgtgtatggtttcctacctcgtgcacctattgatttgttgcctcttccatctccggagaaggttaattttgatgctaaacaacgtgctgaattgatcttaaaaatgcatgagttaactaaggaaaacattgagcgtatgaatgctaaatataaacttgctggagataagggtagaaaacatgttgtgtttgcacctggagatcttgtttggttacatttgcgtaaggatagatttcctgatttgcgcaaatcaaagctaatgccacgtgctgatggtccttttaaggtgttagagaaaataaatgataatgcatataaacttgagctgcctgcagattttggggttagtcccacttttaacattgcagatttgaagccttatttgggtgaggaagatgagcttccgtcgaggacgacttcatttcaagaaggggaggatgatgaggacatcaataccattgttacacccacagcccctgctgctatacatactggaccaattactagagctcgcgcacgccaattaaattaccaggtactttcgtttcttggtaatgattctaatgttcatgagaatatgatgctgcctaaattggatacatttgttttgcttacaaatgaagggcctagctttgagaaggatgaacattggagcaagaacaagcatggagatgatggcatgcgcatggggaacaagaacggagttacaagtgatgatttcaggacgtgatttcagaacgttgaagccaccataatgagtgcatgaagccttggacgaaatatacaagatgctacttcataactttcgtccagaggctattctaggtgctgcgtcaccttattattgggccaggcccatgtaatttcgaaatacataagtataggctgtttttagagtccgtatgtgtggggaaacaagagaggttggtttcggaccccaccctcaagggccacgaaattcgcccctcttcctccatatatacagcccttagggcgtcgtttagactttgggttttgtttagattaaaagttcgccatagctgcaacttcgcgtacttcgtttgtgttcagcgaccagacaaaggcgtcacagaaccccaccttgatcaataaagctttcatcttatattcgcaatatccagattgcaatctcagtttcttgcttgttcttcgtttgctcgcaggaaacagaccctcgtggtcaggttgatcgtgctccggcgtggtcgctcggcgttggtttagcgattgctaaggcgcgacgtcctcgcacgttcgtagtcggatcgtcaaagtcgacttccatcaaagcgatattcatcatctcatcgaaagacgggacacctttgcctctatcaagtggtatcagatttccaggttgctcggtgagattttacagtttttcgtagtttagatcgagtctgttcttcatacctatagtccacgaaaaagccacaaaaaaaatttagggttagttcatcatatccgaaccaatctgagcctttgcataatctttttagggtttttgctttgttgaatttgcggttgcatcgtcgtgtcaagttgctggtcttagagtctagtcttttagagtttcgagttctggtcataagttgtcacgccgccgccgcaccatcatcatcgccttgccatctaccaccattgcttatccgccaccgctctgaatccgtatccatataccaccaccaatccgtatccatataccaccaccgctgccatatcctaccaccatatatccaccaccaatccgagttcttttcatagtcggtttgttttagagatccatatattttccgtttcgtgtttccttgcctgagtaggtctcggaaaaaaaaaaaaaagagtctggagacccccgggcagtttttaggccaaaatttcggcaaccaaaaatattttttccctatcctatttttaggtcccggggagtgttttgagacactcgccatcatagtgattttttgtcgcactttttcgtcgtcgctgccctgatttccgaaaaaaaaaatagtcaaaaaattttgtgcccatcctgtcagtttgacctgggaagagttttgagacactcgccattatagtgattt

SEQ ID NO: 4359 - DNA, 3309 bp, Brassica rapa
acctagtactttcatgagactaatgaacgaagttttacgtgctttcattggacgatttgtggtagtctattttgatgatatactgatttatagcaaatctttggaagaacatttggaacatttacgtgctgtttttattgctctacgtgatgcacgtttgtttggtaaccttgggaagtgcaccttttgcaccgaccgagtatcttttcttggctatgttgttactccacagggaattgaagttgataaagccaagattgaagctattgagagttggccgcagcccaaaacggtcacacaagtgcggagttttcttggactcgctggtttctataggcgttttgtgagagatttccgaaccattgctgcaactcacaacgagcttacaaagaaggatgtgccttttgtttggggtaccgcacaggaagaagccttcacggtattgaaagataagttgacacatgctcctttactccaacttcctgattttaataagacttttgagcttgaatgtgatgctagtggcattggattaggaggtgtgttattacaagatggcaaacctgttgcatacttttctgaaaaattgagtgggcctagtctgaattattctacttatgataaagaactatatgctcttgttcggactttagaaacatggcaacattatttgtggcccaaagaatttgttatacattctgatcatgaatctttgaaacatattaaaagtcaagctaaactgaatcgtagacatgctaaatgggttgaattcattgaaactttcccttatgtcattaaacacaagaagggtaaagaaaatgttattgctgatgcattgtctcgtcgctatactatgctttcacaacttgacttcaaaatatttggtttggagaccatcaaagatcaatatgtgcatgatgctgattttaaagatgtattgcagaattgtaaagaaggaagaacctggaacaagtttgtcgttaatgatggatttgtgttccgtgctaacaagctatgcattccagctagctctcttcgtcttttgttgttgcaggaggcgcatggaggaggattaatgggacactttggcgtgaagaagacggaggacgtacttgctacacatttcttttggccaaagatgagacgggatgttgagcgttttgttgctcgctgcactacatgtcaaaaagctaagtcacgactcaatcctcatggtttatatatgctaagtttcttagccacttttggagatgtttatgggctaagttggggactaaactgctttttagtactacttgtcacccccaaactgatggacaaactgaagtagtcaatagaacattgtctactatgcttagggctgttttgaagaataataagaaaatgtgggaagaatgcttgcctcatattgaatttgcttataatcgttcgttgcattctactactaagatgtgcccttttgaaattgtgtatggtttcctacctcgtgcacctattgatttgttgcctcttccatctccggagaaggttaattttgatgctaaacaacgtgctgaattgatcttaaaaatgcatgagttaactaaggaaaacattgagcgtatgaatgctaaatataaacttgctggagataagggtagaaaacatgttgtgtttgcacctggagatcttgtttggttacatttgcgtaaggatagatttcctgatttgcgcaaatcaaagctaatgccacgtgctgatggtccttttaaggtgttagagaaaataaatgataatgcatataaacttgagctgcctgcagattttggggttagtcccacttttaacattgcagatttgaagccttatttgggtgaggaagatgagcttccgtcgaggacgacttcatttcaagaaggggaggatgatgaggacatcaataccattgttacacccacagcccctgctgctatacatactggaccaattactagagctcgcgcacgccaattaaattaccaggtactttcgtttcttggtaatgattctaatgttcatgagaatatgatgctgcctaaattggatacatttgttttgcttacaaatgaagggcctagctttgagaaggatgaacattggagcaagaacaagcatggagatgatggcatgcgcatggggaacaagaacggagttacaagtgatgatttcaggacgtgatttcagaacgttgaagccaccataatgagtgcatgaagccttggacgaaatatacaagatgctacttcataactttcgtccagaggctattctaggtgctgcgtcaccttattattgggccaggcccatgtaatttcgaaatacataagtataggctgtttttagagtccgtatgtgtggggaaacaagagaggttggtttcggaccccaccctcaagggccacgaaattcgcccctcttcctccatatatacagcccttagggcgtcgtttagactttgggttttgtttagattaaaagttcgccatagctgcaacttcgcgtacttcgtttgtgttcagcgaccagacaaaggcgtcacagaaccccaccttgatcaataaagctttcatcttatattcgcaatatccagattgcaatctcagtttcttgcttgttcttcgtttgctcgcaggaaacagaccctcgtggtcaggttgatcgtgctccggcgtggtcgctcggcgttggtttagcgattgctaaggcgcgacgtcctcgcacgttcgtagtcggatcgtcaaagtcgacttccatcaaagcgatattcatcatctcatcgaaagacgggacacctttgcctctatcaagtggtatcagatttccaggttgctcggtgagattttacagtttttcgtagtttagatcgagtctgttcttcatacctatagtccacgaaaaagccacaaaaaaaatttagggttagttcatcatatccgaaccaatctgagcctttgcataatctttttagggtttttgctttgttgaatttgcggttgcatcgtcgtgtcaagttgctggtcttagagtctagtcttttagagtttcgagttctggtcataagttgtcacgccgccgccgcaccatcatcatcgccttgccatctaccaccattgcttatccgccaccgctctgaatccgtatccatataccaccaccaatccgtatccatataccaccaccgctgccatatcctaccaccatatatccaccaccaatccgagttcttttcatagtcggtttgttttagagatccatatattttccgtttcgtgtttccttgcctgagtaggt

SEQ ID NO: 4360 - DNA, 744 bp, Secale cereale
agccacacagagacagagcgtccaagctccagctagctagccaacaatggccgccgcactgagcctccgcgcgcccttctccctgcgcgccgtcgcgccaccggcgccccgcgtggccctcgcgcccgcggccctcagcctggccgccgccaagcaggtgcggggagccaggctccgcgcgcaggcgacgtacaaggtgaagctggtgacacccgagggcgaggtggagctggaggtccccgacgacgtctacatcctcgaccaggccgaggaggaggggatcgacctgccctactcctgccgcgccggctcctgctcctcctgcgccggcaagttggtgtccggcgagatcgaccagtccgaccagagcttcctcgacgacgaccagatggaggcagggtgggtgctcacctgccacgcctaccccaagtccgacatcgtcatcgagacccacaaagaggaggagctcaccgcataagctgctatacctatctctctttgcaagaggatcgagctgatatcatattatctccttctgtatcatgcatgcatgcgtggacatcgccagatgcaccgattgttttgtgctcgaatgaattgctcgatgcatggtttgctcaagtaataatgtcttcgaattactacctttttgtaccgtaagatatactactgtcgtaatactagcgtgtacgtaactcgacgtactgaaatgaatcctgatggctgaggtgtctctctgatcaa

SEQ ID NO: 4361 - DNA, 781 bp, Pseudoroegneria spicata
cgcctatcctctccagctcctcagccacacacagagaaagagcgtaccagctccagctagctagcttgcaatggccgccgcactgagcctccgcgcgcccttctccctgcgcgccgtggcgccaccggcgccccgcgtggccctcgcgcccgcggccctcagcctcgccgccgccaagcaggtgcggggagccaggctccgcgcgcaggcgacgtacaaggtgaagctggtgacgcccgagggcgaggtggagctggaggtccccgacgacgtctacatcctggaccaggccgaggaggaggggatcgacctgccctactcctgccgcgccggctcctgctcctcctgcgccggcaagttggtgtccggcgagatcgaccagtccgaccagagcttcctcgacgacgaccagatggaggcagggtgggtgctcacctgccacgcctaccccaagtctgacatcgtcatcgagacccacaaggaggaggagctcaccgcataagctgctatacctatctctctttgcaagaggatcgagctgataccatattatctcctgtcatgcatgcatggacatcgccggatacaccgatttgtttgtgctcgaatgaattgctcgatgcatggtttgctcaagtaataatgtcttcaaattacctttttgtaccgtaagatatactactctcgtaatactagtgtgtacgtaactcaacgtactgaaatgaatcctgatggctgaagtgtctctctgattaataatatcttctttttacttaagata

SEQ ID NO: 4362 - DNA, 795 bp, Secale cereale
ctttacttattcccgcccccctcactcctccatcccctagctcgctcgcctatcctctccagctcctcagccacacagagacagagcgtccaagctccagctagctagccaacaatggccgccgcactgagcctccgcgcgcccttctccctgcgcaccgtcgcgccaccggcgccccgcgtggccctggcgcccgcggccctcagcctcgccgccgccaagcaggtgcggggagccaggctccgcgcgcaggcgacgtacaaggtgaagctggtgacgcccgagggcgaggtggagctggaggtccccgacgacgtctacatcctcgaccaggccgaggaggaggggatcgacctgccctactcctgccgcgccggctcctgctcctcctgcgccggcaagttggtgtccggcgagatcgaccagtccgaccagagcttcctcgacgacgaccagatggaggcagggtgggtgctcacctgccacgcctaccccaagtccgacatcgtcatcgagacccacaaagaggaggagctcaccgcataagctgctatacctatctctctttgcaagaggatcgagctgatatcatattatctccttctgtatcatgcatgcatgcgtggacatcgccagatacaccgattgttttgtgctcgaatgaattgctcgatgcatggtttgctcaagtaataatgtcttcgaattactacctttttgtaccgtaagatatactactgtcgtaatactagcgtgtacgtaactcgacgtactgaaatgaatcctgatggctga

SEQ ID NO: 4363 - DNA, 760 bp, Leymus cinereus x Leymus triticoides
gcacgagggccacacacagagagagcatcccagctccagctagctagctagcaatggccgccgcactcagcctccgcgcgcccttctccctgcgcgccgtcgcgccaccggcgccccgtgtggccctcgcgccggcggctctcagcctcaccgccgccaagcaggtgcggggagccaggctccgcgcgcaggcgacgtacaaggtgaagctggtgacgcccgagggcgaggtggagctggaggtccccgatgacgtctacatcctcgaccaggccgaggaggaggggatcgacctgccctactcctgccgcgccggctcctgctcctcctgcgccggcaagttggtgtccggcgagatcgaccagtccgaccagagcttcctcgacgacgaccagatggaggcagggtgggtgctcacctgccacgcctaccccaagtccgacatcgtcatcgagacccacaaggaggaggagctcaccgcataagctgctacctatctctctttgcaacaagaagatcgagctgatatcatattatctcctatcatgcatgcatggacatcgccagatacaccgatttgtttgtgctcgaatgaattgctcgatgcatggtttgctcaagtaataatgtcttcgaattacctttttgtaccgtaagatatgctactgtcgtaatactagcgtgtacgtaattcaacgtactgaaatgaatcctgatggctgaggtgtctctctgattaataatatcttctttttaatta

SEQ ID NO: 4364 - DNA, 722 bp, Secale cereale
  misc_feature (193)..(193): n is a, c, g, or t
  misc_feature (719)..(719): n is a, c, g, or t
agagagagagagacagctcctcagccacacagagacagagcgtccaagctccagctagctagccaacaatggccgccgcactgagcctccgcgcgcccttctccctgcgcaccgtcgcgccaccggcgccccgcgtggccctggcgcccgcggccctcagcctcgccgccgccaagcaggtgcggggagccangctccgcgcgcaggcgacgtacaaggtgaagctggtgacgcccgagggcgaggtggagctggaggtccccgacgacgtctacatcctcgaccaggccgaggaggaggggatcgacctgccctactcctgccgcgccggctcctgctcctcctgcgccggcaagttggtgtccggcgagatcgaccagtccgaccagagcttcctcgacgacgaccagatggaggcagggtgggtgctcacctgccacgcctaccccaagtccgacatcgtcatcgagacccacaaagaggaggagctcaccgcataagctgctatacctatctctctttgcaagaggatcgagctgatatcatattatctccttctgtatcatgcatgcatgcgtggacatcgccagatacaccgattgttttgtgctcgaatgaattgctcgatgcatggtttgctcaagtaataatgtcttcgaattactaccttcctgtaccgtaagatatactactgtcgtaatactagcgtgtacgtaacncga

SEQ ID NO: 4365 - DNA, 764 bp, Avena sativa
cacccaggagctcaggtagttagcatcaatggccaccgcactgagcagcctccgcgcgcccttctccctgcgcgccgccgccccaccggcgccccgcgtggccctcgcgccggcggctctcggcctcaccgccgccaagcaggtgcggggagccagcctccgcgcgcaggcgacgtacaaggtgaagctgatcacgcccgagggcgaggtggaactggaggtccccgacgacgtctacatcctcgaccaggccgaggaggagggcatcgacctgccgtactcctgcagggccgggtcatgctcatcgtgcgccggcaagctcgtgtccgggtcgctggaccagtccgaccagagcttcctcgacgacgagcagatggaggcagggtgggtgctcacctgccacgcctaccccacgtccgacctcgtcatcgagacccacaaggaggaggagctcaccgcataaattgactatatattatctcttatcatgtcatgcatcaccagcggtttgtttgtgcttgaatgaattgctccatgcatgatttgctcaagtaatgatatcgtcaaatcgaagtacgtaccttttttgtaccgtaagatatactgtgagatactggagtactagtagtatattctacgtatctcaacgtgattgtaagagacccatgaatgttggtcccttgaaatagtaatgcatatgctcacattgatgaaatatctgtgatactgataataggtgctatatgagcctatcttagttgcca

SEQ ID NO: 4366 - DNA, 899 bp, Avena sativa
tcctccacaccacacacccagcagctcaggtagttagcaacaatggccaccgcactgagcagcctccgcgcgcccttctccctgcgcgccgccgccccaccggcgccccgcgtggccctcgcgccggcggctctcggcctcaccgccgccaagcaggtgcggggagccagcctccgcgcgcaggcgacgtacaaggtgaagctgatcacccccgagggcgaggtggaactggaggtccccgacgacgtctacatcctcgaccaggccgaggaggaaggcatcgacctgccgtactcctgcagggccgggtcatgctcatcgtgcgccggcaagctggtgtccgggtcgctggaccagtccgaccagagcttcctcgacgacgagcagatggaggcggggtgggtgctcacctgccacgcctaccccacgtccgacctcgtcatcgagacccacaaggaggaggagctcaccgcataaattgactatatattatctcttatcatgtcatgcatacacctgcgatttgtttctgcttgaatgaattgctccatgcatgcatgatttgctcaagtaataatatcgtcaagtcgaagtacctttttttgtaccgtaagatatactgtcaaatgctactgtagtatattgtacgcatctcaacgtgattgtaagagacccatgaatgttggtctcttgaaatagtaatgcatatgctcacattgatgaatatctgtgatactgataataggtgctatatgagcctatcttagttggtaactgccacccgggctcaagcgggcctagattttgcatgcatggcatttttctggatttgtccatgacttggttgatctcaagatttgccagctcagtctcagggaagtgtacatgttccggcatga

SEQ ID NO: 4367 - DNA, 892 bp, Avena sativa
caccacacacccagcagctcaggtagttagcaacaatggccaccgcactgagcagcctccgcgcgcccttctccctgcgcgccgccgccccaccggcgccccgcgtggccctcgcgccggcggctctcggcctcaccgccgccaagcaggtgcggggagccagcctccgcgcgcaggcgacgtacaaggtgaagctgatcacccccgagggcgaggtggaactggaggtccccgacgacgtctacatcctcgaccaggccgaggaggaaggcatcgacctgccgtactcctgcagggccgggtcatgctcatcgtgcgccggcaagctggtgtccgggtcgctggaccagtccgaccagagcttcctcgacgacgagcagatggaggcggggtgggtgctcacctgccacgcctaccccacgtccgacctcgtcatcgagacccacaaggaggaggagctcaccgcataaattgactatatattatctcttatcatgtcatgcatacacctgcgatttgtttctgcttgaatgaattgctccatgcatgcatgatttgctcaagtaataatatcgtcaagtcgaagtacctttttttgtaccgtaagatatactgtcaaatgctactgtagtatattgtacgcatctcaacgtgattgtaagagacccatgaatgttggtctcttgaaatagtaatgcatatgctcacattgatgaatatctgtgatactgataataggtgctatatgagcctatcttagttggtaactgccacccgggctcaagcgggcctagattttgcatgcatggcatttttctggatttgtccatgacttggttgatctcaagatttgccagctcagtctcagggaagtgtacatgttccggcatga

SEQ ID NO: 4368 - DNA, 749 bp, Festuca arundinacea
ggcacgaggcccgccctcctcactcctccatcccctagatcacctatccgacctccatagccacacacacgctagctagctcttctccccgagcagcagcaatggccaccgcactgagcagcctccgcgcgcccttctccctgcgcgccgcctccccaccggcgccccgcgtggccctcgcgccggcgaatctcgctctcgccgccgccaagcaggtgcggggagccaggctccgcgcgcaggcgacctacaaggtgaagctgatcacgcccgagggcgaggtggagctggaggtccccgacgacgtctacatcctcgaccaggccgaggaggagggcatcgacctgccctactcctgcagggccgggtcatgctcgtcctgcgccggcaagctggtgtcgggatcgctggaccagtccgaccagagcttcctcgacgacgagcagatggaggaggggtgggtgctcacctgccacgcctaccccacgtccgacctcgtcatcgagacccacaaggaggaggagctcaccgcctaagttgattatatatcatgcgtacttgacatcaccagcgatctgttagtgcttgaatgaattgctcgatgcatgcatgatgatttgctcgatgcatgcatgatgatttgctctcaagtgataatatggtcgtggaattacgtaccttttttgtaccgtaagatatactactgtcaaatactagtatatgcaagtacgtaactcaacgtactgaaa

SEQ ID NO: 4369 - DNA, 906 bp, Lolium multiflorum
ccgacctccatagccacacacgctagctagctcttcccatctcatctccccgagcagcagctagcaatggccaccgcactgagcagcctccgcgcgcccttctccctgcgcgccgccgccccaccggcgccccgcgtggccctcgcgccggcgaacctcgccctcaccgccgccaagcaggtgcggggagccaggctccgcgcgcaggccacctacaaggtgaagctgatcacgcccgagggcgaggtggagctggaggtccccgacgacgtctacatcctcgaccaggccgaggaggagggcatcgacctgccatactcctgcagggccgggtcctgctcgtcctgcgccggcaagctggtgtccgggtcgctggaccagtccgaccagagcttcctcgacgacgagcagatggaggagggctgggtgctcacctgccacgcctaccccacgtccgacctcgtcatcgagacccacaaggaggaggagctcaccgcctaagctgattatataccatctctcttgtcatgcgtacatgggcatcgccaccgatttgttagtgcttgaatgaattgcgtgatgatttgctcaagtggtgatatggtcgtcgaattacctatacctttttgtacgcgggggtcccatctccctccctctcgcgtgagctccaccagcaaaagcgaccacataaaagaccagcaataaactttgatctgttcggtgccggtcaaacctcaacaaccaagtttcatgtctgatctcgacgtcacacttccatctgccttcgatccgtttgccgaggcaaatgctgaggatgctggtgcaggccctggagcaaaagattatgtgcatgtgcgcatccagcagcgcaacggcaggaagagtctgactactgttcagggcttg

SEQ ID NO: 4370 - DNA, 700 bp, Secale cereale
cgaaagaggcgaaaacctgattcgctaccgacctgacctcgccgccgttctccgattccccgctcgcctgctctgctctgctccgccgcctctctggaaaaaaaagacaggtagtactgaataatagacaaggatggcttctactggcgtgaaagatttctaccggcagaagaagaaaggaggtgtcggcaaaacttcagcatcttctaagaagaaaacacagaattacactggaggggcctctgttggggcttcaaataaggctcagacagcagcactaatttctcacggatccatagacctcaaagatgatttcagtgagcaagaggagcagctgcggcagtttgacatggacatgaagtttggcccgtgcatcggtgtcaaccggcttcagcgctgggagcgtgcatccgccatgggcctccagccgccgccccaccttcgtgatctcctagcgcgcgcctcctctggaaacaaccgcaacaacggcggcccctcccctgagtgcctctgggagggtaagatctagaatgaaatttcttccaccacaagtgcaacctagcacggcttgcctactgtttgtgaccaggtagttttagtccgagactctgagaccgttttaccgcgcgaaactctcgctgttgtaccgaatccttgtctgttttccttatcagatgttgctacttacactcttgccagt

SEQ ID NO: 4371 - DNA, 888 bp, Secale cereale
tggaaaagaaaacgaaagaggcgaaaacctgattcgctcccgacctgacctcgccgccgttctccgattccccgctcgcctgctctgctctgctccgccgcctctctggaaaaaaaaagacaggtagtactgaataataggcaaggatggcttccactggcgtgaaagatttctaccggcagaagaagaaaggaggtgtcggcaaaacttcagcatcttctaagaagaaaacacagaattacactggaggggcctctgttggggcctcaaataaggctcagacagcagcactaatttctcacggatccttagacctcaaagatgatttcagtgagcaagaggagcagctgcggcagtttgacatggacatgaagtttggcccatgcatcggtgtcaaccggcttcagcgctgggagcgtgcttccgccatgggcctccagccaccgccccaccttcgtgatctcctagcgggcgcctcctctggaaacaaccgcaacaacggcagcccctcccctgagtgcctctgggagggtaagatctagaatgaaatttcttccaccacaagtgcaacctagcatggcttgcctactgtttgtgaccaggtagtttagtccgagactctgagaccgttttaccgcgcgaaactctcgctgttgtaccgaatccttgtctgttttccttatcagatgttgctacttacactcttgccagtgttatcttcagtttaccccgcgcgagttgcttaccttttatttttttacaaaaaaaaaaaaaacaaaaaaaaaacaaaaaaaaaacaaaaaaaaaacaaaaaaaaaaaaaaaaaaaaaacaaaacaaaaaaaaaaacacacacacacacacacacacacacacacacacacacgac

SEQ ID NO: 4372 - DNA, 664 bp, Secale cereale
ctccgattccccgctcgcctgctctgctctgctccgccgcctctctgtttctgttggcttttacaggaaaaaaaagacaggtagtactgaataatagacaaggatggcttctactggcgtgaaagatttctaccggcagaagaagaacggaggtgtcggcaaaacttcagcatcttctaagaagaaaacacagaattacactggaggggcctctgttggggcctcaaataaggctcagacagcagcactaatttctcacggatccatagacctcaaagatgatttcagtgagcaagaggagcagctgcggcagtttgacatggacatgaagtttggcccgtgcatcggtgtcaaccggcttcagcgctgggagcgtgcttccgccatgggcctccagccaccgcctcaccttcgtgatctcctagcgggcgcctcctctggaaacaaccgcaacaacggcggcccctcccctgagtgcctctgggagggtaagatctagaatgaaatttcttccaccacaagtgcaacctagcacggcttgcctactgtttgtgaccaggtagtttagcccgagactctgagaccgttttacgggcgaaactctcgctgttgtaccgaatccttgtctgttttccttatcagatgttgctactttcactcagtc

SEQ ID NO: 4373 - DNA, 777 bp, Hordeum vulgare
cgcgaaagaggcgaagacctgattcgctaccgacctgacctcgccgccgttctccggctctccgctcgctccgctccgctccgccgcctcccctggaaaacacaggtaggactgaataatagacaagaatggcttctactggcgtgaaagatttctaccggcagaagaagaaaggaggtgccggcaaaacttcagcatcttctaagaagaaaccacagaattatactggaggggcctctgttggggcctcgaataaggctcagacagcagcactaatttctcacggatcctttgacctcaaagatgatttcagtgagcaagaggagcagctgcggcagtttgacatggacatgaagtttggcccatgcatcggtgtgaacaggcttcagcgctgggagcgtgcttccgccatgggcctccagccaccgccccaccttcgtgatctcctagcgcgcgccgcctctggaaacaaccgcaacaacggcggcccctcccctgagtgcctctgggagggtaagatctagaatcaaatcactttagtgacaagtgttccatggcaacctagcacgacttgcctactgtagcatgagacttctgagaccattttaccaggcggaactcttgctgttgtactgaatccttgtctgtttttccttgtcagttcgttgctactctaactcttgccagtgttatctccagttcaccccgcgtgagctgcttacctcttttttttcttttcttcaaaagtactccttttttgagaggatttaatggaca

SEQ ID NO: 4374 - DNA, 797 bp, Pseudoroegneria spicata
taagatgggtcgttagtgttcgggaatcaggacttggctatgtatgacctatgaacaaacattgaacagtttctgatgttgccatgttcacattgtacttattatagctcatagcattctttctgatgaaatgaataaaatgcaaatgaaacccaaaagctacagcagaagtgattttaagtttctgttggggggctttgacaggaaaacacaggcagaactgaataatagaacaagaatggcttctactggcgtgaaagatttctaccggcagaagaagaaaggaggtgcaggcaaaacttcagcatcttctaagaagaaaacacagaattacactggaggggcctctgttggggcctcgaataaggctcagacagcagcactaatttctcacggatccatagacctcaaagatgatttcaatgagcaagaggagcagctgaggcagtttgacatggacatgaagttcgggccgtgcatcggtgtcaaccggcttcagcgctgggagcgtgcttccgccatgggcctccagccaccaccccaccttcgggatctgctaatgtgcgcctcctctggaaacaaccgcaacaacggtggcccctcacctgagtgcctctgggagggtaagatctagaatcaaatttcttccaccacaagtgcaacctagcgcggcttgcctactgtttgtgaccaggtagtttagtccgagactcgagactgttttaccgcccggaactcttgctgttgtaccgaatccttgcctgttttccttgtcagatgttgctaccttcactcca

SEQ ID NO: 4375 - DNA, 779 bp, Avena sativa
gaaagaagggaagaaccgattcactacgacctcgccgccgttctccgcttctccgctcgcttctccgccgccgccgccgccgccgccgcctcacgtggaaacataagaaactgaatagtagacaacaatggcttctactggcgtgaaagatttctaccgtcagaagaagaaaggaggtgtcgccaaaacttcaacatcttctaagaagaaaacacagcagtacactggaggggcctctgttggggccggaaatcctgctcagacagcagcactaatctctcacggatccttggacctcaaagacgacttcagtgagcaagaggagcagctgcggcagtttgacctggacatgaagtttggcccatgcattggcgttaaccggcttcagcgctgggagcgtgcttctgccatgggcctccagccaccgcctcatcttcgggatctcttacgcgggcctcatcagctaacaatcgcaataatggcgctccctcccccgagtgcctgtgggagggcaaaatctagaaccggatttcctctacagcaggtgatccatccaatagcaagctatccatgttgccatcatcatcatctgcggagggtccccttggccctgcttcttagctgctgggaccctggtagtttagtcgagactctttattagtgcaagaactcttggttgctgttgttgttgttgtaccaaaccttcttcgttcttcttatcttcttatcgtcagatgttgctactttcatatgctgacagttagttccgtatgctaaga

SEQ ID NO: 4376 - DNA, 636 bp, Avena sativa
tgaaagatttctaccgtcagaagaagaaaggaggtgtcgccaaaacttcaacatcttctaagaagaaaacacagcagtacactggaggggcctctgttggggccggaaatcctgctcagacagcagcactaatctctcacggatccttggacctcaaagacgacttcagtgagcaagaggagcagctgcggcagtttgacctggacatgaagtttggcccatgcattggcgttaaccggcttcagcgctgggagcgtgcttctgccatgggcctccagccaccgcctcatcttcgggatctcttacgcgggcctcatcagctaacaatcgcaataatggcgctccctcccccgagtgcctgtgggagggcaaaatctagaaccggatttcctctacagcaggtgatccatccaatagcaagctatccatgttgccatcatcatcatctgcggagggtccccttggccctgcttcttagctgctgggaccctggtagtttagtcgagactctttattagtgcaagaactcttggttgctgttgttgttgttgtaccaaaccttcttcgttcttcttatcttcttatcgtcagatgttgctactttcatatgctgacagttagttccgtatgctaaga

SEQ ID NO: 4377 - DNA, 947 bp, Brachypodium distachyon
gcggctcctgctcatctagacgacgagttggtttggttggacgtttggactctggacttgaccagacaccggaacccgtttcagcgcacagtcgctctccaccgagttttctctccgatccccttccttctcgcctgcgacaccggcggaatcaccacgcggaggaggagttccggcagccggcgctccgaccaacgaaaacacaggtggaactgaagaatagataagtatggcttctagtggtgtgaaagatttctaccggcagaaaaagaaaggtggtataaccaaaacttcatcatgttctaagaagaaaacacagcagtacactggaggggcctccgttggcgcttcgaatcctgctcagacatcagcactaatttctcatggatccttagatctcaaagatgatatcagtgagcaggaggagcagttgcggcagtttgacatggacatgaagttcggcccatgtattggtgtcaatcggcttcagcgttgggagcgcgcttctgccatgggcctccagccaccatctcatcttcgggacctcttggcacacagcgcttccatgaacaatcacaataatggtagcccctcccctgagtgcctatgggagggtaaaatctagaatcaaataaaaagtgatccatatcatatcaacctagccttgtttacttactcctttctccccgggcccagctacctgagtcttcttgcccctctctactgcttcgtaggtcgtagctgggacatggggcctattagtgtagtcgaaactcatactctttcactgtggtgaactcttgttgtaaccaaccttctcgtttttctttgatagactgttgctgctttcattttttgccagtgtatcttcagtttaccctgcgcaagttgtttatgccatttccgcacggatgtactccaattgatattcctgtttccgtttgaat

SEQ ID NO: 4378 - DNA, 976 bp, Brachypodium distachyon
ggaagcggctcctgctcatctagacgacgagttggtttggttggacgtttggactctggacttgaccagacaccggaacccgtttcagcgcacagtcgctctccaccgagttttctctccgatccccttccttctcgcctgcgacaccggcggaatcaccacgcggaggaggagttccggcagccggcgctccgaccaacgaaaacacaggtggaactgaagaatagataagtatggcttctagtggtgtgaaagatttctaccggcagaaaaagaaaggtggtataaccaaaacttcatcatgttctaagaagaaaacacagcagtacactggaggggcctccgttggcgcttcgaatcctgctcagacatcagcactaatttctcatggatccttagatctcaaagatgatatcagtgagcaggaggagcagttgcggcagtttgacatggacatgaagttcggcccatgtattggtgtcaatcggcttcagcgttgggagcgcgcttctgccatgggcctccagccaccatctcatcttcgggacctcttggcacacagcgcttccatgaacaatcacaataatggtagcccctcccctgagtgcctatgggagggtaaaatctagaatcaaataaaaagtgatccatatcatatcaacctagccttgtttacttactcctttctccccgggcccagctacctgagtcttcttgcccctctctactgcttcgtaggtcgtagctgggacatggggcctattagtgtagtcgaaactcatactctttcactgtggtgaactcttgttgtaaccaaccttctcgtttttctttgatagactgttgctgctttcattttttgccagtgtatcttcagtttaccctgcgcaagttgtttatgccatttccgcacggatgtactccaattgatattcctgtttccgtttgaatgttcatttggtacagttagtactta

SEQ ID NO: 4379 - DNA, 545 bp, Secale cereale
  misc_feature (55)..(55): n is a, c, g, or t
  misc_feature (60)..(60): n is a, c, g, or t
  misc_feature (316)..(316): n is a, c, g, or t
  misc_feature (319)..(319): n is a, c, g, or t
  misc_feature (330)..(330): n is a, c, g, or t
  misc_feature (334)..(334): n is a, c, g, or t
  misc_feature (346)..(346): n is a, c, g, or t
  misc_feature (353)..(353): n is a, c, g, or t
  misc_feature (361)..(361): n is a, c, g, or t
  misc_feature (367)..(368): n is a, c, g, or t
  misc_feature (380)..(381): n is a, c, g, or t
  misc_feature (404)..(404): n is a, c, g, or t
  misc_feature (415)..(415): n is a, c, g, or t
  misc_feature (422)..(422): n is a, c, g, or t
  misc_feature (425)..(425): n is a, c, g, or t
  misc_feature (442)..(442): n is a, c, g, or t
  misc_feature (469)..(469): n is a, c, g, or t
  misc_feature (500)..(500): n is a, c, g, or t
  misc_feature (504)..(504): n is a, c, g, or t
  misc_feature (510)..(510): n is a, c, g, or t
  misc_feature (535)..(535): n is a, c, g, or t
ttcgctcccgacctgacctcgccgccgttctccgattccccgctcgcctgctctnctctntccgccgcctctctggaaaaaaaaagacaggtagtactgaataataggcaaggatggcttccactggcgtgaaagatttctaccggcagaagaagaaaggaggtgtcggcaaaaacttcagcatcttctaagaagaaaacacagaattacactggaggggcctctgttggggcctcaaataaggctcagacagcagcactaatttctcacggatccttagacctcaaagatgatttcagtgagcaagaggagcagntgnggcagtttganatgnaaatgaagtttngcccatncatcggtntcaacnngcttcagcgctnngagcgtgcttccgccatgggccnccagccaccgncccaccntcntaatatcctagcgggcncctcccctggaaacaaccgaaacaacngcagcccctcccctgagtgcctctgggaggntaanatctanaatgaaatttcttccaccacaagtncaacctagca

SEQ ID NO: 4380 - DNA, 679 bp, Cynodon dactylon
aggcattgacaggtagacaccggtagctgtgaagaattgataaacatggcatctagtggtgtgaaagatttttaccggcagaaaaagaaaggcagtgtgtccaaagagtcaacatcttccaagaagaaaacacagcaatacactggaggggcctctgttggtgccttagataccgctcagacatcagcactggtttctcatggctcctgggatctcaaagaagattttggcgatcaagaggagcagttgcgacaattcgacatggacatgaaatttggcccctgcattggtgtcactcggcttcagcgctgggagcgtgcttctgccatgggcctccagccaccacctcatatccaggatcttttactacgtgcttcatcaacaaagaatcgtagtagcagtggcccctcccctgagtgcctctgggagggtaaagtctagaataaaagtcctctgtactaggcaagatcttgttcataagaacctagttgaacttttgcatctctcccatcaacgatgaactttagttctctagccgtcaacacataaggcatgtctgtctactgcttcgttggtgagggcgtgaggctccagtagctcacttgtgacatactctgtgacaccttgttgatgtaagatgatactgctttgtttctgttgtatctctttggtttgaata

SEQ ID NO: 4381 - DNA, 1014 bp, Oryza sativa
ctcaaaagggcagagaaggttccattccattcccattcctatcccgaaagctcccaaaccctagccggcgagcgacaccgccgggcgcgcgaggcggcggctcacgagcagcgccaccgagggcgcgagcggccggccggccggacgccggggagagtgccggtgagttcgcgtctccccgcagcggcagccagcgagacgcggagcggcacgaagacttccaggaaaacattggtagaactgaagaatagacagatatggcttctggtggcatgaaggacttttaccggcagaagaagaaaggaggtcccaccaaagcatcgtcatcttccaagaagaaaacacagcattacactggaggggcctctgttggggcctcagacactgctcagacatcagcactaatttctcatggtaacctagatcttaaagatgatttcagtgagcaagaggagcagttgcgactgtttgatatggacatgaagtttggcccttgcattggcgttactcgtcttcagcgttgggaacgtgcttctgccatgggtcttcacccaccacctcatctcagggatctcttactgaacaatactcatgcaggcaatcacaataacaatggtccctcccttgagtgcctctgggagggcaaagtctagaacaaacaaatagtctgtactactgtaaatcctgcactgttcatagctactcgctatgcctagcccttcaaaccccaccccaactgatggatgaatccctgtatttcttcttagtcgagggctttgggctcagtcaatgaccttgtgttgtcgcaatcctttgtttctgctacgttttctgacaatactgcagtgtttcttcagtttgttcttaatcctaagctgttactagtaaaaataaggagaatgagctggcagtgtatctccagtttgccccaaatccaatgtttgccaaaaggataatgtaactgctggtgattgatgcgagaaaaaggaaatatggaaatagccaattaagtta

SEQ ID NO: 4382 - DNA, 999 bp, Oryza sativa
aaggttccattccattcccattcctatcccgaaagctcccaaaccctagccggcgagcgacaccgccgggcgcgcgaggcggcggctcacgagcagcgccaccgagggcgcgagcggccggccggccggacgccggggagagtgccggtgagttcgcgtctccccgcagcggcagccagcgagacgcggagcggcacgaagacttccaggaaaacattggtagaactgaagaatagacagatatggcttctggtggcatgaaggacttttaccggcagaagaagaaaggaggtcccaccaaagcatcgtcatcttccaagaagaaaacacagcattacactggaggggcctctgttggggcctcagacactgctcagacatcagcactaatttctcatggtaacctagatcttaaagatgatttcagtgagcaagaggagcagttgcgactgtttgatatggacatgaagtttggcccttgcattggcgttactcgtcttcagcgttgggaacgtgcttctgccatgggtcttcacccaccacctcatctcagggatctcttactgaacaatactcatgcaggcaatcacaataacaatggtccctcccttgagtgcctctgggagggcaaagtctagaacaaacaaatagtctgtactactgtaaatcctgcactgttcatagctactcgctatgcctagcccttcaaaccccaccccaactgatggatgaatccctgtatttcttcttagtcgagggctttgggctcagtcaatgaccttgtgttgtcgcaatcctttgtttctgctacgttttctgacaatactgcagtgtttcttcagtttgttcttaatcctaagctgttactagtaaaaataaggagaatgagctggcagtgtatctccagtttgccccaaatccaatgtttgccaaaaggataatgtaactgctggtgattgatgcgagaaaaaggaaatatggaaatagccaattaagtta

SEQ ID NO: 4383 - DNA, 1729 bp, Secale cereale
cacaagccaccgttcgtccgcgcacgcgcacgctctgctcgcgataatcctcaccggcgagcgcgcagctctcgatctggtaccatccccatgtcgcccgtgcggatcatcgacgcgagctatgtgcgcgtgccggagaccgccgcgccgccgccggggccgatcaggttcaccgcgatggaggcgctctgggtcgtcttcccggtgctgcagcacgtcctgctctaccagggcgacgacatgccgcccttcgacgccattctccagtccctccgctcctccctggcggccactttggagagcttcgcgccgctcgccggcaagctggtccacctcgaggacacgggggacgtcggcatcagctgctccgcctccgacggcgtcaggttcgtcgtcgccgagtgcgacgccgacatccgccgcctggccggcgacgaggagcacgacctgcgcgtgctggaggcgctcgtgccggaggtggacatgggccagctgccgaccgccgtgctggccgtgcaggccacccgtttcgcgggcggcgtggccctcgggctgacggtgcaccacggcgccgccgacgggcgggcgctgtggacgttcgtcgaggcgtgggcgacggcgtgccggggcgaggcgccggccgccacgccgtgcttcgaccgctcgctcgtcaagatgcccgccggcgacgagctggccagtagtgttctgcggaagttcgctcccaatttgccctcggcggcactagcatcgtcagtcttcgatgaccgaaagcggctcactcgccgaaccttcaccttggacgaaggagacatcaaacgcctgaagcaacacattgtccacctcaatgagtcgggaggcacgcccctgcctcgtccgccgtctggtttcgccaccgtcgtcgcgctcgcgtggacgtgcttcgcccggtgcaagtcgttctccttggacgacgacctgtggctcttcttcttcgccgacatccgcgagcgccttgaccctcccgtcggcgcggggtacattggctcgtgcctcaccaagtgcttggcaaggctccccgcccgggagcttcatggcgagcgcgccctcgcggctgcggcgtcggcggtccaggacgagatcaacaagatgaaggaagaccctattgctggttggaacttcttctcgtacgatgtcatgcccatcatggaccggctgatgaacatatcaggctcgtcgggttttagtgcatacaagatcgccgacttcgggtggggtaagccaaggcgaacagagccgattaggatgaacacggacggtcaggtggcgctgatgggcagcagggacggccggggtgtgcaggtctcagtggcactgctccaagcggcacaaatggacgagttcaaatctaactttctggcgctacttgagtgacactttttgctctcaaagagacatacttacgtcacttcaaaacagtacacccaaatgttttacaaagattaatgcattataattgaattattttttaactaagagttccttattttgaagttgtcgatcttagttgttggttctttatcttactagaagggttgagcgcgcttctctgtgcagttcgtgtggttgagattcataaacataaaatttggtttggcgcatgtgaaagatgacgaaatgtttttttatattgtaatgtttaaatgggctttcttgcttatgtgattatgtgttagctgctaatcactga

SEQ ID NO: 4384 - DNA, 1514 bp, Secale cereale
gactcactagccagcgggcaattctacctggcaaccgcgagctccgtcaccccagccgaccatgtcgcaggtgaggatcgtcgacgcgagctacgtcgatgtgccggagaccgccgtccggccgccggggccgatcaagctgaccgccatggaggcgctgtggatcatcatcccggtgctacagcacgtgctgctttacgagggcgacgacgacatgccgcccttcgacgctatcgtccaatcgcttcggtcctccctcgcggcgactttgggcagcgccccgccgctcgccggcaagctggtccacctcgaggagacgggggacgtcggcatcagctgctccgcctccgacggcgtcaggttcgtcgtcgcggagtgcggcgcagacatcggacgcctggccggcgacgaggagcacgacctgcgcgtgcttgaggggctcgtcccagaggtggacatgagccagctgccggcccccgtgctggccgtgcaggccacgcgcttcgagggcggcgtggcggtcggcgtgacggtgcaccacggtgtcgcggatgggcgggcgctgtggacgttcgttgaggcgtgggcggccgcgtgccggggcgagacgccggccacgacgccgtgcttcgaccgctcgctcgtcaagctgcccggcggcgaagagctggccaggagcgtcgtacggaaggtggccccgaatttgccttcggtggcgccaccgtcatccctggttgaagatcgaaagcggttcagccgtcgaacgttcaccttggagacgcaggacatccaacgcctcaagcaacggattgtccatctagcagaatcctgcggcgcgcccctgctccacacgccgtcaactttcaccgccgtcgtcgcgctcgcctggacgtgcttcgcccggagcaagccattctcctcaaaggacgacgcgcagctcttcttcttcgccgacacccgcgaacgccttgaccctcccgttgatgcggggtacatcggcgcgtgcctcgccgggtcactatcgaagctccccgtgcccgtgcttcgtggtgaccacgccttggcagccgcggcgtcgacggtccaggacgagatcaacaagctgaaggaggaccctatcgctgggtggaacttctacacgttgatagccgatgcctgcatcgaccgtatgatgaatatatcaggatcgtcgggatttagagcatacgaggtcggcgacttcgggtgggggaagccgagccgaacagagtcgattacgatgaaccacgacggtcaggtggcgctgatgcgcagcagggatggccagggcgtccaggtgtcagtgtcgctgctccaaccggcacagatggatgcgttcaagtctagtttcctcgagctactcaagtaatgatttttttttcaaagatacctaactccacatagaactctcacgtagatcatgagttaatacacaaaacataatgaacaatgcttatcatacatgagatcacttgatccctctcggcaaaaaagtc

SEQ ID NO: 4385 - DNA, 1546 bp, Triticum aestivum
acgccacctcctcccctccctcccccgccgccgcgcatttgctggtctcggcgagggccgctcctctgctcgtgtgggtggccgtgccctcgccggcgtcgcgtcgcgccggccctcgaatctccggcgagccgctcgcgccccaagcccgagcccggtgaggcctgctgctctaggtcttcctgccacccagagttgtcggtgtactggttttgatatggagtgattggtggagctggtcgtccggaagctctgctggttaatccgatggggagcaacgatcctagcacgccgcctaaggcttcgaagccaccagaacaggagcaacctccagctactacctctggcactacagctccagtttaccctgaatggcccggctttcagggctacccagcgatgccaccacatgggtttttcccccctcctgttgctgcaggccaggctcatccatacatgtggggagctcagcacatggtgccaccttacgggacaccaccacccccctatatgatgtatccaccaggaacagtatatgcccacccgactactcctggtgtgcatccatttcattatcctatgcaaacaaatggaaatcttgaacctgctggagctcagggagctgcaccaggtgctgcagaaacaaatgggaaaaatgagcctggcaaaacatctggtccatctgccaatggggttacgtccaacagtgaaagcggaagtgatagtgagagtgaaggaagtgatgccaattctcaaaacgattcacattcaaaggagaatgatgtaaatgaaaatggcagtgctcagaatggcgtatctcattcatcatcgcatggaacatttaataaacccatgccgttggttccagtacaatcaggtgcagtgataggaggagttgctggtcctgcgacaaacttgaacatagggatggactactggggtgcaactggctcttcacctgttcctgcaatgcgcggcaaagcaccgtctggttcagctcgaggagagcaatgggatgaaagggaactgaagaagcagaagaggaagctgtccaaccgggaatccgcgcgaaggtcccggctgcgcaagcaggccgagtgtgaagagctcgggcagcgggctgaggctttgaagtcagagaactcgtccctcaggatcgagctcgaccggatcaaaaaggaatacgaggagctcctttcgaagaacacctctctcaaggccaagctaggggagaccggcggtggcgactcggtccccgacatgaacgaacggggcgacaccaacggcggcagccaccacaaggagccctgactgatgacgcatgcggcctctaccactctacttacatagctcgtgatgattgatgattcttgtaacaaacaaacttggcggccccgatctgccacacacacacacaatcagatgattcttcctttttttctgtctcttatcgacctgacaatggcgatgctgtcgctgctaccgcggaactcactcctgtgcttgtgcttgaaaagagagatcattatgggtgcacttctcaccg

SEQ ID NO: 4386 - DNA, 1341 bp, Secale cereale
attctggtttcgctatggagtgattggtggagccggtcgtccggaagctctgctggtgaatccgatggggagcaacgatcccagcacgccgcctaaggcttccaagccaccggaacaggagcaacctcctgctactacctctggcaccacagctccagtttaccctgaatggcctggctttcagggctacccagcgatgccaccacatgggtttttcccccctcctgttgccgcaggccaggctcatccatacatgtggggagctcagcacatggtgccaccttacgggacaccaccacccccctatatgatgtatccaccagggacagtatatgcccatccgactactcctggtgtgcatccatttcattatcctatgcaaacaaatggaaatcttgaacctgctggagctcagggagctgcaccaggtgctgcagaaacgaatgggaaaaatgagcctggcaaaacatctggtccatctgccaatggggttacatccaacagtgaaagcggaagtgatagtgagagtgaaggaagtgatgccaattctcaaaatgattcacattcaaaggagaatgatgtaaatgaaaatgtacaatcaggtgcagtgataggaggagttgctggtcctgcgacaaacttgaacatagggatggactactggggtgcaactggctcttcacctgttcctgcaatgcgcggcaaagtaccgtctggttcagctcgaggagagcaatgggatgaaagggagcttaagaagcagaagaggaagctgtccaaccgggaatcagcgcgcaggtcccggctgcgcaagcaggccgagtgtgaagagctcgggcagcgcgctgaggccttggaagtcggagaactcgtccctcaggatcgagctcgaccggatcaaaaaggagtacgaggagctcctttcgaagaacacctctctcaaggccaagctaggggagaccggcggcggcggcgactcggtccccgacatgaacgaacggggcgacgccaacggcggcagccacccgaaggagccctgactgaccggcgacgacgcatgcggcatctgctcttctacttacttactcacatagctcgtgatgattgatgatgaatgattcttgtaacaaacaaacatggcgaccccgatctgccacacacatacgcacacaatcagatcagattcttttttttttctctctcttttatcgacctgacaatggcgatgccgaactcgctcctgtgcttgtgcttgaaaagagagatcattgtggtgcactctccatacgaaacgaaaaaaaaaaaaactacgaagacgtagaccgacggacgacgaaccgg

SEQ ID NO: 4387 - DNA, 1300 bp, Secale cereale
cgcccacctctagctcgctctaggttttccagctacgcagagctaccggtattctggttttgctatggagtgattggtggagccggtcgtccggaagctctgctggtgaatccgatggggagcaacgatcccagcacgccgcctaaggcttccaagccaccggaacaggagcaacctccagctactacctctggcactacagctccagtttatcctgaatggcccggctttcagggctacccagcgatgccaccacatgggtttttcccccctcctgttgccgcaggccaggctcatccatacatgtggggagctcagcacatggtgccaccttacgggacaccaccacccccctatatgatgtatccaccagggacagtatatgcccatccgactactcctggtgtgcatccatttcattatcctatgcaaacaaatggaaatcttgaacctgctggagctgcaccaggtgctgcagaaacgaatgggaaaaatgagcctggcaaaacatctggtccatctgccaatggggttacatccaacagtgaaagcggaagtgatagtgagagtgaaggaagtgatgccaattctcaaaatgattcacattcaaaggagaatgatgtaaatgaaaatgtacaatcaggtgcagtgataggaggagttgctggtcctgcgacaaacttgaacatagggatggactactggggtgcaactggctcttcacctgttcctgcaatgcgcggcaaacgtccgtctggttcagctcgaggagagcaagtgggatgaaagggagcttaagaagcagaagaggaagctgtccaaccgggaatcagcgcgcaggtcccggctgcgcaagcaggccgagtgtgaagagctcgggcagcgcgctgaggccttgaagtcggagaactcgtccctcaggatcgagctcgaccggatcaaaaaggagtacgaggagctcctttcgaagaacacctctctcaaggccaagctaggggagaccggcggcggcggcgactcggtccccgacatgaacgaacggggcgacgccaacggcggcagccacccgaaggagccctgactgaccggcgacgacgcatgcggcatctgctcttctacttacttactcacatagctcgtgatgattgatgatgaatgattcttgtaacaaacaaacatggcgaccccgatctgccacacacatacgcacacaatcagatcagatttctttttttttcctctctcttttatcgacctgacaatggcgacgccgaactcactcccgtgcttgtgcttgaaa

SEQ ID NO: 4388 - DNA, 1683 bp, Brachypodium distachyon
ccaccaccaccctccttccttcctcctcctccgccgccgccgccgccctcgtatccgccgcattttcccgcttcggcgaggaccgttcggctgcttcttctctgcgctgcttgttcgaccgcggcgccctctctctggcggggctctgccgctccgctcgtgtcccgagccagactgcgtaggtatttcctctgtccggagctactggtgtcctgttggtggttgcaatggagtgattggacgagttggtcgtccagaaagctttgttggtgaatccaatgggaagtaatgatcccagcacgccgtccaagccttccaaggtgccagagcaggagcaacctccagccactacctctggcaccactgctccagtttaccctgaatggcctggctttcagggctacccagcgatgccgccacatgggttctttccccctcctgttgctgcaggccaggctcatccttatatgtggggagcgcagcatatggtgccaccttatgggacaccaccgccaccttatatgatgtatccaccaggaacagtatatgcccatccctctactcctggtgtgcatccatttcattacccagtaccaacaaatggaaatcttgaccctgctggagctgcaccaggtgcttcagaaataaatggaaaaaatgagcccggcaaaacatctggtccatctgccaacgggattacctccaacagtgaaagtggaagtgatagtgagagtgaaggaagtgatgccaattcccaaaatgattcacattcgaaggagaatgatgtaaatgaaaatggcagttcccagaatggtgtatctcattcatcatcgaatggaatatttaataaaaccatgccattggttccagtacaatcaggtgcagtgataggaggagttgctggtcctgcgacaaacttgaatataggaatggactactggggtgctactggttcttcacctcttcctgcaatgcgtggcaaagtaccgtctggttcagtccgaggagagcaatgggatgaaagggaactcaagaagcagaaaaggaagctgtctaatcgggaatcagcacgcaggtcccggctgcgtaagcaggctgagtgtgaagagctcggtcaacgtgccgaagttttgaagtcagagaactcttctcttagggccgagcttgaacgggtaaaaaaagagtatgaggaacttcgtttgaagaatgcttccctcaaggaaaagctaggggaagccggtgattcggtacctgacatgaacgaacagagcgacaccaatggcgggagccaccagcagaaggaagcctgacatgacatgactattcagcctctaattacttagctcgcgattcttgtaatagggcaattgcaatttgccacacagatgattttaccaagcatctcttctgtgccattcccgaatctgatgtggcaagctgttgcttgctgtactcgcagttcttcttactccttgtggaaaatagaaagcattgtgcacttctcaattatcctttttgtaaatttagtgggacggtgacgcagagatttaaatcctagtgctcacatttacacacctgttattgcatctcattagaaatcctgtgatactcatgtttgtgatctagacaacatttacagttgagtttctgtttttttatgcacaaactggatttggatttgaa

SEQ ID NO: 4389 - DNA, 2005 bp, Brachypodium distachyon
atgggtctcttccgccggatcgccggcatgctcggcatgtccagggacgacgccgaccaccacgacgccgtcgccgccgccgccggcaccggcggaggcgacgtcccacatgataaagtcgccgctgccgcggccgccgcggccgccgccggccaccagacgaggcgcgggttcagcgtccaggtgcccgtccccgtcgaccggccggcggccgggcccgttctgatgccctgcgccccgggagacggtggcgtgcagggttttcggtggtatacaaggaggctgcggatcgacgaagatggtgatgtcgctgatgagttcttggaggaggttctcccagaaagcttgataaataatgacgcaaatccagttggaaggtttcaagtgaaatacaacacgagacctactgctctagcaatgagaaagcagacaatcgccattgatggtgacatccgtcatagcctggagtaccaagggcagcttcaatgggtgtgaagtgtgtaattaggtatttcctctgtccggagctactggtgtcctgttggtggttgcaatggagtgattggacgagttggtcgtccagaaagctttgttggtgaatccaatgggaagtaatgatcccagcacgccgtccaagccttccaaggtgccagagcaggagcaacctccagccactacctctggcaccactgctccagtttaccctgaatggcctggctttcagggctacccagcgatgccgccacatgggttctttccccctcctgttgctgcaggccaggctcatccttatatgtggggagcgcagcatatggtgccaccttatgggacaccaccgccaccttatatgatgtatccaccaggaacagtatatgcccatccctctactcctggtgtgcatccatttcattacccagtaccaacaaatggaaatcttgaccctgctggagctgcaccaggtgcttcagaaataaatggaaaaaatgagcccggcaaaacatctggtccatctgccaacgggattacctccaacagtgaaagtggaagtgatagtgagagtgaaggaagtgatgccaattcccaaaatgattcacattcgaaggagaatgatgtaaatgaaaatggcagttcccagaatggtgtatctcattcatcatcgaatggaatatttaataaaaccatgccattggttccagtacaatcaggtgcagtgataggaggagttgctggtcctgcgacaaacttgaatataggaatggactactggggtgctactggttcttcacctcttcctgcaatgcgtggcaaagtaccgtctggttcagtccgaggagagcaatgggatgaaagggaactcaagaagcagaaaaggaagctgtctaatcgggaatcagcacgcaggtcccggctgcgtaagcaggctgagtgtgaagagctcggtcaacgtgccgaagttttgaagtcagagaactcttctcttagggccgagcttgaacgggtaaaaaaagagtatgaggaacttcgtttgaagaatgcttccctcaaggaaaagctaggggaagccggtgattcggtacctgacatgaacgaacagagcgacaccaatggcgggagccaccagcagaaggaagcctgacatgacatgactattcagcctctaattacttagctcgcgattcttgtaatagggcaattgcaatttgccacacagatgattttaccaagcatctcttctgtgccattcccgaatctgatgtggcaagctgttgcttgctgtactcgcagttcttcttactccttgtggaaaatagaaagcattgtgcacttctcaattatcctttttgtaaatttagtgggacggtgacgcagagatttaaatcctagtgctcacatttacacacctgttattgcatctcattagaaatcctgtgatactcatgtttgtgatctagacaacatttacagttgagtttctgtttttttatgcacaaactggatttggatt

SEQ ID NO: 4390 - DNA, 1432 bp, Leymus cinereus x Leymus triticoides
  misc_feature (972)..(972): n is a, c, g, or t
  misc_feature (1228)..(1228): n is a, c, g, or t
  misc_feature (1263)..(1263): n is a, c, g, or t
  misc_feature (1399)..(1399): n is a, c, g, or t
cgattttttcttttttttctctccccttccgagccccttgtgtcctgaccttcgcttccaagttccacgcggcggatctaccttcaactgccgctgtgccgccttagcgtcaccgccggcgcctcgatcccgccacccccctcccgcctcgcccccgccaccgccgtttcccttcttcctcgccccccgggagatcctggccatcgggtctcctttcttcctctgaggaacaaagttcaggttggcaccaacatgtcgtcgaagaagatagagctagaccacaaggacatggttcatgattctgccattgactactatgggaagcgccttgccacagcctcctctgactccactgtgaagatcaccaacattggaggtgcatctgccccgtcccagctcgttgcgaccctcactggccactatggtcctgtgtggcgtgtcggatgggcccatcccaagtatggttcaattctcgcatcctgcggctatgatggccgtgtgatagtctggaaggagggtgccactgggcaatggtctcagctccatgtgtttgacaaccacaaggcctcagttaactccattgcttgggctccatatgaacttggcctttgccttgcctgtgggtcttctgacggcaccatctctgtcatctccatgcggcttgatgcaggaggatgggacgccgcaaccattgagcgggcacaccctgttggcgtgacagcagtctcctgggctccagcagcagcacttgggtccatggttggctcagatcagctcgtccacaagctcgtgtctggtggctttgactgtgtcgtcaaggtgtgggagtttgtcaatggtggctggaagctggagagcgctctggtctccgacatgcacaaagaatgcgtgagggatgtttcatgggcaccggtcctgggcctggcaaagtcaaccatcgccagcgcatcccaagacggcaaggttgtcatntggaccagtggtaaggcaggaggcaagtgggaaggaaagctcatgcgcgacttcgaggctccggtgtggagggtgtcctggtccctgacgggaaacatactgtccgtcgctgccggcgagggtgacataactctgtggaaggaatcgtcggatgggcagtgggagtcgctgtggaccaaggcctcagacgagccgccgcaggagcaggcgattgaggaggccatgcagtaggggagtcggcgccacgtctcctgtntcaatttcagaccgtgattcgtgtttctagcgccnacggcatgacttgctttcacctgctgccctgatactcatagagatactcgtttccatcttttttgccgtttgtttctacatggacaatgtctgattgcactgttaagttttactggtcatgtactcgtcgtgcacnccgtcagaatgtatcggctgtttgaactgttta

SEQ ID NO: 4391 - DNA, 1466 bp, Triticum aestivum
gttttctctccccttccgaacccctcgcgtcctgaccttcgcttccaagttccaacgcggcggatctaccttcaactgccgctgtgccgccttagcgtcaccgccggcgcctcgatccgcccccctcctcccgcctctcggagacgcgcttcgccgccgccgccgccaccgccaccgccgttccccttcttccccgccaccgggagatcctggccatcgggtctccttccttcctccgaggatcaaagttcaggttggcgccaacatgtcgtcgaagaagatagagctagaccacaaggacatggttcatgattctgccattgactactatgggaagcgccttgccacagcctcctctgactccactgtgaagatcaccaacattgggggtgcatctgccccgtcccagctcgttgcgaccctcactggccactatggtcctgtgtggcgtgtcggatgggcccatcccaagtatggttccattctcgcatcctgcggctatgatggccgtgtgatagtctggaaggaggctgccactgggcaatggtctcagctccatgtgtttgacaaccacaaggcctcagttaactccattgcttgggctccatatgaacttggcctttgccttgcctgtgggtcttctgacggcaccatctctgtcatctccatgcggcttgatacaggaggatgtgacgctgcaaccattgagcgggcacaccctgttggcgtgacagcagtctcctgggctccagcagcagcacttgggtccatggttggctcagatcagctcgtccacaagatcgtgtctggtggctttgactgtgtcgtcaaggtgtgggagtttgtcaatggtggctggaagctggagagtgctttggtctctgacatgcacaaagagtgcgtgagagacgtctcatgggcaccggtcctgggcctggcaaagtcaaccatcgccagtgcttcccaagacggcaaggttgtcatctggaccagtggcaaaggaggaggcaagtgggaaggaaagctcatgcgtgactttgaggctccggtgtggagggtgtcctggtccctgacgggaaacatactgtctgtggctgccggcgagggcgacattactctgtggaaggaatcgtcggacgggcagtgggagtcgctgtggaccaaggcctcagaggagccgccgcaggaggagcaggcgatcgaggaggccatgcagtaggggagtcgacgccacatctcccgtgttgattttggaccatgattcgtgtttctagcgccaacgccatgacttgctttcacctgctgccctgatactcttagagatactcgttgccatcttttttgccgtttgtttctatatggacaatgtctgattgcactgtttaagttttatactggtcatgtactcttgtgcacaccgtcagaatgtatcgcctgtttgaactgtttatatcctgcactagctg

SEQ ID NO: 4392 - DNA, 1431 bp, Triticum aestivum
ccaagttccaacgcggcggatctaccttcaactgccgcggtgccgccttagcgtcaccgccggcgactcgatccgcccccctcctcccgccactcggggacgcgcttcgcccgccaccgccaccgccaccgccaccgccaccgccgttccccttcttcctcgcccccgggagatcctggccataggatctccttccttcctccgaggatcaaagttcaggttggtgccaacatgtcgtcgaagaagatagagctagaccacaaggacatggttcatgattctgccattgactactatgggaagcgccttgccacagcctcctctgactccactgtgaagatcaccaacattgggggtgcatctgccccgtcccagctcgttgcgaccctcactggccactatggtcctgtgtggcgtgtcggatgggcccatcccaagtatggttcaattctcgcatcctgtggctatgatggccgtgtaatagtctggaaggaggctgccactgggcaatggtctcagctccatgtgtttgacaaccacaaggcctccgttaactccattgcttgggctccatatgaacttggcctttgccttgcctgtgggtcttctgacggcaccatctctgtcatctccatgcggcttgatacaggaggatgtgaggccgcaaccatcgagcgggcacaccctgttggcgtgacagcagtctcctgggctccagcagcagcacttgggtccatggttggctcagatcagctcgtccacaagatcgtgtctggtggctttgactgtgtcgtcaaggtgtgggagtttgtcaatggtggctggaagctggagagcgctctggtctccgacatgcacaaagagtgcgtgagagacgtctcatgggcaccggtcctgggcctggcaaagtcaaccatcgccagcgcgtcccaagacggcaaggttgtcatctggaccagtggcaaaggaggaggcaagtgggaaggaaagctcatgcgcgacttcgaggctccggtgtggagggtgtcctggtccctgacgggaaacatactgtccgtggctgccggcgagggcgacataactctgtggaaggaatcgtcggacgggcagtgggagtcgctgtggaccaaggcctcagaggagccgccgcaggaggagcaggcgatcgaggaggccatgcagtaggggagtcgacgccacatctcccgtgtcgatttcggaccgtgattcgtgtttctagcgccaacgccatgacttgctttcaccagatactcttagagatactcgttgccatcttttttgccgtttgtttctatatggacaatgtctgattgcactgttaagttttatactggtcatgtactcttgtgcacaccgtcagaatgtatcgtctgtttgaactgcttatatcctgcaatagctgttatcggt

SEQ ID NO: 4393 - DNA, 1543 bp, Secale cereale
gactctcgtgtcctgcccttgccatccaagttccaacgcggcggatctaccttcgactgccgctgtgaggcggcaccgccgacgcctcgatcccgccccctcctccggcctcccagggacgcgcgtcgccgccgccgccgccgccgccgccgttccccatctccctcggcccccgggagatcctgctgctgtctccacgccgtcccagtcttcggccatcggcctccctccttccttcgagggccgaagttcaggttggcaccaacatgtcgtcgaagaagatagagctagaccacaaggacatggttcatgattctgccattgactactatgggaagcgccttgccacagcctcctcagactccactgtgaagatcaccaacattggaggcgcatctgccccgtcccagctcgttgcgaccctcactggccactatggtcctgtgtggcgtgtcggatgggcccatcccaagtatggttcaattctcgcatcctgcggctatgatggccgtgtgatagtctggaaggagggcgccactgggcaatggtctcagctccatgtgtttgacaaccacaaggcctcagttaactccattgcttgggctccatatgaacttggcctttgccttgcctgtggatcttctgacggcaccatctctgtcatctccatgcggactgatacaggaggatgggacgctgcaaccatcgagcgggcacaccctgttggcgtgacagcagtctcctgggctccagcagcagcacttggggccatggttggctcagatcagctcgtccacaagctcgtgtctggtggctttgactgcgtcgtcaaggtgtgggagtttgtcaatggtggctggaagctggagagcgctctggtctccgacatgcacaaagagtgcgtgagagatgtctcatgggcgccggtcctgggcctggcaaagtccaccatcgccagcgcttcccaagacggcaaggttgtcatctggaccagtggcaagggaggaggcaagtgggaaggaaagctcatgcgcgacttcgaggctccagtgtggagggtgtcctggtccctgacggggaacatactgtccgtggccgccggcgagggcgacataactctgtggaaggaatcgtcggacgggcagtgggagtcgctgtggaccaaggcctcagaggagccgccgcaggagcaggagcaggcgatcgaggaggccatgcagtaggggactcggcgccacatctcccgtgtcgattttcggaccgtgattcgtgtttctagcgccgacgccatgacttgctttcttcacctggtgccctgatgatactcatagagatactcgtttccatcttttttgccgttcgtttctacatggacaatgtctgattgcactgttaagttttatatactggttatgtactcttgtgcacaccgtcagaatgtatcggctgtttgaactaagtttaaaaaaaaaaaaacaaaaaaaaaaaaacaaaaaaaaaaactaaagagaacgtacgtacaacgacgacacgacgggagtag

SEQ ID NO: 4394 - DNA, 1461 bp, Triticum aestivum
cgttttctctccccttccgaacccctcgcgtcctgaccttcgcttccaagttcttccaacgcggcggatctaccttcaactgccgctgtgccgccttagcgtcaccgccggcgcgtcgatccggccccctcctgccgccactcggggacgcgcttctccgccgccaccgccgttccccttcttcctcgcccccgggagatcctggccatcgggtctccttccttcctccgaggatcaaagttcaggttggcgccgacatgtcgtcgaagaagatagagctagaccacaatgacatggttcatgattctgccattgactactatgggaagcgccttgccacagcctcctctgactccactgtgaagatcaccagcattggaggtgcatctgccccgtcccagcttgttgcgaccctcactggccactatggtcctgtgtggcgtgtcggatgggcccatcccaagtatggttccattctcgcatcctgcggctatgatggccgtgtgatagtctggaaggaggctgccactgggcaatggtctcagctccatgtgtttgacaaccacaaggcctcagttaactccattgcttgggctccatatgaacttggcctttgccttgcctgtgggtcttctgacggcaccatctctgtcatctccatgcggcctgatacaggaggatgtgacgctgcaaccattgagcgggcgcaccctgttggcgtgacagcagtctcctgggctccagcagcagcactcgggtccatggttggctcagatcagctcgtccacaagatcgtgtctggtggctttgactgtgtcgtcaaggtgtgggagtttgtcaatggtggctggaagctggagagcgctctggtctccgacatgcacaaagagtgcgtgagagatgtctcatgggcaccggtcctgggcctggcaaagtccaccatcgccagcgcgtcccaagacggcaaggttgtcatctggaccagtggcaaaggaggaggcaagtgggaaggaaagctcatgcgtgacttcgaggctccggtgtggagggtgtcctggtccctgacgggaaacatcctgtccgtggctgccggcgagggcgacataactctgtggaaggagtcgtcagacgggcagtgggagtcgctgtggaccaaggcctcagaggagccgccgcaggaggagcaggcgatagaggaggccatgcagtaggaggggagtctgcgccacatctcccgtgtcgatttcggaccgtgattcgtgtttctagcgccaatgccatgacttgctttcacctgatactcttagagatactcgttgccatcttttttgccgtttgtttctacatggacaatgtctgattgcacttttaagttttatactggtcatgtactctttgtgcacaccgtcagaatgtatcggctgtttgaactgtttatatcctgcactggctgttatcggt

SEQ ID NO: 4395 - DNA, 1468 bp, Secale cereale
cgtgtcctgcccttgccatccaagttccaacgcggcggatctaccttcgactgccgctgtgaggcggcaccgccgacgcctcgatcccgccccctcctccggcctcccagggacgcgcgtcgccgccgccgccgttccccatctccctcggcccccgggagatcctgctgctgtctccacgccgtcccagtcttcggccatcggcctccctccttccttcgagggccgaagttcaggttggcaccaacatgtcgtcgaagaagatagagctagaccacaaggacatggttcatgattctgccattgactactatgggaagcgccttgccacagcctcctcagactccactgtgaagatcaccaacattggaggtgcatctgccccgtcccagctcgttgcgaccctcactggccactatggtcctgtgtggcgtgtcggatgggcccatcccaagtatggttcaattctcgcatcctgtggctatgatggccgtgtgatagtctggaaggagggcgccgctgggcaatggtctcagctccatgtgtttgacaaccacaaggcctcagttaactccattgcttgggctccatatgaacttggcctttgccttgcctgtggatcttctgacggcaccatctctgtcatctccatgcggactgatacaggaggatgggacgctgcaaccatcgaacgggcacaccctgttggcgtgacagcagtctcctgggctccagcagcagcacttggggccatggttggctcagatcagctcgtccacaagctcgtgtctggtggctttgactgcgtcgtcaaggtgtgggagtttgtcaatggcggctggaagctggagagcgctctggtctcggatatgcacaaagaatgcgtgagagatgtctcatgggcgccggtcctgggcctggcaaagtcaaccatcgccagcgcgtcccaagacggcaaggttgtcatctggaccagtggcaagggaggaggcaagtgggaaggaaagctcatgcgcgacttcgaggctccagtgtggagggtgtcctggtccctgacggggaacatactgtccgtggcagccggcgagggcgacataactctgtggaaggaatcgtcggacgggcagtgggagtcgctgtggaccaaggcctcagaggagccgcagcaggagcaggagcaggcgatcgaggaggccatgcagtaggggactcggcgccacatctcccgtgtcgattttcggaccgtggttcgtgtttctagcgccgacgccatgacttgctttcttcacctggtgccctgatttgatactcatagagatacccgtttccatcttttttgccgttcgtttctacatggacaatgtctgattgcactgttaagttttatactggtcatgtactcttgtgcacaccgtcagaatgtatcggctgtttgaactgtttatatatcctgcactagctgttaaaa

SEQ ID NO: 4396 - DNA, 1410 bp, Pseudoroegneria spicata
  misc_feature (1084)..(1084): n is a, c, g, or t
  misc_feature (1150)..(1150): n is a, c, g, or t
  misc_feature (1378)..(1379): n is a, c, g, or t
ttcgcttccagttccaacgcggcggatctaccttcaacccgccgctgtgccgccttagcgtcaccgccggcgcctcgatcccgcccccctcctcccgcctctcggggacgcgcctcgccgccgccaccgccgttccccttcttcctcgcccccccggagatcctggccataggatttccttccttcctctgaggaacaaagttcaggttggcaccaacatgtcgtcgaagaagatagagctagaccacaaggacatggttcatgattctgccattgactactatggaaagcgccttgccacagcctcctctgactccactgtgaagatcaccaacattggaggcgcatctgccccatcccagctcgttgcgaccctcactggccactatggtcctgtgtggcgtgtcggatgggcccatcccaagtatggttcaattctcgcatcctgcggctatgatggccgtgtgatagtctggaaggagggtgccactgggcaatggtctcagctccatgtgtttgacaaccacaaggcctcagttaactccattgcttgggctccatatgaacttggcctttgccttgcctgtgggtcttctgacggcaccatctctgtcatctccatgcggcatgatacaggaggatgggatgccgcaatcatcgagcgggcacaccctgttggcgtgacagcagtctcctgggctccagcagcagcacttgggtccatggttggctcagatcagctcgtccacaagctcgtgtctggtggctttgactgcgttgtcaaggtgtgggagtttgtcaatggtggttggaagctggagagcgctctggtctcggacatgcacaaagaatgcgtgagagatgtttcatgggcgccggtcctgggcctggcaaagtccaccatcgccagtgcttcccaagacggcaaggttgtcatctggaccagtggtaagggaggaggcaagtgggaaggaaagctcatgcgggacttcgaggctccggtgtggagggtgtcctggtccctgacgggaaacatactgtccgtcgccgccggcgagggcgacataactctgtggaaggaatngtcagatgggcagtgggagtcgctgtggaccaaggcctcagaggagccgccgcaggaggagcaggngatcgaggaggccatgcagtaggggagtcggcgccacatctcccgtgtcgatttcagaccgtgattcgtgtttctagcgccaacgccatgacttgctttcacctgctgccctgatactcttagagatactcgttgccatcttttttgccgtttgtttctatatggacaatgtctgattgcactgttaaattttatactggtcatgtactcttgtgcacaccgtcaganngtatcgtctgtttgaactgtttatatccaaa

SEQ ID NO: 4397 - DNA, 1526 bp, Avena sativa
ctttcctcttccacctcctgatctacccgatctcacagtccgacccaacccagaatctctcctgtggtctgctcgctgctgtgccctgcagctccccccccgtgccgtacctcaactccacactcgccgcaacccctccgcccggactcacgcgcgtcgccgccatcgccgttcccgttcttcttcgtcgtcgggaaagcgcgttccagctatctccaccccgctcccgcagtcttccgccgttgggttttgaggactagaaaagaggctgtcaaggcaccaacatgtcgtcgaagaagatagagctagaccacaaggacatggttcatgattctgccattgactactacgggaagcgccttgccacagcctcttcagactccactgtgaagatcaccagcattggaggcgcatctgccccatcccagctcgttgcgaccctcactggccactatggtcctgtgtggcgtgtcggatgggcccatcccaagtatggttcaatcctcgcatcctgtggctatgatggccgtgtgatagtctggaaggagggtgcggctgggcagtggtcgcaggcccatgtgtttgacaaccacaagtcgtcagttaactccattgcctgggctccgtatgaacttggcctttcccttgcctgtgcgtcctcggacggcaccatctctgtcatgtccatgcggtccgatggaggatgggactctgcaaccatcgagcgggcacaccctgttggcgtcacagccgtctcctgggctccagcggcggcacttgggtccatggtcggctcagatcagcttgtccacaagctcgtgtctggtggctttgactctgttgtcaaggtgtgggagtttgtgaatggtggctggaagctggagagcgctctggtctcggacatgcacacagagtgcgtgagagacgtctcgtgggcaccggtcctgggcctggcaaagtcgaccatcgccagcgcctcccaggacggcaaggtcgtcatctggaccaatggcaaaggaggaggggacaagtgggaagggaaggtcatgcgggacttcgaggctcccgtgtggagggtgtcctggtccctgacgggagacatgctgtcggttgccgccggcgagggcgacataacgctgtggaaggaagcgtcggatgggcagtgggagtcgctgtggaccaaggggtcagacgagccgcaggagcaggctaccgaggaggcgacggaggaggccgcgcagtagggggagcctgtgctctgtgtctccagcttgttttggaccttggtttgtgtttctaggccaacctgtgtgctgatactgatagagatattcgtttcgaccttttttttttttgggggtacatctttagctgtcgtttctactgcatggacacaatctctgggaatcgcactgttaaaatttactggtcatgtacttgtctacaccgtcacaatgtatcgtcattttgaactgttatatatatatcctgaagtagctgttatataagtattcgtctgtgtgttt

SEQ ID NO: 4398 - DNA, 1471 bp, Avena sativa
ctttcctcttccacctcctgatctacccgatctcacagtccgacccaacccagaatctctcctgtggtctgctcgctgctgtgccctgcagctccccccccgtgccgtacctcaactccacactcgccgcaacccctccgcccggactcacgcgcgtcgccgccatcgccgttcccgttcttcttcgtcgtcgggaaagcgcgttccagctatctccaccccgctcccgcagtcttccgccgttgggttttgaggactagaaaagaggctgtcaaggcaccaacatgtcgtcgaagaagatagagctagaccacaaggacatggttcatgattctgccattgactactacgggaagcgccttgccacagcctcttcagactccactgtgaagatcaccagcattggaggcgcatctgccccatcccagctcgttgcgaccctcactggccactatggtcctgtgtggcgtgtcggatgggcccatcccaagtatggttcaatcctcgcatcctgtggctatgatggccgtgtgatagtctggaaggagggtgcggctgggcagtggtcgcaggcccatgtgtttgacaaccacaagtcgtcagttaactccattgcctgggctccgtatgaacttggcctttcccttgcctgtgcgtcctcggacggcaccatctctgtcatgtccatgcggtccgatggaggatgggactctgcaaccatcgagcgggcacaccctgttggcgtcacagccgtctcctgggctccagcggcggcacttgggtccatggtcggctcagatcagcttgtccacaagctcgtgtctggtggctttgactctgttgtcaaggtgtgggagtttgtgaatggtggctggaagctggagagcgctctggtctcggacatgcacacagagtgcgtgagagacgtctcgtgggcaccggtcctgggcctggcaaagtcgaccatcgccagcgcctcccaggacggcaaggtcgtcatctggaccaatggcaaaggaggaggggacaagtgggaagggaaggtcatgcgggacttcgaggctcccgtgtggagggtgtcctggtccctgacgggagacatgctgtcggttgccgccggcgagggcgacataacgctgtggaaggaagcgtcggatgggcagtgggagtcgctgtggaccaaggggtcagacgagccgcaggagcaggctaccgaggaggcgacggaggaggccgcgcagtagggggagcctgtgctctgtgtctccagcttgttttggaccttggtttgtgtttctaggccaacctgtgtgctgatactgatagagatattcgtttcgacctgttttttttttgggggtacatctttagctgtcgtttctactgcatggacacaatctctgggaatcgcactgttaaaatttactggtcatgtacttgtctacaccgtcacaatgtatcgtcattttga

SEQ ID NO: 4399 - DNA, 1324 bp, Brachypodium distachyon
cgccgccacccctccctccccatcccgctgcgcccctcgctccgtcgctcgtcctcgtcgtcgcgcgagcgccgccaccaggactaaccgggttggcaccaaatgtcgtcgaagaagatagagctagaccacaaggacatggttcatgattctgccattgactactatgggaagcgccttgccacagcctcctcagactccactgtgaagatcgtcaacattggaggcgcatctgctccatcccagctccttgccaccctcactggccactatggccccgtgtggcgtgttggatgggctcatcccaagtatggttcaattctcgcatcctgcagctatgatggccgtgtgatagtatggaaggagggtgcgactgggcaatggtcgcaggcccatgtgttcagcaaccacaagtcctcagttaactccattgcttgggctccatatgagctcggcctttgccttgcctgtgggtcttcggatggtagcatctctgtcatgtccatgcagcctgatggaggatgggacactgcaaccatcgagagggcacaccctgtcggcgtcacagcagtctcctgggctccagcaacagcgcttggttccatggttggctctgaccagctcgtccacaagcttgtatcaggtggatttgactgtgttgtcaaggtgtgggagtttgtcaacggtggctggaaagtggagagcgctctggtctctgacatgcacgcagaatgtgtgagagacgtttcatgggcaccggttcttggcctggcgaagtcgaccattgccagtgcttcccaagacggcaaggtcgtcatctggaccaaggggaaaggaggagacaagtgggaaggaaagatgatgcgtgacttggaggctccggtgtggagggtgtcctggtccttgacagggaacatactatccgtcgctgctggtgaaggtgccataacactgtggaaggaaacgtcggacgggcagtgggagcagctgtggacgaaggcgtcaggcgagccgcaggagcaggcgacggaggaggtcatcgcggcacagtagggggagcaagcctgcgctgcatatgcatatctccagctcgtttcgaaaccgttactttgtctttatagtacccaatgctgttattattattattattattactgctacatgttttgatcaccggtgttaactgatacagatagagatattcgccttttggtgcatgttgttcttctgctgcatgggtagtgctctgattgcattgtaaaaacctgttggtctgaaattgtttactcttggaacaatgtatcatcctttctgaagtgttata

SEQ ID NO: 4400 - DNA, 1424 bp, Brachypodium distachyon
atggcaaggcacctgatctcgtgccttccctccctctcgctgccgtcgctcgtcttcctccctcgcgcgagcgccgccacccctccctccccatcccgctgcgcccctcgctccgtcgctcgtcctcgtcgtcgcgcgagcgccgccaccaggactaaccgggttggcaccaaatgtcgtcgaagaagatagagctagaccacaaggacatggttcatgattctgccattgactactatgggaagcgccttgccacagcctcctcagactccactgtgaagatcgtcaacattggaggcgcatctgctccatcccagctccttgccaccctcactggccactatggccccgtgtggcgtgttggatgggctcatcccaagtatggttcaattctcgcatcctgcagctatgatggccgtgtgatagtatggaaggagggtgcgactgggcaatggtcgcaggcccatgtgttcagcaaccacaagtcctcagttaactccattgcttgggctccatatgagctcggcctttgccttgcctgtgggtcttcggatggtagcatctctgtcatgtccatgcagcctgatggaggatgggacactgcaaccatcgagagggcacaccctgtcggcgtcacagcagtctcctgggctccagcaacagcgcttggttccatggttggctctgaccagctcgtccacaagcttgtatcaggtggatttgactgtgttgtcaaggtgtgggagtttgtcaacggtggctggaaagtggagagcgctctggtctctgacatgcacgcagaatgtgtgagagacgtttcatgggcaccggttcttggcctggcgaagtcgaccattgccagtgcttcccaagacggcaaggtcgtcatctggaccaaggggaaaggaggagacaagtgggaaggaaagatgatgcgtgacttggaggctccggtgtggagggtgtcctggtccttgacagggaacatactatccgtcgctgctggtgaaggtgccataacactgtggaaggaaacgtcggacgggcagtgggagcagctgtggacgaaggcgtcaggcgagccgcaggagcaggcgacggaggaggtcatcgcggcacagtagggggagcaagcctgcgctgcatatgcatatctccagctcgtttcgaaaccgttactttgtctttatagtacccaatgctgttattattattattattattactgctacatgttttgatcaccggtgttaactgatacagatagagatattcgccttttggtgcatgttgttcttctgctgcatgggtagtgctctgattgcattgtaaaaacctgttggtctgaaattgtttactcttggaacaatgtatcatcctttctgaagtgttatatttcctgcgctagctttatgctactctcc

SEQ ID NO: 4401 - DNA, 1093 bp, Hordeum vulgare
gtacccccagccatggccgcgactacggccgcctcgctaccacgcctctccctcccgccgccggccgctctccctgccgtcacctcctctcgcttccgccccgacctcgcctccgtccccagccgccgccgcgtcggcctccgactccaccgctcgccggtggcacctgcagctgcggcgagctctccatccgctccgtcttcttctccggaaccagggtcgggtatcggtgatgccctcggtggcgtcgccatcttctccgcggccaccggcgagcccgtcctgatcagagatctgtgggaccagaacgagggaatggctgtcgtcgcgttgctaaggcatttcggatgtccatgctgttgggagttggccttgacgttgaaggacgcgaaggaaagatttgattctgctggcgtcaaactaattgccgttggtgttggcactcctgataaagcccgtattcttgctgagcgtttgccctttccattggattacctctatgcagaccctgagcgcaaggcttatgatctcttgggcctgtattttggtgttggtcgcacattcttcaacccagccagtgtgaaagtgttttctcggtttgattccctcaaggaggcaacaaagaactatacaatcgaagccaccccagatgacaggccaagtgtgctgcaacagggtggaatgttcgtgttcaaagggaaagaactgttatatgcgaggaaggatgagggcacaggggatcatgcaccattagatgatgtcctgaacatctgctgtaaagttccagtggcctgatgtcgaatcctaccaacgggtgcttctcgtacatacatttcataagcttggcatcagataactttcaaggcattggaccccgatgagcttaccagggttggtcgtttttggtagatatatgtaactgattatggacactgcacagtgagctaaaatacagcgatacattataatcagcctgtgtattggacctatcggctttattattaatttaaagccaggtgcttcttgggcctttcctctgaaaaaatatagcaatactgtatatatattatatatataacactaatcttcctag

SEQ ID NO: 4402 - DNA, 1128 bp, Secale cereale
gaccaacgggtgggacagcctctacgccgaaacgcctcttgctcggcatcgcggcctgtcttgctctcggacagggtttcgccgcgtacacctagccatggccgcctcgctaccacgcctctccctcccgccgacggccgctctccctgccgtcacctcctcccgctaccgccccgacctcgcccccgtccccaaccgccgccgcctcggcctccgtctccaccgctcgccggtggtacctgcggctgccgcgagctcgccgtccgttccgtcttcttcaccggaaccagggtcgggtatcggtgatgccctcggtggcgtcgccatcttctccgcggccaccggcgagcccgtcctgatcagggatctgtgggaccagaacgagggaatggctgtcgtcgcgttgctaaggcatttcggatgtccttgctgctgggagttggccttgacgctgaaggccgcgaaagaaagatttgattctgctggcgtcaaactaattgctgttggtgttggcactcctgataaagcccgtattcttgccgagcgtttgccctttccattggattatctctacgctgatcctgagcgcaaggcttatgatctcctgggcctatattttggtgttggtcgcacattcttcaacccagccagtgtgaaagtattttctcggtttgattccctcaaggaggcaacaaagaactatacaatcgaagccaccccagatgataggccaagtgtcctgcaacagggtggaatgttcgtgttcaaagggaaagaactgttatatgcgaggaaggatgagggcacaggggatcatgcaccattagatgatgtcctgaacatctgctgtaaagttccggtagcctgatgtcgaatcctacaaacaggtgcttctcgtagagacatctcataagcttggtatcagatgattttcgagatactggatcctgatgtaagggtagcatccgccccatgtacatgtattaagatttttgacaaactttctaacaccttattaattatagaagcttagcagggttggtttttggtagatatatgtaactaattacgaacactgcacagtgagctaaaatatagcgatacgttatcttcagcatgtgcattggg

SEQ ID NO: 4403 - DNA, 1585 bp, Triticum aestivum
ggaaaagattgcactctccgtgacgaatctgtggccacgccgcccgtcccgccaccgggaaacccatctccaccgcatcggcccgcttgctcttgctcggcatcctcggccggccttgctctcggacagggtttcgccgcgtacacctagccatggccgcctcgctgccacgcctctccctcccgccgacggccgctctccctgccgtcgcctcctctcgctaccgccccgacctcgcccccgtccccagccgccgccgccgcctcggcctccgtctccaccgctcgccgctggcacctgcagctgccgcgagctcgccgtccattccgtcttcttcaccggaaccagggtcgggtatcggtgatgccctcggtggcgtcgccatcttctccgcggccaccggcgagcccgtcctgatcagggatctgtgggaccagaacgagggaatggctgtggtcgcgttgctaaggcatttcggatgtccttgctgctgggagttagccttgacgttgaaagacgcgaaagaaagatttgattctgctggcgtcaaactaattgctgttggtgttggcactcctgataaagcccgtatacttgctgagcgtttgccctttccattggattacctctacgcagatcctgagcgcaaggcttatgatctcttgggcctatattttggtgttgggcgcacattcttcaacccagccagtgtgaaagtattttctcggtttgattccctcaaggaggcgacaaagaactatacaatcgaagccaccccagatgacaggccaagtgtcctgcaacagggtggaatgttcgtgttcaaagggaaagaactgttatatgcaaggaaggatgagggcacaggggatcatgcaccattagatgatgtcctgaacatctgctgtaaagttccagtagcctgatgtcgaatcctacaaataggcgcttctcgtagagacatttcataagcttggcatcagatgactttcgagatactggatcctgatgtaagggtagcatccgccccatgtacatgtattaggctttgttcggttacaccctgtcccaaggcgattggaggggatttggggggaatttgacttgtatgggatataattctcttcaatccctgccaaacccctgtcaattgaacgcagctttaagatttttgacaaactttctagcagggttgggttttggtagatatgcataactaattataaacactgcacagtgagctaaaagggttggttttttgtagatatacgttatcttcagcatgtgtattgggctttatcaatttaaagccgggtgtttcttggtcgtatttccacaagtgtccaatttcttgtacagaatgctgcatacctggctacctggacatcatgcaattgggctgtactaatatcaaggagggcaaatgctacacaagatctccaatggtcaaaaccccagtctctgacccacccaccgcgtggagaccaagaagctgctatgttggaaccttttttttgggggtcacactggagccctccaggggagttgatggcttcaaagccttttttggagttacatcttgacc

SEQ ID NO: 4404 - DNA, 1193 bp, Avena sativa
gcttgctcggcatccgcgggctttctcttcctcccggacagggtttcgccgcgtccccacctagccatggccgtgactacggccgcctcgctcccacgcctctccctcccgccgccggccactcgttctaccgtcacctcctctcgcttccctctcaacctcgcctctgtccccacgctgccgccccctccagcctccgtcttcaccgctctctggtggtacctcctaatgccgcaagttctccctccgtcgcatcctcttctccagaaccagggtcgggtatcggcgatgccctcggtggcgtggccatcttctccgcggccaccggcgagcccgtcctgatcaaggatctctgggaccagaacgagggaatggctgttgttgcattgttgaggcatttcggatgtccttgctgttgggagttggccttggcgttgaaggagacaaaagaaagatttgatgctgctggcgtcaaactaattgctgttggtgttggcactcctgataaagcccgtattctcgctgagcgtttgccctttccattggattacctctacgcagatcctgagcgcaaggcttatgatctattgggcctatattttggtcttggtcgcacattcttcaatccagccagtgtgaaagtgttttcccggtttgattccctcaaggaggcgacaaagaactatacaatcgaagccaccccggatgacaggccaagtgtcctgcaacagggtggaatgttcgtgttcaaagggaaagaactgttatatgcgaggaaagatgagggcacaggtgatcatgcaccattagatgatgtcctgaacatctgctgtaaagttccagtagcttgatgttgagtcataccgatgcgcattccagattccgatcttcacgacttcactgtacacagcttcttgccataattttggcatcaaacgacttcccaaagacggactcctggtgcaagggcagcatcgccatgtatatatctattgagatagctgggcgaactttgtccacatttgacaataataggagcttatcagcggtggtttgtggtagatatgttactgattatgtagcctgtatagtgagttagtacaatatagccagtttaacggtaatgtataatactactagtacggaaaatttcttgttgaatgctgcatatctgcacatcacgtaattctata

SEQ ID NO: 4405 - DNA, 1251 bp, Avena sativa
gtttccgcttgctcggcatccgcgggctttctcttcctcccggacagggtttcgccgcgtccccacctagccatggccgtgactacggccgcctcgctcccacgcctctccctcccgccgccggccactcgttctaccgtcacctcctctcgcttccctctcaacctcgcctctgtccccacgctgccgccccctccagcctccgtcttcaccgctctctggtggtacctcctaatgccgcaagttctccctccgtcgcatcctcttctccagaaccagggtcgggtatcggcgatgccctcggtggcgtggccatcttctccgcggccaccggcgagcccgtcctgatcaaggatctctgggaccagaacgagggaatggctgttgttgcattgttgaggcatttcggatgtccttgctgttgggagttggccttggcgttgaaggagacaaaagaaagatttgatgctgctggcgtcaaactaattgctgttggtgttggcactcctgataaagcccgtattctcgctgagcgtttgccctttccattggattacctctacgcagatcctgagcgcaaggcttatgatctattgggcctatattttggtcttggtcgcacattcttcaatccagccagtgtgaaagtgttttcccggtttgattccctcaaggaggcgacaaagaactatacaatcgaagccaccccggatgacaggccaagtgtcctgcaacagggtggaatgttcgtgttcaaagggaaagaactgttatatgcgaggaaagatgagggcacaggtgatcatgcaccattagatgatgtcctgaacatctgctgtaaagttccagtagcttgatgttgagtcataccgatgcgcattccaggtttctgttcttcacgatcacgactcgctgtgcacatgcttcttgccataattttggcatcaagccactttccaaagaccgagtcctggtgcaagggcagcatcgccatgtatatgtattgagatatctgggcgaactttgtccacatttgacaatcataggagcttatcagcggtggtttgtggtagatatgttactgattatgtagcctgtatagtgagttagtacaatatagccagtttaacggtaatgtataatactactagtacggaaaatttcttgttgaatgctgcatatctgcacatcacgtaattctatagtaatattaaggcgtctcccgtcccaaagatacaaaaaaaaaaaaaa

SEQ ID NO: 4406 - DNA, 1179 bp, Saccharum officinarum
aagaactcgaattcttatcgatactggaactcagagcataggagggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaa

SEQ ID NO: 4407 - DNA, 819 bp, Sorghum bicolor
acggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggttaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaata

SEQ ID NO: 4408 - DNA, 6051 bp, Zea mays
aagaactcgaattcttatcgatactggaactcagagcatagggggggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctatgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacttcaaccgatatgcccttaggcacggccatacataacatagaaatcacacatggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcattattattctatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcatgcctactcggcatttcacgagttatgaaagtacaagaaaggatactaaatctcgtcgttaattgatttcagaatagaaagattcagaataaacaaaatttataggactcaaataatcaaataaagtaaaggtaggcgggtaataaccttatttatgacaagtttcaaattggtaaagtatacccctaggataaagaagaagaaggggctgagaaaactcgcaagaaaagttccaaccgatcgtctacttaaattcgaacgggttttcaaagcacaaaaacgcatacatatgtctgtttttaaagcacaaagagttctagatgagattcgctggcgttactacgaggaaaccgttatgatactgaatctcatgccttatcgagcatcgtatcccatcttaaagttggtttattcggcagcagcaaatgctactcattatagggatttcgacaaaacgaatttattcatcactaaagccgaagtcagtaggagtactattatgaaaaaattcagacctcgagctcgaggacgtagttattctataaaaaaacgatgtgtaatataacaattgtactaaatatagtaaagaaatcaaaataatctttagatcaatctaagatttcgattcccagtaaaaaaaaagaaatataatagaaaaatatgggacaaaaaataaatccactcggtttcagacttggtacaacccaaaatcaccattccttttggttcgcacaaccaaaaaattattctgaaggtctacaggaagataaaaaaatacggaattgtatcaagaactatatacaaaagaataggaaaaaaggctcgaatagaaaaatggaatcagactcaagttctgaagtaattacacatatagaaattcaaaaagaaatcgatacaatccacgtcataatccatattggattccccaacttattaaagaaaaagggagcaatcgaagaattagagaaagatctccaaaaggaagttaattctgtaaaccagagacttaatattgctatcgaaaaggttaaagaaccttatagacaacctaatattcttgcggaatatatagctttccaattaaaaaatagagtttcattccgaaaagcaatgaaaaaagctattgaattaactaaaaaagcggatataaagggaataaaaatccaaattgcgggtcgtctagcaggaaaagaaattgcacgtgccgaatgcatcaaaaaggggtagactacccctccaaacaattcgcgctaaaattgattattgctgctatccaattcgaactatctatggagtattaggtgtcaaaatttggatattcgtagaagaagaataactaaccatgtcttcccattccgcccagtgatagaataaaaaagacaagaaccttgtttttccaaaaatccctaaaaaaaagaagaaagtatccctctttctatatgatttaatgaaaattaagaaatcttttaatataattgctatgcttagtgtgtgactcgttagttttttctttagggtcaaaaatggaaaaaaaacttagtaatgatagaaaattaactaataaccaacctattgcttcgtattgtcgagatcctaactaagaaacagtcactatgtgaataaatacatctatcaaaaatgagtagatctatcatatagttgtagcaactgcatttttttctctacaaaagaaacctgattctaggctgtgaagcaaaactaaagggatgtggataaaaggagggatgatagatagaaggaagaagaataagaaagatataggattcccatatgtatggtctatgaattacatcataaaaaaaggcaatgtgataaagcatcaatataataaaattctcaaaaaaagagagaattcgaaatcgtaacttgacttttgaaacaacaaataaaaatataaagcaataaataaagagcagtcgggttaataaaactgagaaaattgactcggaaaaaaaaattggaagctccattgcaggattcaaacctaaccattaaaggagaagctgtggaaacgacaaaacctatgactacataggattttattgaaaagaatcctaatacttcattgggtgggatggcggaacaaaccaaaaaaaatgctttatttgataaggttctaaattaacaaataagacaggaaagagtaaatattcgcccgcgaaatccttattggattagaatactttaccacgattcaataagaataaaaaaaaggagattccaaaaaaggaaggattacattttatataaatattgaatttggatatatttctagatcttctttcttgactatatatttatttttcttttttaagtttaagaaagtcaaaatccaaaaaacctaactttttctattatatattgatgtgtatctatctataatatttttgaatattatggaattagagaaatgacattcgcacgctttctcatttcattcgcgaggagctggatgagaagaaactctcatgtccaattttgtagtagagatggaactaagaaagaaccatcgactataaccccaaaagaactagatttcgtaaacaacatagaggaagaatgaagggaaaatcctgccgaggcaatcatatttgttttggtagatatgctcttcaagtacttgaacccgcttggatcaccgcgagacagatagaagcaggacgaagagcaatgacacgatatgcacgttgtggtggaaaaatatgggtgcgtatatttcccgacaaaccggttacaataagacccacagaaacacgtatgggctcgggaaagggatcccccgaatattgggtagccgttgttaaaccaggtcgaatactttatgaaatgagcggagtatccgaaactgtagctagagcagctatctctatagctgccagtaaaatgcccatacgaagtcaatttcttcgattagagatatagaaccccaaaaaggaatattgaagataaaaaaccctggtttttctttctggaaagacaatatttctttcatccttttgcattgaaataacaaatggaaatccaaataatatgattcaacctcagacccttttaaatgtagcagataacagtggagctcgaaaattgatgtgtattcgagtcataggagccgctggtaatcagcgatatgctcgtattggtgatgttattattgctgtaatcaaagacgcagtgccccaaatgcctctagaaagatccgaagtaattcgagctgtaattgtacgtacacgtaaagaattcaaaggcgacgacggtataataatacgctatgatgacaatgcagcagttatcattgatcaaaaaggaaatccaaaaggaactcgagtttttggcgcggttgccgaagaattaagagaattgaatttgactaaaatagtttcattagctcctgaagtattataaatactagtagacgagatatagatcaaagaaaaaattagtagattttgtctcacgtatatgctttaaaatcctaaatttaaagaaaagggaaaacatgttgattatagaaaaattaggaggaacctagaattagagtcttatgggcaaggacactattgctgatttactaacctctataagaaacgcagacatgaataaaaaaggaactgttcgagtagtatccacaaatattaccgaaaacattgttaaaatacttctacgagagggttttattgaaagtgttcggaaacatcaggaaagtaacagatatttcttggtttcaactttgcgacatcaaaggagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagttttatgttatatatggtaatggccccacctatagtacccaaattctatctcgaacttcctattttgaaaataaaaatagaaaaataggagaaaaatatatgacagaaaaaaaatagtagagaaaaaaaacccgagagaagcaaaagtcactttcgaaggtttagttacggaagccctacccaacggaatgttccgtgttcgcctagagaatgacacgatcatcctgggctatatttcaggaaagatccggtctagttctatacgaatactgatgggggatagggtcaaaattgaaataagtcgttatgattccagcaaaggtcgtataatttatagacttccccataaggattcgaagcgtaccgaagactcgaaggatactgaagatttgaaggataccaaagattcaaaggattaggtttttctggggtaat

SEQ ID NO: 4409 - DNA, 3053 bp, Setaria italica
tttagggattttgggaaaaagaagttcttgtcttattctatcaacgagcagaatgggaagactgggttagttattcttcttctacgaatatccaaatttttacacctaatactccatagatagttcgaattggatagcagcaataatcaattttagcgcgaattgtttgtaggggcagtctgccctttttgatgcattcggcacgtgcaatttctttcctgctagacgacccgcaattttgatttttactccctttatgtctgcttttttagttaattcaatggcttttttcattgcttttcggaatgaaactctattttttaattggaaagctatatattctgcaagaatattaggttgtctataaggttctttaaccttttcgatagcaatattaagtctctggtttacagaattaacttccttttggagatctttctctaattcttcgattgctccctttttctttaataaattggggaatccaatatggattatgacgtggattgtatcaatttctttttgaatttctatatgtgtaattacttcagaacttgagtctgattctattttctattcgagccttttttcctattctgttgtatatagttcttgatacaattccgtatttttttatcttcctgtagaccttcagaataattttttggttgtgcgaaccaaaaggaatggtgattttgggttgtaccaagtctgaaaccgagtggatttattttttgtcccatattttctattctatttctttttttattgggaatcgaaatcttggattgatctaaagattatttagatttctttactatatttagtacaattgttatatgacacatggttttttttatagaataactacgtcctcgagctcgaggtctgaattttttcataatagtacccctactgacttcggctttagtgatgaataaattcgctttgtcgaaatccctataatgagtagcatttgctgctgccgaataaaccaactttaagatgggataagacgctcgataaggcatgaggttcagtatcataacggtttcctcgtagtaacgccagcgaatctcatcaagaactctttgtgctttgaaaacagacatatgtatgcgtttttgtgctttgaaaacccgttcgaatttaagtagacgatcagttggaacttttcttgcgagtttccttagctcgttcttcttcttctttatcctaggggtatactttaccaatttgaaacttgtcataaataaggttattacccgtctatcttactttatttgaatccaattatttctttgtttattctgaatctttctattctgaattcagttaacgacgagatttagtatcttttcttgcactttcataactcgtgaaatgccgagtaggcacgaattcccccaatttgcgacctaccataggatttgttatgtaaataggtatatgttcctttccattatgaatcgcgattgtatggccaaccattgcgggtagaatgctagatgcccgggaccacgttactatatttctttctcctccttcatattaaccttttcgatttttgccaataaatgacgagctacaaaaggattcgttttttttcgtgtcacagctgattactcctttttttcattttaaagagtggcatcctatgtccactatctcgatcgaggtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagggcatttcccattgatataggaacttttgtaccagaaacaatagtatctccaattatagcccctctgggatgtaaaatatatctcttctcaccatccccatagtgtatgagacaaatgtatgcatttcgattagggtcgtattctatggttacgattctaccagatatgtctttttgattccgtcgaaaatcgattttacggtataggcgcttatgacctccccctctatgccttacggtaatgattcctctggcattacgacctttaccacaacggtgccgtccatggatcaatttatttcgtggattggatttcacttgcctgtctacggttcccttgcgtgtgctcgggataggtgtttgtataaatgtttcgccgtattattaagtattctcctttagttcgtttctctatctagaagtggaatagaataacccggttgaagggtaatgatcatacgtctgtaatgcattgtatgtcccagaataggtcccattcttctaccctttccgggtagtcgatggctattcacagctactaccttaacaccaaagaagagttcgacccaatgctttatttctgtcttagtgaatcccgattcgacattagaagtatattgattctttcccaataaacgaagactcttttctgtaaatactgcgtatttgattccatccataaatcgactttccctcctatgctctgagttccagtatcgataagaattcgagttctt

SEQ ID NO: 4410 - DNA, 1100 bp, Lolium multiflorum
agatagagaaaaaactaaaggagaatacttaataatatggcgaaacatttatacaaaacacctatcccgagcacacgcaagggaaccgtagacaggcaagtgaaatccaatccacgaaataatttgatccatggacgacaccgttgtggtaaaggtcgtaattccagaggaatcattaccgcaaggcatagagggggaggtcataagcgcctataccgtaaaatagattttagacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgcccctacctttgaccgatatgcccttaggcacggccatgcataacatagaaatcacacgtggaaggggtgggcaattagctagagcagcaggtgctgtagcgaaactgattgcaaaagagggtaaatcggccactttaagattaccatctggggaggtccgtttagtatcccaaaactgcttagcaacagtcggacaagtgggtaatgttggggtgaaccaaaaaagtttgggtagagccggatctaagtgttggctaggtaaacgacccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaatatggaaattgcattttttgaatttgcaataatgcgatgggcgaacgacgggaattgaacccgcgcatggtggattcacaatccactgccttgatccacttggctacatccgccccttatccagctaaaggattttttctcttttttttcattcatcattattctatttattttgacctccatacttcgatcgagatattggacatagaatgccactctttaaaaa

SEQ ID NO: 4411 - DNA, 5168 bp, Hordeum vulgare
gaaaaaagtcttcgtttattgggaaagaatcaatatacttttaatgtcgaatcgggattcactaagacagaaataaagcattgggtcgaactcttctttggtgttaaggtggtagctgtgaatagccatcgactacctggaaaaggtagaagaataggacctattctgggccatacaatgcattacagacgtatgatcattacccttcaaccgggttattctattccacttctagatagagaaaaaaactaaaggagaatacttaataatatggcgaaacatttatacaaaacacctatcccgagcacacgcaagggaaccgtagacaggcaagtgaaatccaatccacgaaataatttgatccatggacggcaccgttgtggtaaaggtcgtaattccagaggaatcattaccgcaaggcatagagggggaggtcataagcgcctataccgtaaaatagattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatgcataacatagaaatcacacgtggaaggggtgggcaattagctagagcagcaggtgctgtagcgaaactcattgcaaaagagggtaaatcggccactttaagattaccatctggggaggtccgtttagtatcccaaaattgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggcggtgaagggaaagctcccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggatttttttcttttttccgttgatcattattctatttattctgacctccgtacttcgatcgagatattggacatagaatgccactctttaaaaaggaaaaaaggagtaatcagctgtgacacgaaaaaaaacgaatccttttgtagctcatcatttattggcaaagatagaaaaggtcaatatgaaggaggagaaagaaacaatagtaacgtggtcccgggcatctagcattctacccacaatggttggccatacaattgcgattcataatggaaaggaacatatacctatttacataacaaatcctatggtaggtcgcaaattgggagaattcgtgcctactcggcattttacgagttatgaaaatgcaagaaaggatactaaatctcgtcgttaactgaattctgaatagaaagattaagaagaaaaaaaagattcaaaataaagtaaaggtaggcggggaataaacttatttatgacaagtttcaaactagtaaagtatatccctaggataaagaagaagaaaagtgggctaaggaaactcgcaaggaaagttccaaccgatcgtctacttaagttcgagagagttttcaaagcacaaaaacgtatccctatgtctgttttcaaagcacaaagagttcttgacgagattcggtggcgttactacgaggaaactgttatgatactgaacctcatgccctatcgagcatcttatcccatcttaaagttggtttattcggcagccgcaaatgcaactcattatagggatttcgacaaagcgaatttattcattactaaagccgaagtcagtaggagtactattatgaagaaattcagacctcgagctcgaggacgtagtttccctataaaaaaaagcatgtgtcatataacaattgtactaaatatagtaaagaaatctaaataacctttagatccatctaagatttcgattcccagtaaaaaaaaatatagaatagaaaaatatgggacaaaaaataaatccactcggttttagacttggtacaacccaaaaacaccattccttttggttcgcacaaccaaaaaattattctgaaggtctacaggaagataaaaaaataagggattgtatcaagaactatatacaaaagaataggaaaaagggctcgaatagaaaaatagaatcagactcaagttccgaagtaattacacataatagaaaaatggactcaggttcaagttccgaagtaattacacatatagaaattcaaaaagaaatcgatacgatccacgtcataatccatattggattcccaaatttattaaagaaaaaaggagcaatcgaagaattagagaaagatctacaaaaggaaattaactctgtaaaccagagatttaatatttctatcgaaaaagttaaagaaccttatagacagcctaacattcttgcagaatatatagctttccaattaaaaaatagagtttcattccgaaaggcaatgaaaaaagccattgaattaactaaaaaagcagatataaggggagtaaaagtaaaaattgcgggtcgtctcggaggaaaagaaattgcacgtgccgaatccattaaaaggggcagacttcccctccaaacaatccgcgctaaaattgattattgctgctatccaattcgaactatctatggagtattaggtgtaaaaatttggatattcgtagacgaagaataactaatcttgtcttcgaattctgtccattgatagaataaaaaatgacaagagacttttttcctgaaatccctgcaaaagaagaaattctacctctttctataagatttaatgaaaattgataaatcatttaatataattgctatgcttagtcccaaaagaaccagatttcgcaaacaacatagaggaagaatgaaaggaaaatccttccgaggcaatcgtatttgttttggtagatatgctcttcaagcacttgaacccgcttggatcacggcgagacagatagaagcaggacgaagagcaataacacgatatgcacgtcgtggtggaaaaatatgggtacgtatatttcccgacaaaccggttacactaagacccacggaaacacgtatgggctcgggaaaggggtcccccgaatattgggtagccgttgttaaaccaggtcgtatactttatgaaatggggggagtatctgaaactgtagctagagcagctatctccatagcggccagtaaaatgcccatacgaagtcaatttattcgattagagatatagaaccctaaaaggggtatggaagaaaaaaaatgcccggtttttctttctggaaagacaatatttctttcatccttttgcattgaaataacaaattgaaatcaaaataatatgattcaacctcagacccttttaaatgtagcagacaatagtggagctcgaaaattgatgtgtattcgagtcataggagctgctggtaatcagcgatatgctcgtattggtgatgttattgttgctgtaatcaaagacgcattgccccaaatgcctctagaaagatccgaagtaattcgagctgtaattgtacgtacatgtaaagaattcaaatgcgaagacggtataataatccgctatgatgacaatgctgcggttataattgatcaaaaaggcaacccaaaaggaactcgagtttttggcgcgattgccgaggaattgagagaattgaattttaccaaaatagtttcattagctcctgaagtattataaatactagtaggcgaaatttagatcaaagaattaatattagtagattgtgttttacgtatatgttttaaaatccaaaatgaaaagaaaaaaaaagaaaacatgttgattatagaaaaattaggaggaacctagaattagagtcttatgggcaaggacactattgctgatttactaacttctataagaaacgcggacatgaataaaaaaggaacagttcgagtagtatctacaaatattaccgaaaacattgttaaaatacttctacgagagggttttcttgaaagtgttcggaaacatcaggaacgtaacagatatttcttggttttaactttgcgacatcaaaagagaaagactcgaaaaggaatatatagaacaagaacttttttaaagcgtattagccgacccggcttacgaatttataccaactatcaaggaattcctaaagttttgggtggaatgggaattgctattctttctacttctcgagggataatgacagatcgagaagctcgactaaacagaattgggggagaagtcttatgttatatatggtaatcgccccgcctatagtgctcgaattctacctcgcccttcctattttgaaaataaaaatggaaaaataggagaaaaaaatatgacagaaaaaaaaaataggagagaaaaaaaaaacccgagagaagcaaaagttacttttgaaggtttagttacggaagccctacccaatggaatgttccgcgttcggctagagaatgacaccatcatcctaggctatatttcaggaaagatccggtctagttctatacgaatactgatgggggatagggtcaaaattgaagtaagtcgttatgattcaagcaagggacgtataatttatagacttccccataaggattcgaagcgtatcgaagactcgaaggatagcgaagatttgaaggatagcgaagatttgaagaataccaaagattcaaaggattaggtttttcttttttttttctagggtaataaattctaagttctaaaattcaagcgaagagacttatttttttccaaaatattagattcatagtttaaaaaaggatacggaaatatgaaaataagagcttccgttcgtaaaatttgtacaaaatgtcgactgattcgtaggcgtggacgaattagagtgatttgctctaatccgaagcataaacaaagacag

SEQ ID NO: 4412 - DNA, 3911 bp, Triticum aestivum
gtcgaatcgggattcactaagacagaaataaagcattgggtcgaactcttctttggtgttaaggtggtagctgtgaatagccatcgactacctggaaaaggtagaagaataggacctattctgggccatacaatgcattacagacgtatgatcattacccttcaaccgggttattctattccacttctagatagagaaaaaaactaaaggagaatacttaataatatggcgaaacatttatacaaaacacctatcccgagcacacgcaagggaaccgtagacaggcaagtgaaatccaatccacgaaataatttgatccatggacggcaccgttgtggtaaaggtcgtaattccagaggaatcattaccgcaaggcatagagggggaggtcataagcgcctataccgtaaaatagattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatgcataacatagaaatcacacgtggaaggggtgggcaattagctagagcagcaggtgctgtagcgaaactcattgcaaaagagggtaaatcggccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggcggtgaagggaaagctcccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggatttttttcttttttccattgatcattattctatttattctgacctccgtacttcgatcgagatattggacatagaatgccactctttaaaaaggaaaaaaggagtaatcagctgtgacacgaaaaaaaacgaatccttttgtagctcatcatttattggcaaagatagaaaaggtcaatatgaaggaggagaaagaaacaatagtaacgtggtcccgggcatctagcattctacccacaatggttggccatacaatcgcgattcataatggaaaggaacatatacctatttacataacaaatcctatggtaggtcgcaaattgggggaattcgtgcctactcggcatttcacgagttatgaaaatgcaagaaaggatactaaatctcgtcgttaactgaattctgaatagaaagattaagaagaaaaaaaagattcaaaataaagtaaaggtaggcggggaataaccttatttatgacaagtttcaaactagtaaagtatatccctaggataaagaagaagaaaagtgggctaaggaaactcgcaaggaaagttccaaccgatcgtctacttaagttcgagagagttttcaaagcacaaaaacgtatccctatgtctgttttcaaagcacaaagagttcttgacgagattcgctggcgttactacgaggaaactgttatgatactgaacctcatgccctatcgagcatcttatcccatcttaaagttggtttattcggcagccgcaaatgctactcattatagggatttcgacaaagcgaatttatttattactaaagccgaagtcagtaggagtactattatgaagaaattcagacctcgagctcgaggacgtagtttccccataaaaaaaagcatgtgtcatataacaattgtactaaatatagtaaagaaatctaaataacctttagatccatctaagatttcgattcccagtaaaaaaaaatatagaatagaaaaatatgggacaaaaaataaatccactcggttttagacttggtacaacccaaaaacaccattccttttggttcgcacaaccaaaaaattattcggaaggtctacaggaagataaaaaaataagggattgtatcaagaactatatacaaaagaataggaaaaagggctcgaatagaaaaatagaatcagactcaagttccgaagtaattacacataatagaaaaatggactcaggttcaagttccgaagtaattacacatatagaaatccaaaaagaaatcgatacgatccacgtcataatccatattggattcccaaatttattaaagaaaaaaggagcaatcgaagaattagagaaagatctacaaaaggaaattaactctgtaaaccagagatttaatatttctatcgaaaaagttaaagaaccttatagacagcctaacattcttgcagaatatatagctttccaattaaaaaatagagtttcattccgaaaggcaatgaaaaaagccattgaattaactaaaaaagcagatataaggggagtaaaagtaaaaattgcgggtcgtctcggaggaaaagaaattgcacgcgccgaatccattaaaaagggtagacttcccctccaaacaattcgcgctaaaattgattattgctgctatccaattcggactatctatggagtattaggtgtaaaaatttggatattcgtagacgaagaataagtaatcttgtcttcggattctgtccattgatagaatcaaaaatgacaagagacttttttcctgaaatccctgcaaaagaagaaattatacctctttctataagatttaatgaaaattgataaatcatttaatataattgctatgcttagtcccaaaagaaccagatttcgcaaacaacatagaggaagaatgaaaggaaaatcctgccgaggcaatcgtatttgttttggtagatatgctcttcaagcacttgaacccgcttggatcacggcgagacagatagaagcaggacgaagagcaataacacgatatgcacgtcgtggtggaaaaatatgggtacgtatatttcccgacaaaccggttacactaagacccacagaaacacgtatgggctcgggaaaggggtcccccgaatattgggtatccgttgttaaacctggtcgtatactttatgaaatggggggagtatctgaaactgtagctagagcagctatctccatagctgccagtaaaatgcccatacgaagtcaatttattcgattagagatatagaaccctaaaaggggtatggaagataaaaaaaaaatgcccggtttttctttctggaaagacaatatttctttcatccttttgcattgaaataacaaattgaaatcaaaataatatgattcaacctcagacccttttaaatgtagcagataatagtggagctcgaaaattgatgtgtattcgagtcataggagctgctggtaatcagcgatatgctcgtattggtgatgttattgttgctgtaatcaaagacgcattgccccaaatgcctctagaaagatccgaagtaattcgagctgtaattgtacgtacatgtaaagagttcaaatgcgaagacggtataataatccgctatgatgacaatgctgcggttataattgatcaaaaaggcaatccaaaaggaactcgagtttttggcgcgattgccgaggaattgagaggattgaattttaccaaaatagtttca

SEQ ID NO: 4413 - DNA, 6783 bp, Secale cereale
tcaataaaaatacaattcaatggaattccttttttgtttttctttagattagttaatcttttttgaaaagtaaaaaggggtggagtaaacctgtttttattttcttcgaaactagcgccctcttcctccgcgtgtagaaaaggaagaaataaatcaatcaaattacgagaagcctcataaagtgcttccttaggggttaaacttccattagtccatatttctagaaaaagtatctcgtgtttttcatttccattcccacaagaaaaaatactataattcacatttcgaacaggcatgaatacagcatctataggataacttccatcttgatagttctttctgagttctgtctgatatccccgatctctcttgatctgtaaatcaatacagaaatcaatgggctctgtcaagttagctataggttgtgccgtatcaacgatttctacggaaggcggtaagatgatatcttgagcagttatgtatctaggacctttgacgcaaatggatgcgtctctaactccatagagattacttctcaatacaatttctttcaaatttagtaaaatttcttgtacggattcttcaatacctgctattgtagaatattcgtgcggcacgctcccaaattttgcacgtgtgatacatgttccttctatttctccaagtaaagctcttcgcaaggcaataccgacggtgtccgcttgaccttttctaagcggggacagaatgaaacgaccataataaaggcgcttactatctactcttgattcaacacacttccactgtagtgtttgagtggatcctgctacctcctctcgaaccataatagactagtattattattttatcattgaatcgtttatttctcttgaaatgaaagttgaaagcgggttaattcttttacagacgctttttttaggcggtcgacatccattatgcggcataggtgttacatcgcgtatacaacttaatcgcacaccacttttagcaattgctcgtaatgcggcatctcttccactaccagcgccctttaccataacttctgctcgttgcaaacctactgtacgaatagcatctactgctgttctttgaccagcatagggtgatgcttttcttgagcttttgaatccacaagtaccggccgaggaccaaaaaaccacccgaccttgtgggtctgtaacagttataatggtattgttgaaactagcttgaacatgaataaccccttttgttatcctacgtgcactcttccgtaaactaaaacgtgcattcctacgtaaaccaatacgcactttcttacgtgaaccaatttttggtatagcttttgccatattttattatctcataaatatgagttagaaataaaaaaaagaaaaaagatacaaagatatccgtttcagggtaaaataaaccctttactttaattattttaaattaaattattttatttggaattggaacatttccgcgggtactttttttttactttttagaaagtaaagttctttttcgaaagattacccctgtctttgtttatgcttcggattagagcaaatgactctaattcgtccacgcctacgaatcagtcgacattttgtacaaattttacgaacggaagctcttattttcatatttccgtatccttttttaaactatgaatctaatcttttggaaaaaataagtctcttcgcttgaattttagaacttagaatttattaccctagaaaaaaaaaaagaaaaacctaatcctttgaatctttggtatccttcaaatcttcgctatccttcaaatcttcgctatccttcgagtcttcgatacgcttcgaatccttatggggaagtctataaattatacgtcccttgcttgaatcataacgacttacttcaattttgaccctatcccccatcagtattcgtatagaactagaccgtatctttcctgaaatatagcctaggatgatggtatcattctctagccgaacgcggaacattccattgggtagggcttccgtaactaaaccttcgaaagttacttttgcttctcttcgggtttttttttctcttcttttttttttttcttgtcatatttttttcctcctatttttctatttttattttaaaaataggaagggcgagatagaattcgagcactataggcggggcgattaccatatataacataagacttctcccccaattctgtttagtcgagcttctcgatctgtcattattcctcgagaagtagaaagaatagcaattcccattccacccaaaattttaggaattccttgatagttggtataaattcgtaagccgggtcggctgatacgctttaaaaaggttcttgttctatatattccttttctagtctttctcttttgatgtcgcaaagttaaaaccaagaaatatctgttacgttcctgatgtttccgaacactttcaataaaaccctctcgtagaagtattttaacaatgttttcggtaatatttgtagatactactcgaactgttccttttttattcatgtccgcatttcttatagaggttagtaaatcagcaatagtgtccttgcccataagactctaattctaggttcctcctaatttttctataatcaacatgttttcttttttttcttttcattttggattttaaaacatatacgtaaaacacaatctattaaattaattctttgatctcaatttcgcctactagtatttataatacttcaggagctaatgaaactattttggtaaaattcaattctctcaattcctcggcaatcgcgccaaaaactcgagttccttttggattgcctttttgatcaattataaccgcagcattgtcatcatagcggattattataccgtcttcgcatttgaactctttacatgtacgtacaattacagctcgaattacttcggatctttctagaggcatttggggcaatgcgtctttgattacagcaacaataacatcaccaatacgagcatatcgctgattaccagcagctcctatgactcgaatacacatcaatttccgagctccactattatctgctacatttaaaagggtctgaggttgaatcatattattttgatttcaatttgttatttcaatgcaaaaggatgaaagaaatattgtctttccagaaagaaaaaccgggcatttttttttatcttccataccccttttagggttctatatctctaatcgaataaattgacttcgtatgggcattttactggcagctatggagatagctgctctagctacagtttcagatactccccccatttcataaagtatacgaccaggtttaacaacggatacccaatattcgggggacccctttcccgagcccatacgtgtttccgtgggtcttagtgtaaccggtttgtcgggaaatatacgtacccatatttttccaccacgacgtgcatatcgtgttattgctcttcgtcctgcttctatctgtctcgccgtgatccaagcgggttcaagtgcttgaagagcatatctaccaaaacaaatacgattgcctcggcaggattttcctttcattcttcctctatgttgtttgcgaaatctggttcttttgggactaagcatagcaattatattaaatgatttatcaattttcattaaatcttatagaaagaggtataatttcttcttttgcagggatttcaggaaaaaagtctcttgtcattttttattctatcaatggacagaatccgaagacaagattagttattcttcgtctacgaatatccaaatttttacacctaatactccatagatagtccgaattggatagcagcaataatcaattttagcgcgaattgtttggaggggaagtctaccctttttaatggattcggcgcgtgcaatttcttttcctccgagacgacccgcaatttttacttttactccccttatatctgcttttttagttaattcaatggcttttttcattgcctttcggaatgaaactctattttttaattggaaagctatatattctgcaagaatgttaggttgtctataaggttctttaactttttcgatagaaatattaaatctctggtttacagagttaatttccttttgtagatctttctctaattcttcgattgctcctttttttttaataaatttgggaatccaatatggattatgacatggatcgtatcgatttctttttgaatttctatatgtgtaattacttcggaacttgaacctgagtccatttttctattatgtgtaattacttcggaacttgagtctgattctatttttctattcgagccctttttcctattcttttgtatatagttcttgatacaatcccttatttttttatcttcctgtagaccttcagaataattttttggttgtgcgaaccaaaaggaatggtgtttttgggttgtaccaagtctaaaaccgagtggatttattttttgtcccatatttttctattctatattttttttactgggaatcgaaatcttagatggatctaaaggttatttagatttctttactatatttagtacaattgttatatgacacatgcttttttttatggggaaactacgtcctcgagctcgaggtctgaatttcttcataatagtactcctactgacttcggctttagtaataaataaatttgctttgtcgaaatccctataatgagtagcatttgcggctgccgaataaaccaactttaagatgggataagatgctcgatagggcatgaggttcagtatcataacagtttcctcgtagtaacgccagcgaatctcgtcaagaactctttgtgctttgaaaacagacatagggatacgtttttgtgctttgaaaactctctcgaacttaagtagacgatcggttggaactttccttgcgagtttccttagcccacttttcttcttctttatcctagggatatactttactagtttgaaacttgtcataaataaggttattccccgcctacctttactttattttgaatcttttttttcttcttaatctttctattcagaatctgatcagttaacgacgagatttagtatcctttcttgcattttcataactcgtgaaatgccgagtaggcacgaattcccccaatttgcgacctaccataggatttgttatgtaaataggtatatgttcctttccattatgaatcgcgattgtatggccaaccattgtgggtagaatgctagatgcccgggaccacgttactattgtttctttctcctccttcatattgaccttttctatctttgccaataaatgatgagctacaaaaggattcgttttttttcgtgtcacagctgattactccttttttcctttttaaagagtggcattctatgtccaatatctcgatcgaagtacggaggtcagaataaatagaataatgatcaatggaaaaaagaaaaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttacggcgacgaagaataaaactatcgctatattttttccttttcctagttcttcttccaagcgcaggataaccccaaggggttgtgggtttttttctaccaatgggagctttcccttcaccgcccccatgggggtggtccacagggttcataactacccctcttactacggggcgtttacctagccaacacttagatccggctctacccaaacttttttggttcaccccaacattacccacttgtccgactgttgctaagcagttttgggatactaaacggacctccccagatggtaatcttaaagtggccgatttaccctcttttgcaatgagtttcgctacagcacctgctgctctagctaattgcccaccccttccacgtgtgatttctatgttatgcatggccgtgcctaagggcatatcggtcaaaggtagggcatttcccattgatataggaacttttgtaccagaaacaatagtatctccaattatagcccctctgggatgtaaaatatatctcttctcaccatccccatagtgtatgagacaaatgtatgcatttcgattagggtcgtattctatggttacgattctaccagatatgtctttttgattccgtcgaaaatctattttacggtataggcgcttatgacctccccctctatgccttgcggtaatgattcctctggaattacgacctttaccacaacggtgccgtccatggatcaaattatttcgtggattggatttcacttgcctgtctacggttcccttgcgtgtgctcgggataggtgttttgtataaatgtttcgccatattattaagtattctcctttagtttttttctctatctagaagtggaatagaataacccggttgaagggtaatgatcatacgtctgtaatgcattgtatggcccagaataggtcctattcttctaccttttccaggtagtcgatggctattcacagctaccaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttctt

SEQ ID NO: 4414 - DNA, 1229 bp, Brachypodium distachyon
ggtatggtatattcataccataacataagaacaataagaactcgaattctatcgatactggaactcagagcataggagggaaagtcgatttatggatggaatcaaatacgcagtatttacagaaaaaagtcttcgtttattgggaaagaatcaatatacttttaatgtcgaatcaggattcactaagacagaaataaagcattgggtcgaactcttctttggtgttaaggtagtagctgtgaatagccatcgactacccggaaagggtagaagaataggacctattctgggacatacaatgcattacagacgtatgatcattacccttcaaccgggttattctattccacttctagatagagaaaaaaactaaaggagaatacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaat

SEQ ID NO: 4415 - DNA, 961 bp, Brachypodium distachyon
tggataaggggcggatgtagccaagtggatcaaggcagtggattgtgaatccaccatgcgcgggttcaattcccgtcgttcgcccatcgcattattgcaaatgcaaaaaatgcaattttccatattcctagttacgtatttacttacggcgacgaagaataaaactatcgctatattttttccttttcctagttcttcttccaagcgcaggataaccccaaggggttgtgggtttttttctaccaatgggggctttcccttcaccgcccccatgggggtggtccacagggttcataactacccctcttactatggggcgtttacctagccaacacttagatccggctctacccaaacttttttggttcaccccaacattacccacttgtccgactgttgctaagcagttttgggatactaaacggacctccccagatggtaatcttaaagtggctgatttaccctcttttgcaataagtttcgctacagcacctgctgctctagctaattggccaccccttccacgtgtgatttctatgttatgcatggccgtgcctaagggcatatcggtcaaaggtagggcatttcccattgatataggaacttttgtaccagaaacaatagtatctccaattatagcccctctgggatgtaaaatatatctcttctcaccatccccatagtgtatgagacaaatgtatgcatttcgattagggtcgtattctatggttacgattctaccagatatgtctttttgattccgtcgaaaatcgattttacggtataggcgtttatgacctccccctctatgccttgcggtaatgattcctctggaattacgacctttaccacaacggtgccgtccatggatcaaattatttcgtggattggatttcacttgcctgtctacggttcccttgcgtgtactcgagataggtgttttgtataaatgtttcgccgt

SEQ ID NO: 4416 - DNA, 1764 bp, Oryza sativa
agaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatatggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaat

SEQ ID NO: 4417 - DNA, 822 bp, Oryza sativa
acggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttatggtacaaaagttcctatatcaatgggaaatgccctacctttgaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaa

SEQ ID NO: 4418 - DNA, 1749 bp, Oryza sativa
agaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatatggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaat

SEQ ID NO: 4419 - DNA, 823 bp, Oryza sativa
acgacgaaacatttatacaaaacacctatcccgagcacacgcaagggaaccatagataggcaagtgaaatcaaatccacgaaataatttgatccatggacggcaccgttgtggtaaaggtcataattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaa

SEQ ID NO: 4420 - DNA, 3904 bp, Oryza sativa
tgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctcgtctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttgggtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattcctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgac

SEQ ID NO: 4421 - DNA, 837 bp, Sorghum bicolor
aggagaatacttaataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggttaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaata

SEQ ID NO: 4422 - DNA, 3894 bp, Oryza sativa
atagggcctcgttgctaagtgctacaagatatagtgcactggaactcgtggttatggacccgaatcctttagtatggaacattgtcttttccaagtaaaaacccccagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgattaatggatggaatcaaatacgcagtatttatagaaaaaagtcttcgtttattgggaaagaatcaatatacttttaatgtcgaatcgggattcactaagacagaaataaagcattgggtcgaactcttctttggtgttaaggtagtagctgtgaatagccatcgactacctggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaatagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacataactaggaatatggaaaattgcatttttggaatttgcaataatgggatgggcgaacgacgggaattgaacccgcgcatggtggattcacaatccactgccttgatccagttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaagaaatacccaatatcttgcttcagcaagatattgggtatttctagctttcctttcttcaaaaattgctatatgttagcagaaaagccttatccattaagagatggaacttcaagagcagctaggtctagagggaagttgtgagcattacgttcgtgcattacttccataccaagattagcacggttgatgatatcagcccaagtattaataacgcgaccttggctatcaactacagattggttgaaattgaatccgtttagattgaaagccatagtactaatacctaaagcagtgaaccaaatccctactacaggccaagcagccaagaagaagtgtaaagaacgagagttgttaaaactagcatattggaagattaatcggccaaaataaccatgagcggccacaatattataagtctcttcctcttgaccaaatctgtaaccctcattagcagattcgttttcagtggtttccctgatcaaactagaggttaccaaggaaccatgcatagcactgaatagggaaccgccgaatacaccagctacacctaacatgtgaaatggatgcataaggatgttatgctctgcctggaatacaatcataaagttgaaagtaccagatattcctaaaggcataccatcagagaaacttccttgaccaatagggtaaatcaagaaaacagcagtagcagctgcaacaggagctgaatatacaacagcaatccaaggacgcatacccagacggaaactcagttcccactcacgacccatataacaagctacaccaagtaagaagtgtagaacaattagctcataaggaccaccattgtataaccactcatcaacagatgcagcttcccaaattgggtaaaagtgcaatccgatcgccgcagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagataatagaaggcttgtta

SEQ ID NO: 4423 - DNA, 7692 bp, Zea mays
cgctcctcctccgcctcggaatgcgggatgcgagggctccgcagttccagaggcggggccagggcggcgtcggcgtcgtcctcctcccgctgatgctcctcctcgcaggcaccgccagcggccagcagcagatccagccgcccccggtacctccggcggacctgccggacgtggagaggcggctcaacaacctgaccgaccacgtcgccaccaccatctccgacaagttccgcttctgcgtcgccgacccgaaggaggactggaacgaggcgttcaactacacatcggacctcagcttcgtggatcgctgccttaccgagacccaaggcgacctgcctcagcgtctctgcggccccgatgaagtcaagttctacttctcaagcttgtacgaccgcgatggggacaagaacatcaacctcaagacaaacataaactgcaacatgtcttcttggggcaagggatgcgatgccggatgggcctgcgccaccgatccagttccagaccgccccagcaaccgtggtagcaacgatatcccgctgagaacaagcagctgccaggcatgctgcgagggcttcttctgcccccgcggcctcacttgcatgctcccttgcccactaggctcatactgtccacgcgccacggcgaatcacacaactgggctctgcgacccgtacaagtatcagatagctccaaactcgactgatagctgtggaggtgctgacatgtgggctgatatccagagcacagaagaaatcttctgcccagctggttactactgtccaagcacgaccagaaaagataactgtagcagtgggcactattgcagattgggttccacagctgaggagaagtgcataataaaggcctcctgcgaagaaaacgcagagaacgagcacatcgccattcttggagcttgcatagtgggtgcgttgtgcctgctgcttcttgtcatatacaactgctcagacaaattcctcagcatccgtgaacggaggaaagcaaggtcaagggagaatgccatccggctagctcgccagcagctaaaggcgcaggagggatggaaagcggcgaaacagtttgccaggaggcatgtgagtggcatgcagggtcatctttcacgcacgttttcgcggaggaggtcgtttcgtcagcaggtagacgcagacaagtctagccatagggtgcaggaagcgccgctgatgggtcaggtccagatgcaggaaatgtcggattctgctgtgtttgcttctgagagcgcaaatgagataacagaggcgatgccatcagtcattgtagatgtcagtgatggggaagttgttgctacaaatgaaaatcctgcgccgaaaggaaaacatagatcaacccacacacaagtgttcaagtatgcgtatggcgagattgagaaggagaaattccagcagcgacaggacaacaagaatctaacttttactggggtgatcgccatggtgaaggaccagcagaaggagataactaggcctttgctcaaggttgagttcagagacctgacactgatgctagggaagaagaagctgctgaggtctatcaatggtgaactccggccggggcgtgtaactgctgtcatgggcccatcaggggctggcaagaccacatttctcaatgccgtcactgggaaggtgaacggctacaagatgacaggttctgttcttgttaatggaaagaatcttaatatccgttcctacaaaaaggtcattggatttgtgccacaagatgacattgttcatggaaacttaacggtggaggaaaacctctggttcagtgcaaagtgcaggctatcagcaagcatgaagcatcgcgacaaggtgctcctagtggagagagtgatagattctctggatcttcagggaatcagaaattcattggttggcacagttgaaaagcgtgggatttctggcgggcagaggaagcgtgtcaatgtgggcatcgagatggtgatggagccgtcgcttctaatcctggatgaaccaacatctggcctggatagctcctcgtcacaacttctcctcagagcccttcggcatgaggcgctccaaggcgtgaacgtctgtgctgttgttcatcaaccgagctacacgctgtacaacatgttcgacgatttgatactcctcgcaaaaggggggttgatggtctacaatggcccagtaaagacggtcgaggagtacttcacagctcttggaatccatgttcctgaccgcgtaaaccccccagaccactacatcgacattctcgagggcattgtgaagcctgattcttctgccatcaaagcgaagcacctaccagtgcattggatgctacacaatggctacgaagtaccaagtgacatgcaagatgatgtcaaggaaatcggtgaacaagccccacaattcaggtccagctcctcgacatctggctcgccctctcctcactgcctccccatcagaaatgcatttgcagaagagcgtgaccgtctcgaacagcgtttgtcaaaaccgaaggacttgtccagcagaaaaacaccagggatcttcatgcagtacaaatattacttgggaagggttacgaaacagcggctgcgtgaagctaggctgctcatggttgatttcctgatactaggcctagctggtatctgcttagggacgatagcaaagctcagtgacaaaacattcgggatgcctggctacatatacactataattgcagtctctcttttgtgcaagatcgcagcactgcggtcgttttcgttggagcgattgcagtacttcagagagagagaatctgggatgagctctctggcatacttccttgctagggacacgattgatcatttcagtactgttgtgaagccgatcatttacctgtctatgttctactacttcaataacccaagatcaacaattgctgataactacattgtgctcctcgcgcttgtgtactgtgtgactgggataggatacacttttgccatctgcttcagtcctggctcagcacagctgtgttctgcgcttatcccggttgttctaaccctgttatccactcaaaagagtactccaacattaatcaggagattgtgctactcaaaatgggcattggagggcttcataattgtaaatgccaagaagtatcctggagtttggcttataacccgctgtggcctgttgtttcagagtcaatttgatattcacaactacaagctctgcattttgattttgttcatgtatggtctgttcttcaggatggtggcatttgctgcaatgattttactgaagaagagatgaatgtactctagatgtaacatttagttcatctctaatatcttcattcatttttacatgtgtaaaacaattctgatgaaaggttttagagcactgacccttgtacagatgagaaaaaaggcaataggaattcatttttttctaccattattgtttcgtacatccccatatctgaagtcctatgcttcacttgaaaaaagaagattcaaccaaattgttatatgacctattagaacaattttagttaggtcacaataatcgtgattgttaggggaaaatggttttcatgctcctaagtatgcaatttgttttgttttttcaaagatgtatgataaggttaaagatggacaagttctaagtgttcataggagttgatagacacttaagagtaattttaggaatttgtttcctttaacaatattataaaggggatatgaactagtagcttgacctagataagtctaatgagttagatgtggtacacactagttatctttagtattagggtttacggtacacactagttgtttggaacaaacctcattcataaagtttttgaattgctagtagtttagtttgtaagagtttggaggcgtcaccccataggaggaaaagggtcattggctacactaaacgatctttcaaattggtcaagactctcaagtttatggccccttctatatggtaccagttgttgtttcattgaatttgcttcattaataggctcacgattcgactttgatcgttatggattggtaccaagatcaagtcctagacaagcggacctaattttaacagctggtacggtaacaatgaaaatggctccatctttagtgcgattatatgagcaaatgcctgaaccaaaatacgtcattgctacgggagcctgtactattacagggggcatgttcagtacatattcctatagtactgttcgaggagtagataagttaattcctgtggacgtctacctgccgggttgcccgcctaaaccagaggctgttatagatgccctaacaaaacttcgtaagaagatagcgcgagaaataattgaggatcgaactctatgtcaaagtcaaaagaaaaatagatcttttactacccgtcacaaactttatgttcggcgcagtactcacactggaacttacgaacaagaattgctctatcaatcaccatctactttagatatatcttctgaaactttttgtccaaacactaattggtcgtgtattagcagacgatatatatattggttcacgatgcattgcttctcgaaatcaagatattggaattggattagtcaatcgattcataactgcctttcgagcacaaccgtttcgagcacaaccaatatatattagaaccccctttacttgccggagcacatcttggatctgtcaattatgttatgggcggagtcccactcatggggatctggtcgaattgggggaagctgtaggtattattgcgggtcaatcaattggggagccgggaactcaattaacattaagaacttttcatactggtggagtattcacagggggtactgccgaccttatacgatccccctcgaatgaaaaaatccaattcaatgaggatttggttcaccccacacgtacccgtcatgggcaacctgcttttctatgctatatagacttgcatgtaactattcagagtcaggatattctacatagtgtgaatattccgttaaaaagcttgattctagtgcaaaatgatcaatatgtagaatctgaacaagtaattgcggagattcgtgccggaacgtccactttgcattttaaagaaaaggtacaaaagcatatttattccgaatcagacggggaaatgcactggagtactgatgtttaccatgcgcccgaatatcaatatggtaatcttcgtcgattaccaaaaacaagccatttatggatattgtcagtaagtatgtgcagatccagtatagcatctttttcgctgcacaaggatcaagatcaaatgaatacttattctttttttgttgatggaagatatatctttgacttctcaatggctaatgatcaagtaagccatagactgttggatacttttggtaaaaaagatagagaaattcttgattatttaacgccagatcgaatcgtgttcaacggtcattggaattgtttctatccttccattcttcaagataattcagatttgttggcgaaaaagcgaagaaataggctcgtcgttccattacaatatcatcaagaacaagaaaaagagcgaatatcctgtttgggtattgctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccgtagacaggcaagtgaaatccaatccacgaaatgaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcgaaaaaagaagaacctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaacccgcgcatgggtggattcacaatccactgcccttgatccacttgggctacatcccgccccctaatccagctaaaggattttctccttttttccatcattattattctatttattctgacctccatacctcgatcgagatagtggacataggatgccgctctttaaaataaaaaaaggagtaatcagctgtgacacgaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaaatttataggattcaaataatcaaataaagtaaaggtaggcgggtaataaccttatttatgacaagtttcaaattggtaaagtatacccctaggataaagaagaagaaggggctgagaaaactcgcaagaaaagttccaaccgatcgtctacttaaattcgaacgggttttcaaagcacaaaaacgcatacatatgtctgttttcaaagcacaaagagttctagatgagattcgctggcgttactacgaggaaaccgttatgatactgaatctcatgccttatcgagcatcgtatcccatcttaaagttggtttattcggcagcagcaaatgctactcattatagggatttcgacaaaacgaatttattcatcactaaagccgaagtcagtaggagtactattatgaaaaaattcagacctcgagctcgaggacgtagttattctataaaaaaaacgatgtgtaatataacaattgtactaaatatagtaaagaaatcaaaataatctttagatcaatctaagatttcgattccc

SEQ ID NO: 4424 - DNA, 1390 bp, Brachypodium distachyon
gagaatacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcattttttgcatttgcaataatgcgatgggcgaacgacgggaattgaacccgcgcatggtggattcacaatccactgccttgatccacttggctacatccgccccttatccagctacaggatttttctcttttttccattcatcattattctatttattctgacctccatacttcgatcgagatattggacatagattgccgctctttaaaaaggaaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccacaatggttggccatacaatcgcgattcataatggaaaggaacatatacctatttacataacaaatcctatggtaggtcgcaaattgggggaattcgtacctactcggcatttcacgagttatgaaaatgcaagaaaggatactaaatctcgtcgttaactgaatt

SEQ ID NO: 4425 - DNA, 2079 bp, Oryza sativa
tatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcgagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaagaaaaaaaa

SEQ ID NO: 4426 - DNA, 1843 bp, Oryza sativa
tttatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctcgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgta

SEQ ID NO: 4427 - DNA, 1851 bp, Brachypodium distachyon
tacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcaggattcactaagacagaaataaagcattgggtcgaactcttctttggtgttaaggtagtagctgtgaatagccatcgactacccggaaagggtagaagaataggacctattctgggacatacaatgcattacagacgtatgatcattacccttcaaccgggttattctattccacttctagatagagaaaaaaactaaaggagaatacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcgagaaaagaagaatctacttcaaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcattttttgcatttgcaataatgcgatgggcgaacgacgggaattgaacccgcgcatggtggattcacaatccactgccttgatccacttggctacatccgccccttatccagctacaggatttttctcttttttccattcatcattattctatttattctgacctccatacttcgatcgagatattggacatagattgccgctctttaaaaaggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccacaatggttggccatacaatcgcgattcataatggaaaggaacatatacctatttacataacaaatcctatggtaggtcgcaaattgggggaattcgtacctactcggcatttcacgagttatgaaaatgcaagaaaggatactaaatctcgtcgttaactgaattcagaatagaaagattcagaataaaaaaaagatgcaaagtaaagaaa

SEQ ID NO: 4428 - DNA, 2688 bp, Brachypodium distachyon
aagtttgtctatgaagagttaatctaattgtatttttttctataatggatttcttatgtggaatactaatggatagggcctcgttgctaagtgctacaagatctagtgcactggaactcgtggttatgcacccgaatcttttagtatggaacattgtcttttctaagtaaaaacccctagtatatgaaagaatgaaaaggtgctttcgttcttgtggaataagaagccctcgtaccttaatgaaaggaaaatcgtaatttttcgttaggtatttgaccaaataggatcgtccagttcttatagaacctatcactaaaatacccgatagggctaagcggaacgaaaagggttttccatgagatggtaaatgaaaacgattagccccacacgaggtttgggaataagtgattgtctgataatgagcaaggaatatacgtctttctgctaaagaggatctattaaactcataattcattagatccttgttatcaatgccaactaggtatcataagtaaatggatcccggttgttcaatcctttgataaccaaggtcattctttgctaaagagaaatgatcactatgagtcagactcaatagaattggatccattccaaatagagagaattaggattcttgatccctctcaatctctctttcaattcgaggatccagagaggtgttttcatagtcatctccgaatatttgccatctccgaatattttcgatttcatttttctatgatatgtctttctatatgaaaattggttatttacgatgtaggatgatccctgttaagcatccatggctgaatggttaaagcgcccaactcataattggtaaatttgcgggttcaattcctgctggatgcacgcgaacgggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcaggattcactaagacagaaataaagcattgggtcgaactcttctttggtgttaaggtagtagctgtgaatagccatcgactacccggaaagggtagaagaataggacctattctgggacatacaatgcattacagacgtatgatcattacccttcaaccgggttattctattccacttctagatagagaaaaaaactaaaggagaatacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcgagaaaagaagaatctacttcaaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcattttttgcatttgcaataatgcgatgggcgaacgacgggaattgaacccgcgcatggtggattcacaatccactgccttgatccacttggctacatccgccccttatccagctacaggatttttctcttttttccattcatcattattctatttattctgacctccatacttcgatcgagatattggacatagattgccgctctttaaaaaggaaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccacaatggttggccatacaatcgcgattcataatggaaaggaacatatacctatttacataacaaatcctatggtaggtcgcaaattgggggaattcgtacctactcggc

SEQ ID NO: 4429 - DNA, 4019 bp, Oryza sativa
gaaaccacaagagtgaagactagtagagtctcgtcttttgtcattctttgctcctttttcactcaatgattcattcgaatttcccgaccaaaaattctatatgtctattcatagggcctcgttgctaagtgctacaagatatagtgcactggaactcgtggttatggacccgaatcctttagtatggaacattgtcttttccaagtaaaaacccccagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgattaatggatggaatcaaatacgcagtatttatagaaaaaagtcttcgtttattgggaaagaatcaatatacttttaatgtcgaatcgggattcactaagacagaaataaagcattgggtcgaactcttctttggtgttaaggtagtagctgtgaatagccatcgactacctggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcgagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaatagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacataactaggaatatggaaaattgcatttttggaatttgcaataatgggatgggcgaacgacgggaattgaacccgcgcatggtggattcacaatccactgccttgatccagttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaagaaatacccaatatcttgcttcagcaagatattgggtatttctagctttcctttcttcaaaaattgctatatgttagcagaaaagccttatccattaagagatggaacttcaagagcagctaggtctagagggaagttgtgagcattacgttcgtgcattacttccataccaagattagcacggttgatgatatcagcccaagtattaataacgcgaccttggctatcaactacagattggttgaaattgaatccgtttagattgaaagccatagtactaatacctaaagcagtgaaccaaatccctactacaggccaagcagccaagaagaagtgtaaagaacgagagttgttaaaactagcatattggaagattaatcggccaaaataaccatgagcggccacaatattataagtctcttcctcttgaccaaatctgtaaccctcattagcagattcgttttcagtggtttccctgatcaaactagaggttaccaaggaaccatgcatagcactgaatagggaaccgccgaatacaccagctacacctaacatgtgaaatggatgcataaggatgttatgctctgcctggaatacaatcataaagttgaaagtaccagatattcctaaaggcataccatcagagaaacttccttgaccaatagggtaaatcaagaaaacagcagtagcagctgcaacaggagctgaatatacaacagcaatccaaggacgcatacccagacggaaactcagttcccactcacgacccatataacaagctacaccaagtaagaagtgtagaacaattagctcataaggaccaccattgtataaccactcatcaacagatgcagcttcccaaattgggtaaaagtgcaatccgatcgccgcagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagataat

SEQ ID NO: 4430 - DNA, 3497 bp, Brachypodium distachyon
tatttgccatctccgaatattttcgatttcatttttctatgatatgtctttctatatgaaaattggttatttacgatgtaggatgatccctgttaagcatccatggctgaatggttaaagcgcccaactcataattggtaaatttgcgggttcaattcctgctggatgcacgcgaacgggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcaggattcactaagacagaaataaagcattgggtcgaactcttctttggtgttaaggtagtagctgtgaatagccatcgactacccggaaagggtagaagaataggacctattctgggacatacaatgcattacagacgtatgatcattacccttcaaccgggttattctattccacttctagatagagaaaaaaactaaaggagaatacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcgagaaaagaagaatctacttcaaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcattttttgcatttgcaataatgcgatgggcgaacgacgggaattgaacccgcgcatggtggattcacaatccactgccttgatccacttggctacatccgccccttatccagctacaggatttttctcttttttccattcatcattattctatttattctgacctccatacttcgatcgagatattggacatagattgccgctctttaaaaaggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccacaatggttggccatacaatcgcgattcataatggaaaggaacatatacctatttacataacaaatcctatggtaggtcgcaaattgggggaattcgtacctactcggcatttcacgagttatgaaaatgcaagaaaggatactaaatctcgtcgttaactgaattcagaatagaaagattcagaataaaaaaaagatgcaaagtaaagaaatacccaatatcttggtagaacaagatattgggtatttctcgctttcttttcttcaaaaattcttatatgttagcggaaaaaccttaaggaaagttccaaccgatcgtctacttaagttcgagcgagttttcaaagcacaaaaacgttcgtgcattacttccataccaagattagcacggttgatgatatcagcccaagtattaataacgcgaccgttatgatactgaacctcatgccttatcgagcatcttatcccatcttaaagttggtttattcggcagcagcaaatgctgctcattatagggatttcgacaaagcgaatttattcataactaaagccgaagtcagtagaagtactattatgaaaaaattcagacctcgggctcgagggcgcagtttccccataaaaaaaagcatgtgtcatataacaattgcactaaatatagtaaagagatctaaataacccttagatccagctaagatttcgattcccagtaaaaaaaaatagaatagaaaaatatgggacaaaaaataaatccacttggtttcagaattggtacaacccaaaaacaccattccttttggttcgcacaaccaaaaaattattctgagggtctacaggaagataaaaaaataaggaattgtatcaagaactatatacaaaaaaataggaaaaagggctcgaatagaaaaatagaatcagactcaagttccgaagtaattacacataatagaaaaatggactcaggttcaagttccgaagtaattacacatatagaaatcaaaaagaaattgatacgatccacgtcataatccatataggatttccaaatttattaaagaaaaagggagtaatcgaagaattagagaaagatctacaaaaagaaattaactctgtaaaccagagacttaatatttctatcgaaaaagtaaagagccttatagacaacctaacattcttgcagaatatatagcttttcaattaaaaaatcgagtttcattccgaaaggcaataaaaaaagccattgaattaactaaaaaagcagatataaggggagtcaaagtaaaaatagcgggtcgtctcggaggaaaagaaattgcacgtgcggaatgcatcaaaaagggtagacttcctctccaaacaattcgcgctaaaattgattattgttgctatccaattcgaactatctatggagtattaggtgtaaaaatttggatattcgtagatgaagaataactaatctgtcttcgcattctgtgcagtggtagaataaaaaatgacaagagccttttttcccgaaatccctaaaaaaagaagaaattatacctctttctataagatttaatgaaaattgataaatcatttaatataattgctatgcttagtatgtgactcgttattttttt

SEQ ID NO: 4431 - DNA, 997 bp, Pseudoroegneria spicata
ggattcactaagacagaaataaagcattgggtcgaactcttctttggtgttaaggtggtagctgtgaatagccatcgactacctggaaaaggtagaagaataggacctattctgggccatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccgtagacaggcaagtgaaatccaatccacgaaataatttgatccatggacggcaccgttgtggtaaaggtcgtaattccagaggaatcattaccgcaaggcatagagggggaggtcataagcgcctataccgtaaaatagattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatgcataacatagaaatcacacgtggaaggggtgggcaattagctagagcagcaggtgctgtagcgaaactcattgcaaaagagggtaaatcggccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggcggtgaagggaaagctcccattggtagaaaaaaacccacaaccccttggggttatcctgcgcttggaagaagaactaggaaaagga

SEQ ID NO: 4432 - DNA, 3903 bp, Oryza sativa
atacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttatggtacaaaagttcctatatcaatgggaaatgccctacctttgagtgcgagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaataggtaagcggggaataaccttatttatgacaagtttcaaactggtaaagtatacccctaggataaagaagaagaagagtgggctaaggaaactcgcaagaaaagtaccaaccgatcgtctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggcagcagcaaatgctactcattatagggatttcgacaaagcaaatttattcatcactaaagccgaagtcagtaggagtactattatgaataaattcagacctcgggctcgaggacgtagttctcccataaaaaaaaccatgtgtcatataacaattgtactaaatatagtaaagaaatcgaaataatctttagatccatctaagatttgattcccggtaaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgtagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgaatgcatcaaaaaaggtagacttcccctccaaacaattcgcgctaaaattgattattgctgctatccaattcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaaattctacctctttctataagatttaatgaaaattgagaaatcttttaataaaattgctatgcttagtgtgtgactcgttagttttttttaggaatgaaccctactatgtaattatagaaaatgaactaataaccaacctattgcttcgtattgtcgagatcctaactaagaaacagtcactatatgaataaatacatctatcataaatgagtaaatctatcatatacgtgtagcaactgcaattttttctttaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattcgaaatcgtaatttgattgaaacaagaaatacaaatttcaaggaataacaaagagcgtcccgagttaataaaactgagaaattgactcggaaagaaattttttggaagctccattgcgagattcaaacctaaccattaaaggagaagcagtgggaacgacagaacctatgactggataggattttcttgaaaagaatcccaatacttcattgggtgggatggcggaacaaaccaaaaaaattgtcttatttgataaggttatgaattaacaaataagacaggaaagagtaaatattcgcccgcgaaatttttattgaattagaatactttaccgcgattcaataagagtaaaataaaaaaaggagattaaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccatcgactataaccccaaaagaaccagatttcgtaaacaacatag

SEQ ID NO: 4433 - DNA, 861 bp, Brachypodium distachyon
atacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactactgtttctggtacaaaagttcctatatcaatgggaaatgccctacctttgagtgcgagaaaagaagaatctacttcaaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaa

SEQ ID NO: 4434 - DNA, 2089 bp, Oryza sativa
cgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctatgaatagccatcgactacccggaaagggtagaagaatgggccctattctaggacatacaatgcattacagacgtatgatcattacccttcaaccgggttattctattccacttctagatagagaaaaaagctaaaggagaatacttaataatatgacgaaacatttatacaaaacacctatcccgagcacatgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaacaatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcgagaaaagaagaatctacttcaaccgatatgcccttaggcacggccatacataacatagaaatcacacgtagaaggggtgggcaattagctagagcagcaggtgctgtagcgaaactgattgcaaaagatggtaaatcggccactttaagattactatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcattttggaatttgcaataatgggatgggcgaacaatgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaatgaatccttttgtagctcatcatttattggcaaaaatagaaaaggtcaatatgaaggaggagaaagaaacaatagtaacgtggtcccgagcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaagaaatacccagcaagatattggccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaag

SEQ ID NO: 4435 - DNA, 1586 bp, Elaeis guineensis
ggaatctcatcatccatacataacgaattggtatattcataccataacatatgaacagtaagaactagaattcttatcgatactggaactcatagggaagaaaatggatttatggatggaatcaaatatgcagtatttacagaaaaaagtattcggttattggggaacaatcaatatacttttaatgtcgaatcaggattaactaggacagaaataaagcattgggtcgaactcttctttggtgtcaaggtaatagctatgaatagttatcgactcccgggaaagggtagaagaatgggacctattatgggacatacaatgcattacagacgtatgatcattacgcttcaaccgggttattctattccacctcttatagagaaaagaacttaaagcaaaatacttaataacacggcgatacatttatacaaaacttctaccccgagcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgcctataccgtaaaatcgattttcgacggaatgaaaaagacatatccggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgaccgatatgcccttaggcacggccatacataacatagaaatcacacttggaaagggtggacaattagctagagcagcaggtgctgtagcgaaactgattgcaaaagagggtaaatcggccacattaagattaccatctggggaggtccgtttgatatccaaaaactgcttagcaacagtcggacaagtgggtaatgttggggtgaaccaaaaaagtttgggtagagccggatctaagtgttggctaggtaagcgtcctgtagtaagaggagtagttatgaaccctgtagaccatccccatgggggcggtgaagggagagccccaattggtagaaaaaacccacaacccttgggttatcctgcgcttggaagaagaagtaggaaaaggaaaaaatatagtgatagttttattcttcgtcgccgtaaataggaatattgaaaatcgaatttttttggaatttgaataatgtgatgggcgaacgacgggaattgaacccgcgcatggtggattcacaatccactgccttgatccacttggctacatccgccccttatctagctaaaggattttctcttttttccattcatcattattgtatttattctgacctccatacttagatcgagatattggacatagaatgccaatctttaaaatgtaaaaaaaggagtaatcagctgtgacacgttcactaaaaaaaataaccttttcgtttagtctaatacatttagtcgggaaaaagttaagtaaaactaacaacaatgagggagggaggaaagaaataa

SEQ ID NO: 4436 - DNA, 6540 bp, Amorphophallus konjac
gatcaactaggacagaaataaagcattgggtcgaactcttctttggtgtcaaggtaatagctatgaatagtcattggtgtcaaggtaatagctatgaatagtcattggtgtcaaggtaatagctatgaatagtcattggtgtcaaggtaatagctatgaatagtcatcgactcccgagaaagggtagaagaatgggacctattatgggacatacaatgcattacagacgtatgatcattacgcttcaaccgggttattctattccacctcttatagagaaaagaacttaaagcaaaatacttaataacatggcgatacatttatacaaaacttctaccccgagcacacgcaacggagccgtagacagaaaagtcaaatccaatccacgaaataatttgatctatggacagcatcgttgtggtaaaggtcgtaatgccagaggaatcattaccgcaggacatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgaccgatatgccattaggcacggccatacataatatagaaatcacacttggaaagggtggacaattagctagagcagcaggcgctgtagcgaaactgattgcaaaagagggtaaatcggccacattaagattaccttctggggaggtccgtttgatatccaaaaactgcttagcaacagtcggacaagtaggtaatgttggggtgaccaaaaaagtttgggtagagccggatctaagtgttggctaggtaagcgtcctgtagtaagaggagtagttatgaaccctgtagaccatccccatgggggcggtgaagggagagcaccaattggtagaaaaagacccacgaccccttggggttatcctgcgcttggaagaagaagtaggaaaagaaaagatatagtgatagttttattcttcgtcgccgtaaataggcatatagaaaatagcatttttggaatttgaaatataatgggcgaattttaatgttaaagttaaaaaggagtaatccgctgtgacacgttcaacaaaaaaaaatccttttgtagctaatcatttattggtaaaaattgagaaactaaacataagggaggaaaaagaaataatagtaacttggtctagggcatccaccattatacccacaatgattggccatacaatcgctattcataatggaaaggaacatttacccatttatataacagatcgtatggtaggtcacaaattgggagaattcgcacctactcgaacttacgggggacatgcgcgaaacgataataaatctcgtcgctaatctaataatattaaaaactaatactaatataaattataaataaataaaaataaataaaagaaaagtgttcatcattcattgggggaaaagggagtaactttatgataaatatggtaacgaagaactcgagtaaaccgcgtacagaagtcaaagctttagctcaaaatatacatatgtccgtttttaaagcacgaagagtaattgatcagattcgcggacgttcctatgaagaaacacttatgatactggaactcatgccttatcgagcatcctttcccattttaaaattggtttattccgcagcagcaaatgttaacgatctgggtttgaacgaagcagatttattcattagtaaagccgaagttaatgggggtacccttataaaaaggttgagacctagagctagagggcgcagttatctaataaaacgacctacctgccatataacaattgtattaaaggataaatctaaaaaaatctaaatatgagtctaagatttagattcatatttagaaataacatatggatggaaaaataatagaataatatggcacaaaaaataaatccacttggtttcagacttggtacaacccaaaatcatcattccttttggttcgcacaaccaaaaagtttttccattggtctccaggaagatgaaaaaatacgagattgtatcaagaattatgtacaaaaaaatatgagaatatcctcgggtttcgagggaattgcacatatagaaattcaaaaaagaatcgatcttattcaggtcataatctatattggattcccaaatttattaatagagggtcgaagacgaggaatcgaagaattacaaacgaatgtacaaaaagagttgaattctgtaaaccggagactcaacattgctatcacaagaattgaaaaaccttatggacaccctaatattctggcagaatacatagctttacagttaaaaaatagagtttcgtttcgaaaagcaatgaaaaaagctattgaattaactgaacaaacagatacaaaaggaattcaaatacaaattgcagggcgtatcgacggaaaagaaattgcacgtgtcgaatggctcagagaaggtagggttcccctacaaaccattcgcgctaaaattgattattgttcctatacagttcgaactatctatggagtattaggcataaaaatttggatatttgtagacggaaaatgatggacctttttttgtcttaccattctatccagtgatagaacaaaaaatgaaaaactgttttattttcctcctgcttgttgtgttgaatcaaatatgagcttaattcttttaattctatagggatgaataaaaatttgatttacatttttggtagaattgctatgcttagtcccaaaagaaccagattccgtaaacaacatagaggaagaatgaaaggaatatcttatagaggcaatcatatttgttttggaagatacgctcttcaggcacttgaacccgcttggatcacagctagacaaatagaagcgggacgaagagcaatgacccgatatgcacgtcgtggtggaaaaatatgggtacgtatatttcccgacaaacctgttacagtaagacctacagaaacacgtatgggttcggggaaagggtctcccgaatattgggtatctgttgttaaaccgggtcgaatactttatgaaatgggcggagtatccgaaactgtggccagagcagccatttcaatagctgcgtgcaaaatgcctatacgaactcaatttattattgcgggatagagatgtagaacaaaagaaaagggcattaagaatgaatgaaaaaatacaattgcgggtttattttttctggacagataatatttcttttctttcttcgtcctttgcattgaaagagcagataaaaaatgatatgattcaacctcagacccttttaaatgtagcggataatagcggggctcgaaaattgatgtgtattcggattttaggaactagtaatcgccgatatgctcatattggtgacgttattgttgctgtaatcaaagaagcagcgtccaatatgccgctcgaaagatcagaagtaattagagctgtaattgtacgtacgtgtaaagaactcaagcgtgaaaacggtatgagaatacgatatgatgacaatgcagcagttgtcattgatcaaaaaggaaatccaaaagggactcgagtttttggtgcaatcgccagggaattgagagaattccatttcactaaaattgtctcattagctcctgaagtattataaatattagtagatgaaattatgatatagtagaatatctgaaatagaaaaattagtagattgtgtctcaagcatatactttttttttatgaattcataaaaaaaagaaacacgttgattatatcaaaattaggaggcaactataattatagttcatcatgggtagggacactatttccgaaataataacttctataagaaatgctgacatgaaaaaaaaaggaacggttcgaatagcatctactaatatcaccgaaaacgttgttaaaatacttctgcgagaaggttttattgaaaacgttagaaaacatcgagaaagtaagaaaaatttcttggttttaaccctgcgacataacagaactagggaaagaatatataaaactattttaaagcgtatcagccgaccaggtctacgaatctattccgactaccaacgaattcctaggattttaggcggaatggggattgctattctttctacttctcgaggtataatgacagatcgagaagctcgcctagaaggcgttgggggagaaattttgtgttatatatggtgatccttttcctacggcatcctaatttgatctctaacttctcagttgtgaaaagaatgaaaagaaaaagagaggaaaagtgagttatatgactgctcccccattaattgatacttcaaggaaaggttacccggaataaaagaacaaaaatggattcatgagggtttaattactgaatcacttctcaatggtatgtttcggggaggatccgacacggttttatcctgatactaccaggagatagagtcaaaacgaagtaagtagttatgattcaaccggcgggggacatataatttatagacttcgcaacgaagttttgaacgattaggagatttttttaatttcattcgtggggggatacaattcgaggttcaaaaattaaggaaactttttttatttcaaagaatagattcagaatcaaggtaaggaatcgtaaatatgaaaataagggcttctgttcgtaaaatttgtgaaaaatgtcgactgatccgtaggcgcggacgaattatagtgatttgttctaatccaagacataaacagagacaaggataatcttttgagttttctaaaggaaggataaggatcaatgtaaaaataaagaatctgttttaacatgaaatggatatctccgtatatttctgactcatatttatgagatgataaaatatgacaaaacctataccaagaattagttcacgtagaaatggacgtattggttcgcgtaagaatggacgtagaataccaacgcgtaagaatggacgtagaataccaaaaggaattattcatgttcaagcgagtttcaacaataccattgtaactgttacagatgtacgagggcgagtggtttcttggtcctccgcgggtacttctagattcaaaggcgcaaaaagaggaacaccttttgctgctcaagccgcagcggcaaatgctattcgtacagtagttgctcaaggtatgcgacgcgcagaagtcatgataaagggtcctggtcccggacgagatgcagcattacgagctattcgtcgaagtggtatactattaagtttcgtacgcgatgtaactcctatgccacataatggatgtagaccccctaaaaaaagacgtatatagaaataagaattgaacagatttcaagtcaagagaaataaacgattcaataatctaatcaaataacaataatatattattatggttcgagaggaaatagcaggatccactcgaacactacagtggaagtgtgttgaatcaagaatagacagtaagcgtctttattatgggcgtttcgttctgtccccgcttatgaaaggtcaagccgataccatgggtattgctatgcgacggattttacttgaagaaatagaaggaacatgtataacacgtgcaaaatctgaaaaagtaccacatgaatattctacgatagtgggtattgaagaatcaatacatgaaattttaatgaatttgaaagaaattgtattaagaagtaatctatatggcattcgagacgcatccatttgcgtcaaaggccccagatacataacagctcaagatattattctaccgccgtctgtggagatagttgacactacacagcatatagctaccctgacagagcctcttgatttgtgtattggattacaaatccaaagagatcgcggatatcgtatgagacccacaaataactctcaagatggaagttatcctatagatgctgtatccatgcctgttcaaaatgcgaatcatagtatttattcttatgggaatggaaatgaaaaacaagagatcctttttctagaaatatggacaaatggaagtttaactcctaaagaagcactccacgaagcttctcgtaatttgattgatttatttattccttttctacatgcagaggaaaaggacattaatttcgaagaaaataaaagcagatttactttacccccttttacctttcatgatagattggctaatctaaagaaaaacaaaaaagaaattgcattgaaatgtatttttattgaccaatcagaattgccttccaggacctataattgtctcaaaaggtccaatatacatacattattggaccttttgagtaacagtcaagaagatcttatgaaaattgaatatcttcggatagaagatgtaaaacggatagtggacattctacagaagcatttcacaattaatttacctaagactaagttttcattttaaatctatcacaattacttctatc

SEQ ID NO: 4437 - DNA, 1352 bp, Elaeis guineensis
ggatgcacaccaatgggaacgttcaataagtctattggaattggctctgtatcaatggaatctcatcatccatacataacgaattggtatattcataccataacatatgaacagtaagaactagaattcttatcgatactggaactcatagggaagaaaatggatttatggatggaatcaaatatgcagtatttacagaaaaaagtattcggttattggggaacaatcaatatacttttaatgtcgaatcaggattaactaggacagaaataaagcattgggtcgaactcttctttggtgtcaaggtaatagctatgaatagttatcgactcccgggaaagggtagaagaatgggacctattatgggacatacaatgcattacagacgtatgatcattacgcttcaaccgggttattctattccacctcttatagagaaaagaacttaaagcaaaatacttaataacatggcgatacatttatacaaaacttctaccccgagcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgcctataccgtaaaatcgattttcgacggaatgaaaaagacatatccggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgaccgatatgcccttaggcacggccatacataacatagaaatcacacttggaaagggtggacaattagctagagcagcaggtgctgtagcgaaactgattgcaaaagagggtaaatcggccacattaagattaccatctggggaggtccgtttgatatccaaaaactgcttagcaacagtcggacaagtgggtaatgttggggtgaaccaaaaaagtttgggtagagccggatctaagtgttggctaggtaagcgtcctgtagtaagaggagtagttatgaaccctgtagaccatccccatgggggcggtgaagggagagccccaattggtagaaaaaacccacaacccctgggttatcctgcgcttggaagaagaagtaggaaaaggaaaaataatagtgatagttttattcttcgtcgccgtaaataggaatattgaaaatcgaattttttttggaatttgaaataatgtgatgggcgaacgacgggaattgaa

SEQ ID NO: 4438 - DNA, 861 bp, Oryza sativa
tatatatatatatatatatatatatatatatatatatatatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcgagaaaagaagaatctacttcaaccgatatgcccttaggcacggctatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagagaggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaa

SEQ ID NO: 4439 - DNA, 2274 bp, Amborella trichopoda
gatggttcactaatagaccgagggataagtaattcgactcattcacatacagatcatgaatgtttggaatccatattatgcaaggagacattgcttttgctaattctaattgaggggtgatatcaaaccggtccattttcggcgtcatatacatagttagcacattcgtcatagttagcagctccgcatcaaggtcatcatcaatatcgatatcatcactatcaccaatatcgacatcgtcactatcatcaatactattactatcatcaagatcgatatcgtcactatcatcaatatcatcaataagataacctttaggcttgtcatccaggaacttgttcggagataccgtaatggaaggaaggtaggagtttgtcgctaggtatttgaccaaataggatcgtccagttcctatagaacctatcactaaaatacccctagaaggggataggtctaagcggagcgaaaagggttttccatgagatgggaaatgagaactattagccccacacgaggtttgtgaataagtgattgtctgataatgagcaaggaatattcgtctttctgctaaacaggatctattgaactcagaattcattagatactttttatgaatgtcaactaagtatcgtaagtaaattgatcccggttgttcaatcatttgataaccagagtcattctttgagaaaggatcactatgagtcagactccatagaatttgatccattccaaatagtgagaattcttgatctctctcaatatctctctcaattcgaagatccaggatttgagttgatgtcctttcattgattcctcctaaagatttcatttcaattggaatttgcttattcgtgatgatacttatcttatgatgatccttgtgaaattaagcatccatggctgaatggttaaagcgcccaactcataattggcaaattcgtaggttcaattcctgctggatgcacgccaattggaatgtttaataagtctattggaattggctctgtatcaatggaatctcatcatccatacataacgaattggtatggtatattcataccataacatatgaacagtaagaactagaattcttatcgatactggaactcatagggaagaaaatggatttatggatggaatcaaatatgcagtatttacagaaaaaagtattcggttattggggaacaatcaatatacttctaatgtcgaatcaggatcaactagggcagaaataaagcattggatcgaactcttctttggtgtcaaggtaatagctatgaatagtcatcgactcccggtcccgggaaagggtagaagaatgggacctcttatgggacatagaatgcattacagacgtatgatcattacgcttcaaccgggttattctattccacctcttatagagaaaaggacttaaatcaaaatacttaataacacggcgatacatttatacaaaacttctaccccgagcacacgcaatggagccgtagacagtcaagtgaaatccaatccacgaaagaatttgatctatggacagcatcgttgtggtaaaggtcgtaatgccagaggaatcattaccgcagggcatagaggggggggtcataagcgtctataccgtaaaatcgattttcgacggaatgaaaaagacatatctggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgaaatctacttcaaccgatatgcccttaggcacggccatacataatatagaaataacacttggaaagggtggacaattagctagagcagcaggtgctgtagcgaaactgattgcaaaagagggtaaatcggccacattaagattaccatctggggaggttcgtttgatatccaaaaactgctcagcaacagtcggacaagtgggtaatgttggggtgaaccagaaaattttgggtagagccggatctaaatgttggctaggtaagcgtcctgtagtaagaggagtagttatgaaccctgtagaccatccccatgggggtggtgaagggagggccccaattggtagaaaaaaacccacaaccccttggggttatcccgcgcttggaagaagaagtaggaaaaagaagaaatatagtgatagtttcattcttcgtcgtcgtaagtaaataga

SEQ ID NO: 4440 - DNA, 7784 bp, Arabidopsis thaliana
tatcaatggaatcttctcatcatctatacataacgaattggtgtggtatattcatatcataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctgtgggcagcatcattgtggtaaaggtcgtaatgccagaggaataattaccgcaaggcatagagggggaggtcataagcgtctataccgtaaaatagattttcgacgaaatgcaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataatatagaaatcacacttggaaggggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccatccccatggaggtggtgaagggagggctccaattggtagaaaaaaacccgtaaccccctggggttatcctgcacttggaagaagaactagaaaaaggaaaaaatatagtgagactttgattcttcgtcgccgtagtaaataggagagaaaatcgaatttctttcttcgtcttaaaaaaataggagttaattaactgtgacacgttcactaaaaaaaaacccttttgtagcaaagcatttattaagaaaaatagagaagcttaatacaaaggcggaaaaagaaatcataataacttggtcccgggcatccaccattatacccacaatgattggccatacgatcgctattcataatggaagggaacacttacccgtttatataatagatcttatggtaggacataaattaggagaattttcacctactataaattttcgaggacatgccaaaaatgataatagatctcgtcgttaattaaataaattaaaaaaaatgaatatagattttttttgagtgagaggtaaaccttatgataaagaagagaaaaaagaaatcatatacggaagtatatgctttagggcaatatatatctatgtctgcccataaagcacggagagtaattgatcaaatacgtggacgttcctatgaagaagcacttatgatattagaacttatgccttatcgaggatgttatcccatttttaaattggtttattctgctgcagcgaacgctagtcacaataagggtttcaaagaaaccaatttagtcattagtaaagctgaggtgaaccaagggaatactgtgaaaaaattaaaacctcgtgcccgaggacgaagttacccaataaaacgatccacttgtcatataactatcgtattggaagatatatccttctatcaacaatatgaagaatatttaatgtatttaaaaaaacctggatgcagcaatgaaaacagaaatctaacatgttatgatacatatagtagtggaggcctatgggacaaaaaataaatccacttggtttcagacttggtacaacccaaagtcatcattctctttggtttgcacaaccaaaaaagtattctgaaggtttagaagaagataaaaaaatacgagactgtattaaaaattatgtccaaaaaaatataagaatatcctctggtatggagggaattgcacgtattgaaattcaaaaaagaatcgatctcatccagatcataatctatatgggatttcctaaattattaattgaagataaaccccgaagagtcgaagaattacagatgaatgttcaaaaagaactaaattgtgtcaatagaaaactcaacattgctattaccagaatttccaatccgtatggggatcctaatattcttgcagaatttatcgctggacaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggttttaggaataaaaatttggatattcgtagacgaagaataaaaaaactttctttatctttatattttatccgacgataaaaaaacgaaaattatataacacgatacagacagtaataaaaaattgcagtcttcttttttatgtttaaaaataaaataagcaattctataagattgaataaaaatttccatcaaaactcctttgatataattgctatgcttagtgtgtgactcgttggtttaggattagataaagataaaaaaaaaagaaaaaagaacttacctataacagaaactaataactatagcattaataaataacctaagcaactcattgcttcacattatctggataaaaaaatcagtcaagatatgatggattgatcatattattgtagcaactgaaaaaaaaaaagaataaagaactataattataagttatgaaaggtaatcgaaaagtatgcggattcagtggaaggatgaaagaaagagagaaaaaattgaatattaatgatatattattccaatttggaaagtctatgaggtcactgtaagaaaagcaatgtaataaagcatcaatacagattcattcagaataattagataaatctgttccgaaaacaaaaaaaattaagagccttgagccaataaaaactaagaaaattgactcaaaaacaaataaaaaaaatgaaattcccgatttcatataagagctccattgtagaattcgggcctaatgattaatcaagaagcgatgggaacgacggaacccatgaatatagaggattctattgaaaaataaatcttagtaattcattggacaggatggcggaataaaccagattattatctattcttatttttattcagagatctcctgggataaacaacaaacttaatatagatattgaaagagtaaatattcgccggcgaatactttttttttaataaaagtaataaaaaacaaaaattaaaaagataaaagaaaataaggatttgttagaatattctaacaaaaacgacattcgagatgatgatattacgttacgttatttttaaataaatagaattaatcttggattccatttcgaaaaagacatacacaaatttagaagagatcagatgaaattgaatatcatgattaatagaattaatcattaactatatcttaatacaagcttttttagtccttttattcgcgaggagctggatgagaagaaactctcacgttcagttctgtagtagagatggaatttctaatttagaaccatcaactataacccaaaaagaaccagatttcgtaaacaacatcgaggaagactaaaaggaatatcttctcgtgggaatcgtatttgttttggcagatatgctcttcaaacacttgaacccgcttggatcacatctagacaaatagaagcagggcgacgcgcaatgacacgaaatgtacgacgtggtggaaaaatttgggtacgtatatttccagacaaaccagttacagtaagacctgcggaaacgcgtatgggttctgggaaaggatcccctgagtattgggtagctgtggttaaaccaggtaaaatcctttatgaaatgggtggtgtacccgaaaatatagcaagaaaagctatttcaatagcggcatcaaaaatgcctataaaaacccaattcattatttctgaataggaatatataatgaaaaaactaaataacatttaagggtaaaaagattataagttttctttttttgacaaacaatatttttttacttcgtcctttgcattaaaagaagagatacaaaaaaaatgatatgattcaaccacaaacctatttgaatgtagcagacaacagcggggctagagaattgatgtgtattcgaataataggagctagtaatcgccgatatgctcatattggtgacgttattgttgctgtaatcaaagaagcaataccaaatactcctctagaaagatcagaagtgattagagctgtaattgtacgtacttgtaaagaactcaaacgtaacaatgggacgataatacgatatgatgacaatgccgcagttgtcattgatcaagaaggaaatccaaaaggaactcgagtttttggggcgatcccacgggaattgagacaattaaactttactaaaatagtttcattagctcctgaggtattataagatctaaatatcgatagcgatagttagtatcggattaaaaaaacaggtattgaaataaaattaattaatagattctgtatcacgcatatacccttaataataaaatattaagaatttaattcatatattaatatataattcgtctatatctatatataaataaaagaaaaagaacatgttgattatatcaaaattatagaacaataaggaattttaacttatcatggggaaagacaccattgctgatataataacctctatacgaaatgctgacatgaatagaaaaggaacggttcggataggatcgactaacatcacggaaagtattgttaaaatccttttacgagagggttttatcgaaaacgtaaggaaacatcgcgaaaacaaccaatattttttgattttaaccctaagacatagacgaaataagaaagaatcctacaaaacgattttaaatttaaagagaataagtcgaccgggtctacgaatctattctaactctcaacgaattccacgaattttaggcggaataggaattgtaatcctttcgacttctcaaggtataatgacagaccgagaagctcgactaaaaagaatcggcggagaaattttgtgttatatatggtaatccttctaatataaaaattagatatctgtaacttacaatttgtgaaaaaagggggttgtgtaataccacccctgttcaaaaaagtttcggatgttttacttcgaatgaaattaaagaaaaaatgaattaataaaagttttctttcttaatcacttccgaacggcatggttcgattttgtttagatactaaagattttttttcgttcatgcttctgaaaggattcgacatatttttgtataggtatacctataggataaaaaggtaaaattttgagtaagttcttaagtataagttaataaggggacagccattttctagactccataataagtattcaaatgagtaagtgttttttcaatttcaaccattcctttcacgaagatacaattcaagattcaaaaatatcaagaaacctttttttcgtccaccaataaatatattcacagaattaaggaataacaactatgaaaataagggcttccgttcgtaaaatttgtgaaaagtgtcgactaatccgcaggaggggacgaattatagtaatttgttccaacccgaggcataaacaaagacaaggataatcttactaaaggaactaaagtaaaagaaaaggcacttccaaagagttggaaaaaagggtctattttgacctgaaatggatatatccatatatttcttgtgaaatgaaaaaaaatggcaaaacctatattaagaattggttcgcgtaaaaatacacgtagtggttcacgtaaaaatgtacgtagaataccaaagggagttattcatgttcaagcaagtttcaacaataccattgtaaccgttacagatgtacggggtcgggtgatttcttggtcctccgcaggtacttgtggattccggggtacaagaagaggaacaccctttgctgcccaaaccgcagcaggaaatgctattcgagcagtagtggatcaaggtatgcaacgagctgaagtaaggataaaaggccctggactcggaagagatgcggcattacgagctattcgtagaagcggtatacttttaagtttcgtacgagatgtaacccctatgccacataatggttgtagaccccctaaaaaaagacgtgtatagaactaaaaaaaggctaaaagggtttcaagagaaataaacgattcaacgatctgatcaaataaaattactatggttcgagagaaagtcaaagtatctactcggacactacagtggaagtgtgttgaatcaaaaagagacagtaagcgtctttattatggacgctttattctgtctccacttatgaaaggccaagccgacacaataggcattgcgatgcgaagagctttacttggcgaaatagaaggaacatgtattacacgtgcaaaatttgagaacataccacatgactattctaacatagcaggtattcaagaatcagtacatgaaattttaatgaatttgaacgagattgtattaagaagtaatctatatggaacgcgcaacgcgcttatttgtgtccaaggtcctggatatataactgctcgagacattattttaccgcccgctgtggaaatcattgataatacacagcatatagctaccttaacagaaccaatagatttgtgtattgaattaaaaattgagaggaatcgcggatatagtctaaaaatgtcaaataactttgaagacagaagttatcctatcgatgctgtattcatgcctgttgaaaatgccaatcatagtattcattcttatgggaatgggaatgaaaaacaagagattctttttctagaaatatggacaaatggaagtttaactcctaaagaagcacttcatcaagcctcccggaatttgattaatttatttattccttttctacatgtagaagaagaaacgttctatttagagaacaatcaacatcaagttactttacccttttttccttttcataatcgattagttaacctaagaaaaaaaaaaaaaacaaaagaactagcctttcaatatatttttattgaccaattagaattgcctcccagaatctacaattgtctcaaaaaatccaatatacatacattattggaccttttgaataacagtcaagaagaccttatcaaaattgaacattttcacgtagaagatgtaaaaaagatattagacattctagaaaaaaaatagaaaaaacatttcaaaaaaaattgactaagactaaaaagtcaatttgaaattgaaatggattttcaaatttcaacgtaatttctattttccagtcgaa

SEQ ID NO: 4441 - DNA, 1149 bp, Musa acuminata
ggaactcatagggaagaaaatggatttatggatggaatcaaatatgcagtatttacagaaaaaagtattcggttattggggaacaatcaatatacttttaatgtcgaatcaggattaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttatagagaaaagaacttaaagcaaaatacttaataacacggcgatacatttatacaaaacttctaccccgagcacacgcaatggagccgtaaacagtcaagtgaaatccaatccacgaaataatttgatctatggacagcatcgttgtagtaaaggtcgtaatgccagaggaatcattaccgcacggcatagagggggaggtcataagcgtctataccgtaaaatcgattttcgacggaatgaaaaagacatatctggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgagtccgatatgcccttaggcacggccatacataacatagaaatcacacttggaaagggtggacaattagctagagcagcaggtgctgtagcgaaactgattgcaaaagagggtaaatcggccacattaagattaccatctggggaggtccgtttgatatccaaaaactgcttagcaacagtcggacaagtgggtaatgttggggtgaaacaaaaaattttggttagacccggatcttactgttggctcaggtaagcttcctgtagtaagaggagtagttatgaaccctgtagaccatccccatgggggcggtgaggggagagccccaatcggtagaaaaaaacccacaaccccttggggttatcctgcgcttggaagaagaagtaggaaaaggaaaaaatatagtgatagttttattcttcgtcgccgtaaa

SEQ ID NO: 4442 - DNA, 1573 bp, Tabernaemontana elegans
attttttcttaattaatattatcaaaatatctcagaaatataaaatgtaaataataataagaaataaacatagtagaaacgaaattctaactaaatagaataaatattctaaatctaaataaattagcaattagaataggaaatataagaaataagtacaaatagggtgaagggggcggatgtagccaagtggatcaaggcagtggattgtgaatccaccatgcgcgggttcaattcccgtcgttcgcccatttctttttcttcttttgtgttaagtttatcaattttttgtaataaatggttggctacaaaaggatttttttttagtgaacgtgtcacagcttactcctatttttttttctttttgttttgtaaagacgaagaaaaaattcgattttctttcctatttactacggcgacgaagaatcaaattatcactatatttattcctttttctacttcttcttccaagtgcaggataaccccaaggggttgtgggtttttttctaccaattggggctctcccttcaccacccccatggggatggtctacagggttcataactactcctcttactacaggacgcttacctagccaacgcttagatccggctctacccaaacttttctggttcaccccaacattccccacttgtccgactgttgctgagcagtttttggatatcaaacggacctccccagaaggtaattttaatgtggccgatttcccctcttttgcaatcagtttcgctacagcacccgctgctctagctaattgtccaccctttccaagtgtgatttctatgttatgtatggccgtgcctaagggcatatcggtcaaaggtagggcatttcccatttttataggaacttctgtaccagaaacaatggtatctccaattatagcccctctgggatgtaaaatatatctcttctcaccatccccatagtgtatgagacaaatgtatgcatttcgattagggtcgtattctatggttacgattctaccatatatgtctttttcattccgtcgaaaatcgattttacggtatagacgcttatgacctccccctctatgccctgcggtaatgattcctctggcattacgacctttaccacaacgatgctgtccatagatcaaattatttcgtggattggatttcacttgactgtctacggttccattgcgtgtgctcggggtagaagttttgtataaatgtatcgccatgctattaagtattttgatttaagttcttttctttctaagaggtggaatagaataacccggttgaagcgtaatgatcatacgtctgtaatgcattgtatgtcccataataggtcccattcttctaccctttcccggaagtcgatgactattcatagctattaccttgacaccaaagaagagttcgacccaatgctttatttctgtcctagttgatcccgattcgacattaaaagtatattgatttttccccaataaccgaatacttttgtctgtaaatactgcatatttgattccatccataaatctattttcttccctatgagttctagtctcaataagaatgct

SEQ ID NO: 4443 - DNA, 1933 bp, Vinca minor
gaaaaaaatgtgaatgaaagatcccactgaattgaattgggtccatgaatctaagaaatagtgagaattcttgatctctctcaatatctctctcaattcgaaaatccaggatttgaattgatttcctttcattgattcctcctaaatggcattgatttatcctaaagattccatttcaattggaatttggttattcactatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattggtgtggtatattcatatcataatatatgaacagtaagaactagcattcttattgagactagaactcatagggaagaaaatagatttatggatggaatcaaatatgcagtatttacagacaaaagtattcggttattggggaaaaatcaatatacttttaatgtcgaatcgggatcaactaggacagaaataaagcattgggtcgaactcttctttggtgtcaaggtaatagctatgaatagtcatcgacttccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcatcgttgtgggaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaggtggggaatgttggggtgaaccagaaaagtttgggtagagccggatctaagcgttggctaggtaagcgtcctgtagtaagaggagtagttatgaaccctgtagaccatccccatgggggtggggaagggagagccccaattggtagaaaaaaacccacaaccccttggggttatcctgcacttggaagaagaagtagaaaaaggaataaatatagtgataatttgattcttcgtcgccgtagtaaataggagagaaaagcgaattgttttcttcggctttacaaaacaaaaagaaaaaataggagtaagctgtgacacgttcactaaaaaaaaatccttttgtagccaaccatttattaaaaaaattgagaaacttaacacgggcgaacgacgggaattgaacccgcgcatggtggattcacaatccactgccttgatccacttggctacatccgcccccttccctatatttctaagattccaaattaaatataatattaattacaaataaaaaaaagtatgatactcaaacctcagcaaactaaaagtcctttgctttctctctaatgaaaagaaagaagaaaaatttctagaaaat

SEQ ID NO: 4444 - DNA, 1572 bp, Gossypium raimondii
aagaactagcattcttattgagactcgaactcatagggaagaaaatagatttatggatggaatcaaatatgtagtagttacagacaaaagtattcggttattggtgaaaaatcaatatacttctaatgtcgaatcaggattaactaggacagaaataaagcattgggtcgaactcttctttggtgtcaaggtaatagctatgaatagtcatcgactccccggaaagggtagaagaatgggacctattatgggacatacaatgcattacaggcgtatgatcattacgcttcaaccgggttattctattccacctcttagaacgaaaagaacttaaatcaaaatacttaatagcatggcgatacatttatacaaaacttctaccccgggcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgtctataccgtaaaattgattttcgacgaaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaggggtggacaattagctagagcagcgggtgctgttgcgaaactgattgcaaaggaggggaaatcggccacattaaaattaccttctggggaggtccgtttgatatccaaaaactgctcagcaacagtcggacaggtggggaatgttggggtgaaccagaaaagtttgggtagagccggatctaaatgttggctaggtaagcgtcctgtagtaagaggagtagttatgaaccctgtagaccatccccatgggggtggtgaagggagggctccaattggtagaaaaaaacccgcaaccccttggggttatcctgcacttggaagaagaagtagaaaaaggaataaatatagtgataatttgattcttcgtcgacggagtaaataggagagattatttctttcttcgtctttacaaaaacaaaaaaatatatttttaaagtaaaaaaaatggcgcgttcactaaaaaaaaatccttttgtagcaaatcatttattaaaaaaaatcgaaaggcttaatacaaaagcggaaaaagaaataataataacttggtccagagcatctaccattatacccacaatgatcggccatactatcgctatccataatggaaaagaacatttgcccatttatataacggatcgtatggtaggacataagttgggagaattcgcacctactataaattttcgcggacacgcaaaaaatgataataaatctcgtcgttaatattattataataaattataataaaaaaaatagagattaattaatgaattcatt

SEQ ID NO: 4445 - DNA, 1306 bp, Gossypium raimondii
atatgaacagtaagaactagcattcttattgagactcgaactcatagggaagaaaatagatttatggatggaatcaaatatgtagtagttacagacaaaagtattcggttattggtgaaaaatcaatatacttctaatgtcgaatcaggatcaactaggacagaaataaagcattgggtcgaactcttctttggtgtcaaggtaatagctatgaatagtcatcgactccccggaaagggtagaagaatgggacctattatgggacatacaatgcattacaggcgtatgatcattacgcttcaaccgggttattctattccacctcttagaacgaaaagaacttaaatcaaaatacttaatagcatggcgatacatttatacaaaacttctaccccgggcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgtctataccgtaaaattgattttcgacgaaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaggggtggacaattagctagagcagcgggtgctgttgcgaaactgattgcaaaggaggggaaatcggccacattaaaattaccttctggggaggtccgtttgatatccaaaaactgctcagcaacagtcggacaggtggggaatgttggggtgaaccagaaaagtttgggtagagccggatctaaatgttggctaggtaagcgtcctgtagtaagaggagtagttatgaaccctgtagaccatccccatgggggtggtgaagggagggctccaattggtagaaaaaaacccgcaaccccttggggttatcctgcacttggaagaagaagtagaaaaaggaataaatatagtgataatttgattcttcgtcgacggagtaaataggagagattatttctttcttcgtctttacaaaaacaaaaaaatatattttaaaagtaaaaaaaatggcgcgttcactaaaaaaaaaaccttttgtagcaaatcatttattaaaaaaaat

SEQ ID NO: 4446 - DNA, 1539 bp, Gossypium raimondii
ggatgcacgccaatgggaccctccaataagtctattggaattggctctgtatcaatggaatctcatcatctatacataacgaattggtgtggtatattcatatcataacatatgaacagtaagaactagcattcttattgagactcgaactcatagggaagaaaatagatttatggatggaatcaaatatgtagtagttacagacaaaagtattcggttattggtgaaaaatcaatatacttctaatgtcgaatcaggatcaactaggacagaaataaagcattgggtcgaactcttctttggtgtcaaggtaatagctatgaatagtcatcgactccccggaaagggtagaagaatgggacctattatgggacatacaatgcattacaggcgtatgatcattacgcttcaaccgggttattctattccacctcttagaacgaaaagaacttaaatcaaaatacttaatagcatggcgatacatttatacaaaacttctaccccgggcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgtctataccgtaaaattgattttcgacgaaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaggggtggacaattagctagagcagcgggtgctgttgcgaaactgattgcaaaggaggggaaatcggccacattaaaattaccttctggggaggtccgtttgatatccaaaaactgctcagcaacagtcggacaggtggggaatgttggggtgaaccagaaaagtttgggtagagccggatctaaatgttggctaggtaagcgtcctgtagtaagaggagtagttatgaaccctgtagaccatccccatgggggtggtgaagggagggctccaattggtagaaaaaaacccgcaaccccttggggttatcctgcacttggaagaagaagtagaaaaaggaataaatatagtgataatttgattcttcgtcgacggagtaaataggagagattatttctttcttcgtctttacaaaaacaaaaaaatatatttttaaagtaaaaaaaatggcgcgttcactaaaaaaaaatccttttgtagcaaatcatttattaaaaaaaatcgaaaggcttaatacaaaagcggaaaaagaaataataataacttggtccagagcatctaccattatacccacaatgatcggccatactatcgctatccataatggaaaagaacatttgcccatt

SEQ ID NO: 4447 - DNA, 1342 bp, Petunia hybrida
gccaatgggaccctccataagtctattggaattggctctgtatcaatggaatctcatcatccatacataacgaattgatgtggtatattcatatcataatatatgaacagtaagaactagcattcttattgagactataactcgtagggaagaaaatcgatttatggatggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagtcatcgacttccgggaaagaggagaagaatgggacctattatgggacatacaatgcattacagacgtatgatcattacgcttcaaccgggttattctattccacctcttagaaagaaaagaacttaaataaaaatacttaatagcatggcgatacatttatacaaaacttctaccccgagcacacgcaatggaaccgtagacagtcaagtgaaatccaatccacgaaataatttgatctatggacagcatcgttgtggtaaaggtcgtaattccagaggaatcattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaggtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaggaataaatatagtgataatttgattcttcgtcgccgtagtaaataggagagaaaatcgaatttaattcttcgtttttacaaaaactttacaaaaaaaaaa

SEQ ID NO: 4448 - DNA, 1798 bp, Solanum tuberosum
tcttattgagactataactcatagggaagaaaatagatttatggatggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagtcatcgacttccgggaaagagtagaagaatgggacctattatgggacatacaatgcattacagacgtatgatcattacgcttcaaccgggttattctattccacctcttagaaagaaaagaacttaaataaaaatacttaatagcatggcgatacatttatacaaaacttctaccccgagcacacgcaatggaaccgtagacagtcaagtgaaatccaatccacgaaataatttgatctatggacagcgtcgttgtggtaaaggtcgtaatgccagaggaatcattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaggaataaatatagtgataatttgattcttcgtcgccgtagtaaataggagagaaaatagaatttaattcttcgtttttacaaaaactttacaaaaaaaaaataggagtaagcttgtgacacgttcactaaaaaaaaatccctttgtagccaatcatttattaaaaaaaattgataagcttaacccaaaagcagaaaaagaaataatagtaacttggtcccgggcatctaccattatacccacaatgatcggtcatactattgctatccataatggaaaagagcatttgcctatttatataacggatagtatggtaggccacaaattgggagaatttgcacctacattaaattttagaggacatgcaaaaagcgataataaatctcgtcgttaatattaataaaaaaatatggatgcttatgattcagtaataggaaacaaaccttttgctaaaaaagaaaaaacggaagtatatgctttaggtgaaatatatctatgtctgcggacaagccacaaaataattgatcaattcggggacgttctatgaggaaaccctagaaacaaaaattcagcccattcgacatgttaaccctttttaaattggtttatcggccgccccaaatgcaatttacaaatgggttccgcggaaccaatttagttttagtaagccccaaataaatg

SEQ ID NO: 4449 - DNA, 2486 bp, Solanum phureja
tctcaatatctctctcaattcgaaaatccaggatttgaattgatgtcctctcattgattcctcctaaattgcattgatttatcctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattgatgtggtatattcatatcataatatatgaacagtaagaactagcattcttattgagactataactcatagggaagaaaatagatttatggatggaatcaaatatgcagtatttacagacaaaagtattcggttattggggaaaaatcaatatacttctaatgtcgaatcaggatcaactaggacagaaataaagcattgggtcgaactcttctttggtgtcaaggtaatagctatgaatagtcatcgacttccgggaaagagtagaagaatgggacctattatgggacatacaatgcattacagacgtatgatcattacgcttcaaccgggttattctattccacctcttagaaagaaaagaacttaaataaaaatacttaatagcatggcgatacatttatacaaaacttctaccccgagcacacgcaatggaaccgtagacagtcaagtgaaatccaatccacgaaataatttgatctatggacagcgtcgttgtggtaaaggtcgtaatgccagaggaatcattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaggaataaatatagtgataatttgattcttcgtcgccgtagtaaataggagagaaaatagaatttaattcttcgtttttacaaaaactttacaaaaaaaaaataggagtaagcttgtgacacgttcactaaaaaaaaatccctttgtagccaatcatttattaaaaaaaattgataagcttaacacaaaagcagaaaaagaaataatagtaacttggtcccgggcatctaccattatacccacaatgatcggtcatactattgctatccataatggaaaagagcatttgcctatttatataacggatagtatggtaggccacaaattgggagaatttgcacctacattaaattttagaggacatgcaaaaagcgataatagatctcgtcgttaatattaataaaaaaatatagatgcttatgattcagtagtaggagacaaaccttatgctaaagaagaaaaaaacagaagtatatgctttaggtgaacatatatctatgtctgctgacaaagcacgaagagtaattgatcaaattcgtggacgttcctatgaggaaacgcttatgatactagaactcatgccctatcgagcatgttatcccattttgaaattggtttattctgcagcagcaaatgctagttacaatatgggttccaacgaaaccaatttagtcattagtaaagccgaagtcaatgaaggtactactgtgaagaaattgaaacctcgagctcgaggacgtagttttccgataaaaagatcgacctgccatataactattgtaatgaaagatatatctttagatgatgaatatggcgagatgtcttcgttaaaaaaaacgagatggaaaaaaaaatctacagctatgacgtatcgtgatatgtataatagcgggggattatgggacaaaaaataaatccacttggtttcagactgggtacaacccaaggtcatcattccctttggttttcacaacccaaaaattattctgagggtttacaagaagataaaaaaataagagattgtatca

SEQ ID NO: 4450 - DNA, 1734 bp, Nicotiana tabacum
ggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagtcatcgacttccgggaaagagtagaagaatgggacctattatgggacatacaatgcattacagacgtatgatcattacgcttcaaccgggttattctattccacctcttagaaagaaaagaacttaaaaaaaaatacttaatagcatggcgatacatttatacaaaacttctaccccgagcacacgcaatggaaccgtagacagtcaagtgaaatccaatccacgaaataatttgatctatggacagcatcattgtggtaaaggtcgtaatgccagaggaatcattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaggaataaatatagtgataatttgattcttcgtcgccgtagtaaataggagagaaaatcgaattaaattcttcgtttttacaagaaaaaaaaaaaaaaaataggagtaagcttgtgacacgttcactaaaaaaaaatccctttgtatccaatcatttattaaaaaaaattgataagcttaacacaaaagcagaaaaagaaataatagtaacttggtcccgggcatctaccattatacccacaatgatcggtcatactattgctatccataatggaaaagagcatttgcctatttatataacggatagtatggtaggccacaaattgggagaatttgcacctacattaaattttagaggacatgcaaaaagcgataatagatctcgtcgttaatattaataaaaaaaaatctagatgcttatgattcagtagtaggaggcaaaccttatgctaaagaagaaaaaaacagaagtatatgctttaggtgaacatatatctatgtctgctgacaaagcacgaagagtaattgatcaaattcgcggccgttcctatgaggaaacgcttatgatactagaactcatgccctatcgagcatgttatcccattttgaaattggtttattctgcggcagcaaatgctagttacaatatgggttccagcgaag

SEQ ID NO: 4451 - DNA, 2895 bp, Papaver somniferum
ctgctggatgcacgccaatgggaacgttcaataagtctattggaattggctctgtatcaatggaatctcatcatccatacataacgaattggtatggtatattcataccataacatatgaacagtaagaactagaattcttatcaatactggaactcatagggaagaaaatggatttatggatggaatcaaatatgcagtatttacagacaaaagtattcggttattggggaacaatcaatatacttttaatgtcgaatcaggatcaactaggacagaaataaagcattgggtcgaactcttctttggtgtcaaggtaatagctatgaatagtcatcgactcccgggaaagggtagaagaatgggacctatgggacatacaatgcattacaaacgtatgatcattacgcttcaaccgggttattctattccacctcttagaaagaaaagaacttaaaaaaaatacttaataacacggcgatacatttatacaaaacttctactccgagcacacgcaatggggccgtagacagtcaagtgaaatccaattcacgaaataatttgatctctggacagcagcgtcattgtggtaaaggtcgtaatgccagaggcatcattaccgcaaggcatagagggggaggtcataagcgtctataccgtaaaatagattttcgacgaaatgaaaaagacatatctggtagaatcgtaaccatagaatacgaccccaaccgaaatgcatacatttgtctcatacactatggggatggtgagaagagatatattttacatcccagaggggctataattggagataccattgtttctggtacagaagttcctatctcaatgggaaatgccctacctttgaccgatatgcccttaggcacggccatacataacatagaaatcacacttggaaagggtggacaattagctagagcagcaggtgctgtagcgaaactgattgcaaaagagggtaaatcggccacattaaaattaccgtctggggaggtccgtttgatatccaaaaactgctcagcaacagtcgggcaagtgggtaatgttggggtgaaccagaaaagtttgggtagagccggatctaagcgttggctaggtaagcgtcctgtagtaagaggggtagttatgaaccctgtagaccatccccatgggggtggtgaaggaagggccccaattggtagaaaacaacccacaaccccttggggttatcctgcgcttggaagaagaagtagaaaaggaataaatatagtgatagtttgattcttcgtcgacgtactaaataggagagaaaatcgagaatatgtttcttcgtctttacaaaagaaaaaaagataggagtaattagctgtgacacgttcactaaaaaaaaatccttttgttgctaatcatttattaggaaaaattgaaaagctcaacataagaggagaaaaagaaataatagtaacttggtcccgggcatctaccattatacccacaatgatcggccatacaattgctattcataatggaaaagaccatctgcctatttatataacagatcgtatggtgggtcacaaattgggagaatttgcacctactctaaatttccggggacatgcgagaagcgataataaatctcgtcgttaatgttaataataataaagtgaatatgggtgctcgtcgttcattggtgggaggttaaccttatgataaagagggacccagatgtggaagtatccgctttaggtcaacatatatgtatgtctgctcacaaagcacgaagagtgatcgatcagattcgtgggcgttcctacgaggaaacacttatgatactagaactcatgccttatcgagcatgttatcccatttttaaattggtttattcggcagcagcaaatgctagtcacaatatgggtttcaaggaaacagatttaatcattagtcaagccgaagtcaacgagggtactatcgtgaaaaagttaaagcctcgagctcgaggacgtagttatccgatcaaaagacccacctgtcatataactattgtattgaaagatatatctaaagatcaagactatttcatatggttaagaaaaactggatatgtatatatagataaatatacggatgttagagagaggtatctatgtatggtagagcacgaaagactaaaatgggctaatgaagaaagcgaagaaagcgagggtgtatgggacaaaaaataaatccacttggttttagacttggtacaacccaaaagcaccattccctttggtttgcacaaccaaaaagttattctgagggtctacaggaagatcaaaaaatacgggattgtatcaagaattatgtacaaaaaaatatgagaatatcttcgggtgtagagggaattgcgcgtatagagattaaaaaaagaatcgacctggtccaagtcataatctatatgggatttccaaaatggttaatagagggtaaaccgagaggaattgaagaattacagatcaatgtacaaaaaggttttaattctgtgaaccgaaaactcaacattgctattacacgaattgcaaaaccctatggagaccctaatattcttgcggaatttatagctgggcaattaaaaaatagagtttcatttcgaaaggcaatgaaaaaagctattgaattaactgagcaagcagatacaaaaggaattcaagtacaaattgcaggacgtattgacggaaaagaaatagcacgtgtcgaatggatcagagaaggtagggttcccctacaaaccattcgagctaaaattgattattgttcgtatacagttcggactatttatggggtattaggcataaaaatttggatatttgcagacgagaaataatcaaagatttcttctttgacttttctatctagcaca

SEQ ID NO: 4452 - DNA, 1245 bp, Catharanthus roseus
attcatatcataatatatgaacagtaagaactagcattcttattgagactagaactcatagggaagaaaatagatttatggatggaatcaaatatgcagtatttacagacaaaagtattcggttattggggaaaaatcaatatacttttaatgtcgaatcgggatcaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcatcgttgtgggaaaggtcgtaatgccagaggaatcattaccgcagggcatagagggggaggtcataagcgtctataccgtaaaatcgattttcgacgaaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaggtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaaacccacaaccccttggggttatcctgcacttggaaaaagaagtagaaaaaggaataaatatagtgataatttgattcttcgtcgccgtagtaaataggagagaaaatcgaatttttttcttcgtcttcacaaaacaaaaa

SEQ ID NO: 4453 - DNA, 1675 bp, Solanum melongena
aatatatgaacagtaagaactagcattcttattgagactataactcatagggaagaaaatcgatttatggatggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagtcatcgacttccgggaaagagtagaagaatgggacctattatgggacatacaatgcattacagacgtatgatcattacgcttcaaccgggtcattctattccacctcttagaaagaaaagaacttaaataaaaatacttaatagcatggcgatacatttatacaaaacttctaccccgagcacacgcaatgaaaccgtagacagtcaagtgaaatccaatccacgaaataatttgatctatggacagcgtcgttgtggtaaaggtcgtaatgccagaggaatcattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaggaataaatatagtgataatttgattcttcgtcgccgtagtaaataggagagaaaatcgaattgaattcttcgtttttacaaaaactttacaaaaaaaataggagtaagcttgtgacacgttcactaaaaaaaaatccctttgtagccaatcatttattaaaaaaaattgataagcttaacacaaaagttatgggcgaacgacgggaattgaacccgcgcatggtggattcacaatccactgccttgatccacttggctacatccgccccctcccctactgatgacattccatttttacattattgaaattagaaaacaaaagatttaagttcgaatatttctcttctttcttatttcacttatttcaatgatagtattatttcgattattatttcaaagatatgaaagatatgaggtcaaaattggattttttatgtgaaatgcaataaaaagatatagtaacattagcaacaagaggaacaagttatatttctttgaaataaatagaaaatcaaaatcgaatactcaat

SEQ ID NO: 4454 - DNA, 1463 bp, Vitis vinifera
ggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatagagccgtagacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaggtgggaaatgttggggtgaaccagaaaagtttgggtagagccggatctaagtgttggctaggtaagcgtcctgtagtaagaggagtagttatgaaccctgtagaccatccccatgggggtggtgaggggagagccccaattggtagaaaaaaacccacaaccccttggggttatcctgcacttggaagaagaagtagaaaaaggaataaatatagcgataatttgattcttcgccgccgtagtaagtagtaaataggagagaaaatagaatttgtttcttcgtctttacaaaaaaaaaaaaaaaataggagtaattaactgtgacacgttcactaaaaaaaaatccttttatagcaaagcatttattaagaaaaattgctatgcttaacacaacgtgggaaaaagaaataatagtaacttggtcccggacatctaccattatacccacaatgatcggccatactattgctgtacataatggaaaggagcattttcctatt

SEQ ID NO: 4455 - DNA, 1072 bp, Heritiera littoralis
gtcgaatcaggatcaactaggacagaaataaagcattgggtcgaactcttctttggtgtcaaggtaatagctatgaatagtcatcgactccccggaaagggtagaagaatgggacctattatgggacatacaatgcattacaggcgtatgatcattacgcttcaaccgggttattctattccacctcttagaacgaaaagaacttaaatcaaaatacttaatagcatggcgatacatttatacaaaacttctaccccgggcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgtctataccgtaaaatcgattttcgacgaaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaggggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaaatgttggctaggtaagcgtcctgtagtaagaggagtagttatgaaccctgtagaccatccccatgggggtggtgaagggagggctccaattggtagaaaaaaacccgcaaccccttggggttatcctgcacttggaagaagaagtagaaaaaggaataaatatagtgagaattgcattcttcgtcgccgtagtaaataggagagaaaatttctttcttcgt

SEQ ID NO: 4456 - DNA, 4569 bp, Raphanus sativus
atagagatttttgctttcgaccatatttcgattgttaatacgatatagaagggccgctactacaaatagtagtacacccttgatcgtgaaatatcgattgcttgttgaaccctgtgaattgcgcaaaagtaggatactaaaaattcgagggtccaagagttttctaaaacgttcttggtggaaaaaaatatgaatgaaagaacccactgaattgatttgggtccatgaatctaagaaatagtgagaattcttgatctctctcactatttctctcaattcgaaaatccaggatttgaattgatgtcctttcattgatttctcctaaattgcattgatttatcctaaagatttcatttcaattggaatttggttattcaccatgtacgaggatccccactaagcatccatggctgaatggttaaagcgcccaactcataattggcgaattcgtaggttcaattcctactggatgcacgccaatgggaccttccaataagtctattggaatcggctctgtatcaatggaatcttctcatcatctatacataacgaattggtgtggtatattcatatcataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatgggcagcatcattgtggtaaaggtcgtaatgccagaggaatcattaccgtaaggcatagagggggaggtcataagcgtctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaaacccgtaaccccctggggttatcctgcgcttggaagaagaactagaaaaaggaaaaaatatagtgagactttgattcttcgtcgccgtagtaaataggagagaaaatagaatttctttcttcgtcttaaaaaaaaataggagttaattaactgtgacacgttcactaaaaaaaaaatccttttgtagcaaagcatttattaagaaaaatagagaagcttaatacaaaggcggaaaaagaaatcataataacttggtcccgggcatctactattatacccacaatgattggccatactatcgctatacataatggaagggaacacttacccgtttatataatcgaccttatggtaggacataaattgggagaattttcacctactataaattttcgaggacacgcgaaaaatgataatagatctcgtcgttaattaaatgaattcaaaaaaatgaataatgaatataaatttttttttagtgagaggtaaaccttatgataaagaagaaaaagaagaaatcatatacttccgtatatgctttagggcaatatatatctatgtctgcccacaaagcacggagagttattgatcagatccgtggacgttcctacgaagaagcacttatgatattagaacttatgccgtatcgaggatgttatcccatttttaaattagtttattctgcagcagcaaatgctagtcacaataagggtttcaaagaaaccaatttagtcattagtaaagctgaagtgaatcaaggaaatacggtgaaaaaattaaaacctcgggcacgaggacggagtttcccaataaaaagatccacttgtcatataactatcgtattggaagatatatccttatatcaacaatatgaagaatatttaatgtattttaaaaaacctggatgcagcaatgaaaacataaatctaacatgttacgatacatatagtagtggaggcctatgggacaaaaaataaatccacttggtttcagacttggtacaacccaaagtcatcattctatttggtttgcacaaccaaaaaagtattctgaaggtttagaagaagataaaaaaatacgagactgtattaaaaattatgtccaaaaaaatataagaatatcctctggtatggagggaattgcacgtatcgaaattcaaaaaagaatcgatctcgttcagatcataatctatatgggatttcctaaattattaattgaagataaaccccgaagaatcgaagaattacagatgaatgttcaaaaagaacttaattgtgccaatagaaaactcaacattgctattacccgaatttccaatccgtatgggcatcctaatattcttgcagaatttatagctggccaattaaaaaatcgtgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggttttaggaataaaaatttggatattcgtagacgaagaataaaaaaactttatttgtctttacattttatccaatgataaaaaacgaaaactatatagtataacactataaagaaataaaaaaagaaataaaaataaaaacttgtagtcttcttttttatgtttaagaaaaaaaataagcaattctataaggttgaataaacatttccatcaaaactcctttgatataattgctatgcttagtgtgtgactcgttggtttagggttagattacgataaaaaaaaaagaacttacctataagagcaactaataactacagcattaataaataacctaagcaactcattgcttcgcattatctggatccaaaaaattagtcaagatatgataggctgatcatatcattggagcaactgactaaaaaaaaaaaaagaataaagaaagatgattattaagttatgaaaggtaatcaaaaagtatgcggataaatggaaggatgaaagaaagagcgaaaaaattgaatattaatgatatatgattccaatttggaaaatctatgaggtcactgtaagaaaagcaatgtaataaagcatcaatacagattcattcataataattagataaatctgttccgaaaacaaaaaattaagagccttgagccaataaaaactgagaaaattgcctcaaaaaaaaaaatgaaattcaaaatttcatgtaaaagctccattgtagaattcaggcctaatgattaatcaagaagcgatgggaacgacggaacccatgaatatataggattctagtgaacaagaaatcttagtaattcattggacaggatggcggaataaaccagaaactttattatctattctgatttctgattttgattctgagacctcggggtataaacagcaaacttaaatagatattgaaagagtaaatattcgccggcgaaaaattggtttttttttttcaaataaaaaaagtaataaaagatgaaaaaaacaatgaaaaaaataaaataaggatttgttataatattctaactctaacaaaaattacatttgtaatgatgatattacgttatttttaaataaatcgaaataaaattgatctttgattctatttaaaaaaagacatacacaaatttagaagagataagatgaaataaaaaaaaataccatgattaataggattaatcattaactacatctatatcttaattaatccttttattcgcgaggagctggatgagaagaaactctcacgtccagttctgcagtagagatggaatttctcatttagaaaaaacccatcaactataac

SEQ ID NO: 4457 - DNA, 825 bp, Cucumis sativus
atggcgatacatttatacaaaacttctaccccgagcacacgcaatggagccgtagacagtcaagtaaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaaaagatatattttacatcccagaggggctataattggagataccattgtttctggtacagaagttcctataaaaatgggaaatgccctacctttgaccgatatgcccttaggcacggccatacataacatagaaatcacacttgggaaggggggacaattagctagagcagcaggtgctgtagcgaaactgattgcaaaagaggggaaatcggccacattaaaattaccttctggggaggtccgtttgatatccaaaaattgctcagcaacagtcggacaagtggggaatgctggggtaaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataa

SEQ ID NO: 4458 - DNA, 957 bp, Panax ginseng
atggcgatacatttatacaaaacttctaccccgagcacacgcaatcgagccgtagacagtcaagtgaaatccaatccacgaaataatttgatctatggacagcatcattgtggtaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacgtggaaagggtggacaattagctagagcagcgggtgctgtagcgaaactgattgcaaaagaggggaaatcggccacattaaaattaccttctggggaggtccgtttgatatccaaaaactgctcagcaacggtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagggccccaattgggagaaaaaaacccacaaccccttggggttatcctgcacttgggagaagaagtagaaaaaggaataaatatagtgataatttgattcttcgtcgccgtagtaagtaggagagaaaatagaatttatttcttcgtctttacaaaaaaaataggagtaagctgtgacacgttcactaaaaaaaaatccttttgtagcaaatcgtttattaagaaaaattgataagcttaacacaaaagcat

SEQ ID NO: 4459 - DNA, 1905 bp, Papaver somniferum
aaaaaaatacttaataacatggcgatacatttatacaaaacttctactccgagcacacgcaatggggccgtagacagtcaagtgaaatccaattcacgaaataatttgatctctggacagcgtcattgtggtaaaggtcgtaatgccagaggcgtcattaccgcaaggcatagagggggaggtcataagcgtctataccgtaaaatagattttcgacggaatgaaaaagacatatctggtagaatcgtaaccatagaatacgaccccaaccgaaatgcatacatttgtctcatacactatggggatggtgagaagagatatattttacatcccagaggggctataattggagataccattgtttctggtacagaagttcctatctcaatgggaaatgccctacctttgaccgatatgcccttaggcacggccatacataacatagaaatcacacttggaaagggtggacaattagctagagcagcaggtgctgtagcgaaactgattgcaaaagagggtaaatcggccacattaaaattaccgtctggggaggtccgtttgatatccaaaaactgctcagcaacagtcgggcaagtgggtaatgttggggtgaaccagaaaagtttgggtagagccggatctaaacgttggctaggtaagcgtcctgtagtaagaggggtagttatgaaccctgtagaccatccccatgggggtggtgaaggaagggccccaattggtagaaaacaacccacaaccccttggggttatcctgcgcttggaagaagaagtagaaaaaggaataaatatagtgatagtttgattcttcgtcgacgtactaaataggagagaaaatcgagaatatgtttcttcgtctttacaaaagaaaaaaagataggagtaattagctgtgacacgttcactaaaaaaaatccttttgttgctaatcatttattaggaaaaattgaaaagctcaacataagaggagaaaaagaaataatagtaacttggtcccgggcatctaccattatacccacaatgatcggccatacaattgctattcataatggaaaagaccatctgcctatttatataacagatcgtatggtgggtcacaaattgggagaatttgcacctactctaaatttccggggacatgcgagaagcgataataaatctcgtcgttaatgttaataataataaagtgaatatgggtgctcatcgttcattggtgggaggttaaccttatgataaagagggacccagatgtggaagtatccgctttaggtcaacatatatgtatgtctgctcacaaagcacgaagagtgatcgatcagattcgtgggcgttcctacgaggaaacacttatgatactagaactcatgccttatcgagcatgttaccctatttttaaattggtttattcggcagcagcaaatgctagtcacaatatgggtttcaaggaaacagatttaatcattagtcaagctgaagtcaacgaggggactatcgtgaaaaagttaaagcctcgagctcgaggacgtagttattcgatcaaaagacccacctgtcatataactattgtattgaaagatatatctaaagatcaagactatttcatatggttaagaaaaactggatatgtatatatagataaatatacggatgttagagagaggtatctatgtatggtagagcacgaaagattaaaatgggctaatgaagaaagcgaagaaggcgagggtgtatgggacaaaaaataaatccacttggttttagacttggtacaacccaaaagcaccattccctttggtttgtcacaaccaaaagttaattctgagggtctacaggaagatcaaaaaataacggatgtatacagaattatgtaacaaaaaaataaactaggta

SEQ ID NO: 4460 - DNA, 4185 bp, Silene vulgaris
ataccgcgagaggtagaaagaattacaattcctattccgcctaaaattctaggaattccttgagagttagaatagattcgtagaccgggtcgactgactctttttaaatataaagtatttcgatatgggcctttcctatttcttctatgtcgcagagttaaaactaaaaagtatttttttccttcttgatgttttctcacgttttcaataaagccttctcgtaaaagtattttaacaatgttttcggtgatgttagtcgatgctattcgaactgttccttttctattcatgtcagcatttcgtatcgaggttattatatcagcaatagtatccctacccataatgaactaaaatccgcggtgtctccaaatttttatataatcaacatgttttttattacttttgtcttttattttctgttatgaattacaaaacgaaaaatttttaaacgaaagatatatacgtgatagatagtctactatactcattcaaatattctatttcttgttcttataatacctcaggagctaatgaaactattttagtaaagttttgtctcaattcgcgggcaattgcgccaaaaaactcgagttccttttggatttccttcttgatcaataataactgcagcgttgtcatcatatcttattatcataccgttgtctcgtttgagttctttacaggtacgtacaattacagctcttattacttctgatctttctaagggtgaattgggtattgcttctttgatcacagcaacaataacatccccaatacgagcatatcgacgattgctagctcctatgattcgaatacacatcaattttttagctctactgttgtctgctacagtcaaataggtctgaggttgaatcatatttttttatctgttctttcaatgcaaaaataactgcaaaggactaaaaataaatattgtttgtcaaaaataagatcgatttcctttggttctacattcctatcctgaaataataaattgagttcgtataggcattttagatgccgctattgagacagcccttcgggctatattttctgctaccccgcttatttcataaagtattcgacctggtttgacaacagctacccaatattcgggagatcctttccccgaacccatacgggtttccgcaggccttagtgtaaccggtttgtctggaaaaatacgtacccatatttttcccccacggcgcgcatttcgtgtcattgctcgcctccccgcttctatttgtctagatgtgatccaagagggttcgagtgcctgaagagcatatcttccaaaacaaattttatttccgcgataagatatccccttcagtcttcctcgatgttgtttgcggaatctggttctttttggactaagcatagcaatttgatcaaaaaaagatgaattaaaattttatttaaccttgtgaaattttaaattagaattagtttgatagtaaaaaaaggaaaagttgttattttgtgttccattcttaaatcttaaaccgaaaaataaagacaagtaaagtcctattattattttgtgtctataaatatccaaattttgatacctaataccccataaatagttcgaacggtataggcacaataattaattttcgcgcgaatggtttgtaggggaactcttccctctcttatccattcaatacgtgcaatttcttttccatctatccggcctgctatttgtatttgaattccttttgtatccgcttgttcggttaattcgatagcctttttcatggcttttctaaatgataccctattctttaattggccagctataaattcagcaagaatattagggtgcccataaggttttgcaattcgtgaaatagcaatgttgagttttcggctcacacaatttaattctttttgtaaatttatttttaggtcttcgattcctcgtggtctattttctattaataactttgggaatcccatatagattattacctgtatcagatcaactcttttttgaatttctatacgtgcaattccttcgacacccgacgatgctcttgtatttttttgtacaaaattttttatataatcccgtattttttgatcttcttgtagaccttcagaatagttttttggttgtgcaaaccaaagggaataatgactttgggttgtaccaagtcggaaaccaagtggatttattttttgtcccatattaccccatcatacttactttaaaaaaaatccaggtattcggcaaatgctggattgagcaagactttatgttgattagttttagataaacttcgtatacattcttctatgtctccatagtaggttatatcttttaatacaatagttatgtgacaagtcggcctttttatcagataactacgccctcgtgcttgaggttttaattttttcatggtagttcctttgttaacttcggctttaaaaatgactaaatcggctttgttgaaacctttattgtgactagcatttgatgctgcagaataaatcaatttaaaaatgggataacatgcacgatagggcatgagttctaatatcataagtgtttcttcgtaggaacgcccgcggatctggtcaattactcttcttgctttgtgagccgacatagatatatattggcctaaagcatatacatcatctttcctcttttttcttttcataaagtttacctccgattaaaaaatgataagcatttattatattattttttattaaaaattcgtttattaataattaataaaattaacggcgagatttattatcgttttttgcatgtcccctaaaatttagagttggtgcgaattctcctaatttatgacctaccatacgatccgttatgtaaataggtaagtgttccctaccattatggatagcgattgtatgtccaatcatggtgggtataatggtagatgcccgagaccaagttactattatttctttttccgcttttgtgttaagcttatcaatttttcgtaataaatgattggctacaaaaggatttttttttagtgaacgtgtcacagttaattactcctaaaaatttttttatgtaaagaggaagagactaattctatttactacgtcgacgaataataaaattatcactatatttattcctttttctacttctttttccaagtgcaggataaccccaaggggttgtggggttttttctcccaattggagccctcccttcaccacccccatggggatggtctacagggttcataacgactcctcttactacaggacgcttacctagccaacgcttagatccggctctacccaaacttttctggttcactccaacattccccacttgtccgactgttgctgagcagtttttggatatcaaacggacctccccagaaggtaattttaatgtggccgatttcccctcttttgcaatcagtttcgctacagcacccgctgctctagctaattgtccaccctttccaagtgtgatttctatgttatgtatggccgtgcctaagggcatatcggtcaaaggtagggcatttcccatttttataggaacttctgtaccagaaacaatggtatctccaattatagcccctctgggatgtaaaatatatcttttttcaccatccccatagtgtatgagacaaatgtatgcatttcgattagggtcatattctatggttacgattctaccatatatgtctttttcattccgtcgaaaatctattttacggtatagacgcttatgacctccccccctatgccttgcggtaatgattcctctggcattacggcctttaccacaacgacgctgtccatagatcaaattatttcgtggattggatttcacttgattgtctacggctccattgcgtgtgctcggggtagaagttttgtataaatgtatcgccatgttattaagtatttttattgaagttattttctttctaagaggtggaatagaataacccgattgaagcgtaatgatcatacgtctgtaatgcattgtatgttccataataggtcccattcttctaccctttcggaggagtcgatgactattcataactattaccttgacaccaaagaagagttcgacccaatactttatttccgtcctagttgattcgaattcgacattagaagtatattgctttttccccaataaccgaatacttttgtctgtaaata

SEQ ID NO: 4461 - DNA, 1171 bp, Brassica napus
gataaaaaaaaatattgctgcgtgtttattttagacaatacaaacaagatatgatgtatagtagagtaggggcggatgtagccaagtggattaaggcagtggattgtgaattcaccatcgcgggttcaattcccgtcgttcgcccgtgatgcccgggaccaagttattatgatttctttttccgcctttgtattaagcttctctatttttcttaataaatgctttgctacaaaaggatttttttttagtgaacgtgtcacagttaattaactcctattttttttaagacgaagaaagaaattcgattttctctcctatttactacggcgacgaagaatcaaagtctcactatattttttccttttctagttcttcttccaagcgcaggataaccccagggggtttacggttttttctaccaattggagccctcccttcaccacctccatgggggtggtcgacagggttcataactactcctcttactacaggacgtttacctagccaacatttcgatccggctctacccaaacttttctggtttaccccaacatttcccacttgtccgactgttgctgagcagtttttggatatcaaacggacctctccagaaggtaattttaatgtggccgatttcccctcttttgcaatcagtttcgctacagcacccgctgctctagctaattgtccaccctttccaagtgtgatttctatattatgtatggccgtgcctaagggcatatcggtcaaaggtagggcatttcccatttttataggaacttctgtaccagaaacaatggtatctccaattatagcccctctgggatgtaaaatatatctcttctcaccatccccatagtgtatgagacaaatgtatgcatttcgattagggtcgtattctatggttacgattctaccatatatgtcttttgtatttcgtcgaaaatctattttacggtatagacgcttatgacctccccctctatgccttacggtaatgattcctctggcattacgacctttaccacaatgatgctgcccatagatcaaattatttcgtggattggatttcacttgactgtctacggctccattgcgtgtgctcggggtagaagttttgtataaatgtatcgccatgctattaagtattttgatttaagttcttttcttt

SEQ ID NO: 4462 - DNA, 7696 bp, Arabidopsis lyrata
gtatcaatggaatcttctcatcatctatacataacgaattggtgtggtatattcatatcataacatatgaacagtaagaactagcattcttattgagactagaactcatagggaagaaaatctatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatgggcagcatcattgtggtaaaggtcgtaatgccagaggaataattaccgcaaggcatagagggggaggtcataagcgtctataccgtaaaatagattttcgacgaaatgcaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcaaaatgttggctaggtaaacgtcctgtagtaagaggagtagttatgaaccctgtcgaccatccccatggaggtggtgaagggagggctccaattggtagaaaaaaacccgtaaccccctggggttatcctgcacttggaagaagaactagaaaaaggaaaaaatatagtgagactttgattcttcgtcgccgtagtaaataggagagaaaatagaatttctttcttcgtcttaaaaaaataggagttaattaactgtgacacgttcactaaaaaaaaacccttttgtagcaaagcatttattaagaaaaatagagaagcttaatacaaaggcggaaaaagaaatcataataacttggtcccgggcatccaccattatacccacaatgattggccatactatcgctattcataatggaagggaacacctacccgtttatataatagatcttatggtaggacataaattaggagaattttcacctactataaattttcgaggacatgcgaaaaatgataatagatctcgtcgttaattaaatgaattaaaaaaaatgaatatagattttttttgagtgagaggtaaaccttatgataaagaagagaaagaagaaatcatatacttccgtatatgctttagggcaatatatatctatgtctgcccataaagcacggagagttattgatcaaatacgtggacgttcctacgaagaagcacttatgatattagaacttatgccttatcgaggatgttatcccatttttaaattggtttattctgccgcagcgaacgctagtcacaataagggtttcaaagaaaccaatttagtcattagtaaagctgaggtgaaccaaggaaatactgtgaaaaaattaaaacctcgtgcccgaggacgaagttacccaataaaacgatccacttgtcatataactatcgtattggaagatatatccttctatcaacaatatgaagaatatttaatgtatttaaaaaaacctggatgcagcaatgaaaacagaaatctaacatgttatgatagatatagtagtggaggcctatgggacaaaaaataaatccacttggtttcagacttggtacaacccaaagtcatcattctctttggtttgcacaaccaaaaaagtattctgaaggtttagaagaagataaaaaaatacgagactgtattaaaaattatgtccaaaaaaatataagaatatcctctggtatggagggaattgcacgtatcgaaattcaaaaaagaatcgatctcatccagatcataatctatatgggatttcctaaattattaattgaagataaaccccgaagagtcgaagaattacagatgaatgttcaaaaagaacttaattgtgtcaatagaaaactcaacattgctattaccagaatttccaatccgtatggggatcctaatattcttgcagaatttatagctggacaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggtcttaggaataaaaatttggatattcgtagacgaagaataaaaaaactttctttatctttacattttatccgatgataaaaaacgaaaactatgtagtataacactatacagtaataaaaaattgcagtcttcttttttatgtttaagaataaaatcagcaattctataagattgaataaaaatttccatcaaaactactttgatataattgctatgcttagtgtgtgactcgttggtttaggattagattaagataaaaaaaaaagaaaaaagaacttacaaactaataactatagcattaataaataacctaagcaactcattgcttcacattatctggataaaaaaatcagtcaagatatgatagattgatcatatcattgtagcaactgaaaaaaaaataaagaaatatgattataaattatgaaaagtaatcgaaaggtatgcggataagtggaaggatgaaagaaagaaagaaaaaattgaatattaatgatatattattccaatttggaaagtctatgaggtcactgtaagaaaagcaatgtaatacagcatcaatacagattcattcataataattagataaatctgttccgaaaacaaaaaaaaaattaagagccttgagccaataaaaactgagaaaattgactcaaaaacaaattaaaaaatgaaattcccaatttcatataagagctccattgtagaattcgggcctaatgattaatcaagaagcgatgggaacgacggaacccatgaatatagaggattctattgaaaaacaaatcttagtaattcattggacaggatggcggaataaaccagaaactttattatctagtcttatttttattcagagatctcctgggataaacatcaaacttaatatagatattgaaagagtaaatattcgccagcgaatctttttttttttaataaaagtaataaaatacgaaaaaaaatttaaaaagataaaagaaaataaggatttgttagaatattctaacgctaataaaaacgacattcgagatgatgatattacgttatttttaaataaatagaattcatcttggattcgatttcgaaaaagacatacacaaatttagaagagatcagatgaaatttaataccatgattaatagaattaatcattaactacatctatatcttttttattccttttattcgcgaggagctggatgagaagaaactctcacgttcagttctgtagtagagatggaatttctaatttagaaccatcaactataacccaaaaagaaccagatttcgtaaacaacatcgaggaagactaaaaggaatatcttctcgtgggaatcgtatttgttttggcagatatgctcttcaaacacttgaacccgcttggatcacatctagacaaatagaagcagggcgacgagcaatgacacgaaatgtacgacgtggtggaaaaatttgggtacgtatatttccagacaaaccagttacagtaagacctgcggaaacgcgtatgggttctgggaaaggatcccccgagtattgggtagctgtggttaaaccaggtaaaatcctttatgaaatgggtggtgtacccgaaaatatagccagaaaagctatttcaatagcggcatcaaaaatgcctataaaaacccaattcattatttctgaataggaatatagaatgaaaaagctaaataacatttaaggataaaaagattatcaattttatttttttgacaaacaatatttttttacttcgtcctttgcattaaaagaagagatacaaaaaaaatgatatgattcaaccacaaacctatttgaatgtagcagacaacagcggggctcgagaattgatgtgtattcgaataataggagctagtaatcgccgatatgctcatattggtgacgttattgttgctgtaatcaaagaagcaataccaaatactcctctagaaagatcagaagtgattagagctgtaattgtacgtacttgtaaagaactcaaacgtaataatgggacgataatacgatatgatgacaatgccgcagttgtcattgatcaagaaggaaatccaaaaggaactcgagtttttggggcgatcccacgggaattgagacaattaaactttactaaaatagtttcattagctcctgaggtattataagatctaaatatcgatagtttagtataggattaaaaaaactggtattgaaataaaattaattaatagattgtgtatcacgcatatacccttaataataaaatattaagaatttaattcatatattaatatataattcgtctatatctatatataaataaaagaaaaagaacatgttgattatatcaaaattatagaacaataaggaattttaacttatcatggggaaagacactattgctgatataataacctctatacgaaatgctgacatgaatagaaaaggaacggttcggataggatcgactaacatcaccgaaagtattgttaaaatccttttacgagagggttttatcgaaaacgtaaggaaacatcgcgaaagcaaccaatattttttgattttaaccctaagacacagacgaaataagaaagaatcctataaaacgattttaaatttaaagagaataagtcggccgggtctacgaatctattctaactctcaacgaattccacgaattttaggcggaataggaattgtaatcctttcgacttctcaaggtataatgacagaccgagaagctcgactaaaaagaatcggcggagaaattttgtgttatatatggtaatccttctaatataaaaattacatatctggaacttacgatttgtgaaaaaaagggggttgtgtaataccacccctgttcaaaaaagtttcggatgttttacttcgaatgaaattaaagaaaaaatgaattaatgaaagttttctttctgaatcacttccgaacggcatggttcgattttgtttagatactaaaaatttttttttagttcatgcttctgaaaggattcgacatatttttgtataggtatacctataggagaaaaaggtaaaatttttagtaagttcttaggtataagttaatcaggggacagccattttctagactccataacaaggattcaaataagtaagtggttttttcaatttcaaccattcctttcacgaagatacaattcaagattcaaaaatatcaagaaacctttttttcgtccaccaataaatatattcacagaattaaggaataacaactatgaaaataagggcttccgttcgtaaaatttgtgaaaagtgtcgactaatccgcaggaggggacgaattatagtaatttgttccaacccgaggcataaacaaagacaaggataatcttactaaaggaaaaggcacttccaaagagttggaaaaaagggtctgttttgacatgaaatggatatatccatatatttcttgtgaaatgaaaaaatatggcaaaacctatattaagaattggttcgcgtaaaaatacacgtagtggttcacgtaaaaatgtacgtagaataccaaagggagttattcatgttcaagcaagtttcaacaataccattgtgaccgttacagatgtacggggtcgggtgatttcttggtcctccgcgggtacttgtggattccggggtacaagaagaggaacgccttttgctgcccaaaccgcagcaggaaatgctattcgagcagtagtggatcaaggtatgcaacgagctgaagtaaggataaaaggccctggactcggaagagatgcagcattacgagctattcgtagaagcggtatacttttaagtttcgtacgagatgtaacccctatgccacataatggttgtagaccccctaaaaaaagacgtgtatagaactaaataaaggctgaaagggtttcaagagaaataaacgattcaatgatctgatcaaataaaattactatggttcgagagaaagtcaaagtatctactcggacactacagtggaagtgtgttgaatcaaaaagagacagtaagcgtctttattatggacgctttattctgtctccacttatgaaaggtcaagccgacacaataggcattgcgatgcgaagagctttacttggcgaaatagaaggaacatgtattacacgtgcaaaatctgagaacataccacatgactattctaacatagtaggtattcaagaatcagtacatgaaattttaatgaatttgaacgagattgtattaagaagtaatctatatggaacgcgcaacgcgcttatttgtgtccaaggtcctggatatataactgctcgagacataattttaccgccctctgtagaaatcattgataatacacagcatatagctaccttaacggaaacaatagatttgtgtattgaattaaaaatcgagaggaatcgcggatatagtctaaaaatgtcaaataactttgaagacagaagttatcctatcgatgctgtattcatgcctgttgaaaacgcgaatcatagtattcattcttatgggaatgggaatgaaaaacaagagattctttttctagaaatatggacaaatggaagtttaactcctaaagaagcacttcatgaagcctcccggaatttgattaatttatttattccttttctacatgtagaagaagaaacgttctatttagagaacaatcagcatcaagttactttacccttttttccttttcataatagattagttaacctaagaaaaaaaacaaaagaactagcctttcaatatatttttattgaccaattagaattgcctcccagaatctacaattgtctcaaaaagtccaatatacatacattattggaccttttgaataacagtcaagaagaccttatcaaaattgaacattttcacgtagaagatgtaaaaaagatattagacattctagaaaaaaaatagaaaaagcattcaatttcaaattgaaa

SEQ ID NO: 4463 - DNA, 1126 bp, Antirrhinum majus
cggcacgagcggttattgggggaaaaatcaatatacttttaatgtcgaatcaggattaactaggacagaactaaagcattgggtcgaactcttctttggtgtcaaggtaatagctatgaatagtcatcgacttccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcatcattgtggtaaaggtcgtaatgccagaggaatcattaccgcaaggcatagagggggaggtcataagcgtctataccgtaaaatcgattttcgacggaatgaaaaagacatatatggtagaatcgtaaccatagaatacgatcctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagttagagcagcaggtgctgtagcgaaactgattgcaaaagaggggaaatcggccacattaaaattaccttctggggaggtccgtttgatatccaaaaactgctcagcaacagtcggacaagtggggaatgttggcgcgaaccagaaaagtttgggtagagccggatccaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaggaataaatatagtgataatttgattgttcgtcgccgtagtaaataggcgagaaaattgaacttctttcttcgtctttac

SEQ ID NO: 4464 - DNA, 8903 bp, Malus domestica
tttttgtttttatttcttttttgtaaagacgaagaaacaaattctattttctcgcctatttactacggcgacgaagaatcaaattatcactatatttattcctttttctacttcttcttccaagtgcaggataaccccaaggggttgcgggtttttttctaccaattggggccctcccttcaccacccccatggggatggtctacagggttcataactactcctcttactacaggacgcttacccagccaacatttagatccggctttacccaaacttttctggttcaccccaacattccccacttgtccgactgttgctgagcagtttttggatatcaaacggacctccccagaaggtaattttaatgtggccgatttcccctcttttgcaatcagtttcgctacagcacctgctgctctagctaattgtccaccctttccaagtgtgatttctatgttatgtatggccgtgcctaagggcatatcggttgaagtagggcatttcccatttttataggaacttctgtaccagaaacaatggtatctccaattatagcccctctgggatgtaaaatatatcttttctcaccatccccatagtgtatgagacaaatgtatgcatttcgattagggtcgtattctatagttacgattctaccatatatgtctttttcattccgtcgaaaatcgattttacggtatagacgcttatgacctccccctctatgccctgcggtaatgattcctctggcattacgacctttaccacaacgatgctgtccatagatcaaattatttcgtggattggatttcacttgactgtctacggctccattgcgtgtgctcggggtagaagttttgtataaatgtatcgccatgctattaagtattttgatttaagttcttttctttctaagaggtggaatagaataacccggttgaagcgtaatgatcatacgtctgtaatgcattgtatgtcccataatagttcccattcttctaccctttccggggagtcgatgactattcatagctattaccttgacaccaaagaagagttcgacccaatgctttatttctgtcctagttgatcctgattcgacattagaagtatattgatttttccccaataaccgaatacttttgtctgtaaatactgcatatttgattccatccataaatctattttcttccctatgagttctagtctcaataagaatgctagttcttactgttcatatgttatgatatgaatataccacaccaattcgttatgtatggatgatgagattccattgatacagagccaattccaatagacttattggagggtcccattggcgtgcatccagtaggaattgaacctacgaattcgccaattatgagttgggcgctttaaccattcagccatggatgcttagcggggatcctcgtacatggtgaataaccaaattccaattgaaatgaaatctttaggataaatcaatgcaatttaggaggactcaatgaaaggacatcaattcaaatcctggattttcgaattgagagagatattgagagagatccagaattctcactatttcttagattcatggaccaaattcaattcagtgggatcttttattcacatttttttccatcaagaacgttttataaaactcttggactcccgaatttggagtatcctactttcacgcaattcacatttacagggttcaacaagcaatcgatatttcacgatcaagggtgtagtactatttgtagtagcggtccttatatatcgtattaacaatcgaaagatggtcgaaagaaaaaatctctatttgacagggcttcttcctatacctatgaatttcattggacccagaaatgatacattggaagaatcttttgggtcttccaatatcaataggttgattgtttcgctcctgtatcttccaaaaggaaaaaagatctctgagagctgtttcctggatccgaaagagagtacttgggttctcccaataactaaaaagtgtatcatgcctgaatctaactggggttcgcggtggtggaggaactggatcggaaaaaagagggcttctagttgtaagatatctaatgaaaccgtcgctggaattgagatctcattcaaagagaaagatatcaaatatctggagtttctttttgtatattatatggatgatccgatccgcaaggaccatgattgggaattgtttgatcgtctttctccgaggaagaggcgaaacataatcaacttgaattcgggacagctattcgaaatcttagtgaaagactggatttgttatctcatgtttgcttttcgtgaaaaaataccaatggaagcggagggtttcttcaaacaacaaggagctgggtcaactattcaatcaaatgaaattgagcatgtttcccatctcttctcgagaaacaagtgggctatgcaaaattgtgctcaatttcatatgcggcaattccgccaagatctcttctttagttgggggaagaatccgcacgaatcggattttttgaggaacatatcgagagagaattggttagacaatgtgtggttgttaaacaaggatcggttttttagcaaggtacggaatgcatcgtcaaatattcaatatgattccacaagatctagtttcgttcaagtaacggattctagccaattgaaaggatcctctgatcaatccagagatcatttcgattccattagtaatgaggattcagaatatcacacattgatcaatcaaagagagattcaacaactaaaagaaagatcgattctttgggatccttcttttcttcaaacggaacgaacagagatagaatcagaccgattccctaaatgcctttctggatattcctcaatgtcccggctattcacggaacgtgagaagcagatgaataagcatctgcttccggaagaaatcgaagaatttcttgggaatcctacaagatccattcgttcttttttctctgacagatggtcagaacttcatctgggttcgaatcctactgagaggtccactagagatcagaaattgttgaagaaagaacaagatgtttcttttgtcccttccaggcgatcggaaaataaagaaatagttaatatattcaagataattacgtatttacaaaataccgtctcaattcatcctatttcatcagatccgggatgtgatatggttccgaaggatgaattggatatggacagttccaataagatttcattcttgaacaaaaatccattttttgatttatttcatctattccatgaccggaacagggggggatacacgttacaccacgattttgaatcagaagagagatttaaagaaatggcagatctattcactctatcaataaccgagccggatctggtgtatcataagggatttgccttttctattggattggatcaaaaacaattcttgaatgaggtattcaactccagggatgaatcgaaaaagaaatctttattggttctacctcctattttttatgaagagaatgaatctttttatcgaaggatcagaaaaaaatgggtccggacctcctgcgggaatgatttggaagatccaaaatcaaaaatagtggtatttgctagcaacaacataatggaggcagtcaatcaatatagattgatccgaaatctgattcaaatccaatatagcacctatgggtacataagaaatgtattgaatcgattctttttaatgaatagatccgatcgcaacttcgaatatggaattcaaagggatcaaataggaaatgatactctgaatcatagaactataatgaaatatacgatcaaccaacatttatcaaatttgaaaaagagtcagaagaaatggttcgatcctcttatttttatttctcgaaccgagagatccatgaatcgggatcctaatgcatatagatacaaatggtccaatgggagcaagaatttacaggaacatttggaacatttcatttctgagcagaagagccgttttcattttcaagtagtgttcgatcgattacgtattaatcaatattcgattgatattgattttgattggtctgaggttatcgacaaaaaagatttgtctaagtcacttcctttctttttgtccaagttacttctttttttgtccaagtttcttctctttttgtctaactcacttccttttttctttgtgagttttgggaatatccccattcataggtccgagatccacatctatgaattgaaaggtccgaatgatcaactctgcaatcagttgttagaatcaataggtcttcaaatcgttcatttgaaaaaattgaaacccttcttattggatgatcatgatacttcccaaaaatcaaaattcttgatcaatggaggaacaatatcaccatttttgttcaataagataccaaagtggatgattgactcattccatactagaaataatcgcaggaaatcttttgataacatggattcctatttctcaatgatatcccacgatcaagacaattggctgaatcccgtgaaaccatttcatagaagttcattgatatcttctttttataaagcaaatcgacttcgattcttgaataatccacatcacttctgcttctattgtaacaaaggattccctttttatgtggaaaaggctcgtatcaataattatgattttacgtatggacaattcctcaatatcttgttcattcgcaacaaaatattttctttgtgcggcggtaaaaaaaaatatgcttttttggagagagatactatttcaccaatcgagttacaggtgtctaacatattcatacctaacgattttccacaaaatggtgacgaaagggataacttgtacaaatctttacattttccaattcgatccgatccattcgttcgtagagctatttactcgatcgcagacatttctggaacacttctaacagagggacagatagtcaattttgaaagaacttattgtcaacctctttcagatatgaatctgtctgattcagaagggaagaacttgcatcagtatctcaatttcaattcaaacatgggtttgattcacactccatgttctgagaaatatttaccatccgaaaagaggaaaaaacggggtctttgtctaaagaaatgccttgagaaagggcggatgtatagaacctttcaacgagatagtgctttttcaactctctcaaaatggaatatattccaaacatatatgccatggttccttacttcgacaggatacaaatatctaaatttgatatttttagatactttttcagacctattgccgatactaagtagcagccaaaaatttgtatccatttttcatgatattatgcatggatcagatatatcatggcgaattcttcagaaaaaattgtgtcttccacaatggaatctgataagtgatatttcgagtaagtgtttacataatcttcttctgtccgaagaaatgattcatcgaaataatgagtcaccattgatatcgacacatctgagatcgccaaatgttcgggagttcctctattcaatccttttccttcttcttgttgctggatatctcgttcgtacacatcttctctttgtttctcgagcctatagtgagttacagacagagttcgaaagggtcaaatctttgatgattccatcatacatgattgagttgcgaaaacttctggataggtatcctacatctgaactgaattctttctggttaaagaatctctttctagttgctcgggaacaattaggagattctctagaagaaatacgggcttctggcggcaacatgctatggggtggtggtcccgcttatggggtcaaatcaatacgttctaagaagaaatatttgaatatcaatctcatcgatatcatcgatttcataagtatcataccaaatcccatcaatcgaatcgctttttcgagaaatacgagacatctaagtcatacaagtaaagagatccattcattgataagaaaaagaaaaaacgtgaacggtgattggattgatgataaaatagaatcctgggtctcgaacagtgattcgattgatgataaagaaagagaattcttggttcagttctccaccttaacgacagaaaaaaggattgatcaaattctattgagtctgactcatagtgatcatttatcaaagaatgattctggttatcaaatgattgaacaaccgggagcaatttacttacgatacttagttgacattcataaaaagtatctaatgaattatgagttcaatacatcctgtttagcagaaagacggatattccttgctcattatcagacaatcacttattcacaaacctcctgtggggctaatagttttcatttcccatctcatggaaaacccttttcgctccgcttagccctatccctctctaggggtattttagtgataggttctataggaactggacgatcctatttggtcaaatacctagcgacaaactcctatgttcctttcattacagtatttctgaacaagttcctggctaacaagcccaagggttttcttgttgatgatagtgacgatattgatgatagcgacgatattgatgatagtgacgaccgtgactttgatacggagctggcgcttctaactatgatgaatgcgctaactatggatatgatgccggaaatagaccgattttatatcacccttcaattcgaattagcaaaagcaatgtctccttgcataatatggattccaaacattcatgatctggatgtgaatgagtcgaattacttatccctcggtctattagtgaactatctctccagggattgtgaaagatgttccactagaaatattcttgttattgcttcgactcatattccccaaaaagtggatcccgctctaatagctccgaataaattaaatacatgcattaagatacgaaggcttcttattccacaacaacgaaagcactttttcactctttcatatactaggggatttcacttggaaaagaaaatgttccatactaatggattcgggtccataaccatgggttccaatgtacgagatcttgtagcacttaccaatgaggccctatcgattagtattacacagaagaaatcaattatagacactaatataattagatctgctcttcatagacaaacttgggatttgcgatcccaagtaagatcggttcaggatcatgggatccttttctatcagataggaagggctgttgcacaaaatgtacttctaagtaattgctccatagatcctatatctatctatatgaagaagaaatcatgtaacgaaggggattcttatttgtacaaatggtacttcgaacttggaacgagcatgaagaaattaacgatacttctttatcttttgagttgttctgccggatcggtcgctcaagacctttggtctctaccccgacccgatgaaaaaaatgggatcacttcttatggactcgttgagaatgattctgatctagttcatggcctattagaagcagaaggcgctccggtgggatcctcacggacagaaaaagattgcagtcagtttgataatgatcgagtgacattgcttcttcggcccgaaccaaggaatcccttagatatgatgcaaaatggatcttgttctatcgttgatcagagatttctctatgaacaatacgaatcggagtttgaagaaggggaaggagtcctcgacccgcaacggatagaggaggatttattcaatcacatagtttgggctcctagaatatggcgcccttggggctttctatttgattgtatcgaaaggcccaatgaattgggatttccctattgggtcaggtcatttcggggcaagcggatcatttatgatgaagaggatgggcttcaagagaatgattcggagttcttgcagagtggaaccatgcagtaccagacacgagatagatcttccaaagaacaaggcttttttcgaataagccaattcatttgggaccctgcggatccactctttttcctattcaaagatcagcctgtgttttcacatcgagaattctttgcagatgaagagatgtcaaaggggcttcttacttcccaaacggatcttcctacatctatatataaacgctggtttatcaagaatacgcaagaaaggtacttcgaattgttaattcatcgccagagatggcttagaaccaatagttcattatctaatggattttttcgttctaatactccatccgagagttatcagtatttatcaaagctgttcctatctaacggaacgctattggatcaaatgacaaagacattgttgagaaaaagatggcttttcccggatgaaatgaaaattggattcatgtaacaagagaaaggtttcccattccttagccggaaagatatgtggccatgaaacagggattaagtggaacagaattgactgggcggtagagtcgtggaaacacctgtttcttccatattttggaccttagctccatggaacaatatactaactactgctgaaacatggaagaattgaaatcttagatcaaaacattatgtatggatggtatgaactgcctaaacaagaattcttgaacagcgaacaaccagagctattactcactacatcaaaaaatttccattaatgaaagatgtaaatccattggaaaataaaaaatacgcatgtcggatgaaatggttgttgctatctgctacaataacgactcattggtttaactgaataactaaataaaatagatagacatttctcttcgtctcaggtcgacggatcttctcaattcaaagatcccctatatggataatacacattccagttgaccgactaattcgaattgttttgttccgaagcaaagatatccacggggcggttcgtcctattcagatattcacgaccaagaa

SEQ ID NO: 4465 - DNA, 3669 bp, Ambrosia trifida
cccaactcataattggcgaattcgtaggttcaattcctactggatgcacgccaatcggaccctccaataagtctattggaattagctctgtatcaatgaaatctcatcatccatacataacgaattgatgtggtatattcatatcatactatatgaacagtaagaattagtagtcttattgagactagaactcatagggaatcaaatcgatttatggatggaatcaggtatgcagtatttacagacaaaagtattcggttattggggaaaaatcaatatacttttaatgtcgaatcaggatcaactaggacagaaataaagcattgggtcgaactcttctttggtgtcaaggtaatcgcgatgaatagtcatcgacttcggggaaaggctagaagaatgggacccattatgggacagacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcatcattgtggtaaaggtcgtaatgccagaggaatcattaccgcagggcatagagggggaggtcataagcgtctataccgtaaaatagattttcgacggaatgaaaaagacatatatggtagaatcgtaaccatagaatacgacccgaatcgaaatgcatacatttgtctcatacactatagggatggtgagaagagatatattttacatcccaggggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaagggaaatcggccacattaaaattaccttctggggaggtccgtttgatatccaaaaactgctcagcaacagtcggacaagtggggaatgttggggtgaaccagaaaagtttgggtagggccggatctaagcgttggctaggtaagcgccctgtagtaagaggagtagttatgaaccctgtagaccatccacatgggggtggtgaagggagggccccaattggtagaaaaaaacccacaaccccttgggttatcctgcacttggaaaaagaagtagaaaaaggaataaatatagtgataatttgattcttcgtcgccgtagtaaataggtagtaaataggagagaaaatagaatttctttcttcgtcttaaaaaaaaataggaggaagctgtgacacgttcactaaaaaaaaatccttttgtagcgaatcatttattaaaaaaaataaataagcttaacacaaaagaagaaaaagaaataataataacctggtcccgggcatctaccattatacccacaatggtcggccatactattgctatccataatggaaaggaacatttacctatttatataacagatcgtatggtaggacacaaattgggagaatttgcgcctactttaaatttccgaggacatgcaaaaagcgataatagatctcgtcgttaaaaaacgtttgtttaggtttatgtataataatatatatagatatttatcattgattagtaggaggcgaactttatgttaaataagagaacaacagaagtatacgctttaggtcaacatatatctatgtctgctcacaaagcgcgaagagtaattgatcaaattcgtgggcgttcctacgaagaaacacttatgatattagaactcatgccttatcgagcatgttatcccatttttaaattagtttattctgcagcagcaaatgctagttccaatatgggttcgaatgaagcaaatttaatgattagtaaagccgaagtaaataaaggtactatcatgaagagattaaaacctcgagctcgagggcgtagttttgcgatacaaaaacctacctgccatataactattgtaatgaaagatatatccttagatgaatatatagataccgactctattacatggtcacaaaagaaaaaaaaggatacaactatgtcgtattatgatatgtatagtaatgggggaacatgggacaaaaataaatccaattggtttcagacttggtacaacccaaggtcatcattccctttggttcgcacaaccaaaaaattattctgagggtctgcaagaagatcaaaaaataagaaattatataaagaattatgtacaaaaaatatgaaaacatcttccggcgtcgagggaattgcacgtatagagattcaaaaagaatcgacctgatccaaatcataatctatatgggatttccaaaaatattaattgaaagtcgaccccgaggaatcgaagaattacagatgaatttacaaaaagaatttaattctgtaaatcgaaaacttaaccttgctatcacacgaattgaaaagccttatggaaaccctaatattcttgcagaatttatagccggacaattaaaaaatagagtttcttttcgcaaagcaatgaaaaaggctatagaattaactgaacaagcagatacaaaaggaattcaagtgcaaattgcaggacgtatcgacggaaaagaaattgcgcgtgttgaatggatcagagagggtagggttccactacaaaccattcgagctaaaattgattattgttcctatacagttcgaacaatctatggggtattgggcatcaaaatttggatctttatagaaggggaataatcaacctttatttccctttgcattctattcagcgatggaacaaaaaacgataaattagtttcttctttttcttttctgttcaataaaaaaaatgaacaattataattctatagggtttaataaaaattcaattaatcttttgatcaaattgctatgcttagtgtgtgactcgttggttttttgagggttagtataaaaaaatagccccatagtataaacaaataactatacaagtaataaccaactcatcacttcgtattatctggatccaaagaaccagtcaagatatgatatattgttcatattgttgtagcaactgaaatctttttttcttcaaaaatctgcttctaagttgtcaatcgaaataaaaaagaaagggtatggataaatggaaggatgagagaaagaaaagaatattgatgatatagaattccaatatgtaaggtctatgagtcatctcagaaaaaatctgcgtaataaagcatcaatacggattcatcattaaatgaatctgctcgtcgaacaaaaaataaagagcttcgagccaattaaagactaagaatattgactcaagaactaatagctccgttgtagaattaagacctaaccattaagtaagaagcgatgggaacgatggaacctgtgaattcaaaagattttagtgaaaataaattcgaatgattcattgatcgggatggcggaaccggccagagaccaattcatctattcggaaaagttatgaactaatgatagaactgaaatagaaattgaaagagtaaatattcgcccgcgaaaactttattttcttggattgct

SEQ ID NO: 4466 - DNA, 52157 bp, Vitis vinifera
ggattggctacttacccattcagtgactttggcactggacgttcccaaaatgggtactatcgggtcgggtgaattcaataatagacgcctgttggcattccagccttccttctcctttcagggcctatccgaaagagaatccagtacttcttggtcgtgaatatctgaataggacgaaccgccccgtggatatctttgcttcggaacaaaacaattagaattaggctcggtcaactggaatgtgtattatccatataggggatcttccaattgagaagatccatcgacctgagacgaagagaaaggtctatccattttatttagttattcagttaaaccaatgattcgttattggagcagatagcaacaaccatttcatcagacatgcgtatttttgattttccaatggatttacatctttcattaatggaaattttttgatgtagtgagtaataggctctggttgttcgctgttcaagaattcttgtttaggcagtttataccatccatacatagtgttttgatctaagatttcaattcttccatgtttcagcagtagcatattgttccatggagctaaggtccaaaatatggaagaaacaagtgtttccacgactctaccacacagtcaattctgttccacttaatccctatttcatggccacatatctttccggctaaggaatgggaaatctttctcctgttacatgaatccaattttcatttcatccgggaaaagccatctttttctcaacaatgtctttgtcatttgatccaatagccttgcgttagataggaacagatttgataaatactgataactctcggatggagtattagaacggaaagatccattagataatgaactattggttctaagccatctctggcgatgaatcaacaattcgaagtgcttttcttgcgtattcttgataaaccagcgtttatatatagatgtaggaggatctgtttgggaagtaagaagcccctttgacatctcttcatctgcaaagaattctcgatgtgaaaacacagagacaaagggctgatctttgaataggaaaaagagtggatctgcagggtcccaaatgaattggcttattcgaaaaaagccttgttctttggaagatctatctcgtgtctggtactgcatggttccactctgcaagaactccgaatcattctcttgaagctcatcctcttcatcataaatgatccgcttgccccgaaaagacctggcccaatagggaaatcccaattcattggtcctttcgatacaatcaaatagaaagccccaagggcgccatattctaggagcccaaactatgtgattgaataaatcctcctctatctgttgcgggtcgagggctccttctcctgccccttcttcaaactccgattcgtatttttcatagagaaatctctgatcaacgatagaacaagatccattttgcatcatatctaagggattccttggttcgggccgaagaagcaatgtcactcgatcattatcaaactgactgcaatctttttctgtccgtgaggatcccaccagagcgccttctacttctaataggccgtgaactagatcagaatcattctcaacgagtccataagaagtgatcccatttttttcatcgggtccgggtagagaccaaaggtcttgagcgaccgatccggcagaacaactcaaaagataaagaagtatcgttaatttcttcatgctcgttccaagttcgaagtaccatttgtacaaataagaatccccttcgttacatgatttcttcttcatatagatagatataggatctatggggcaattacttagaagtacattttgcgcaacagcccttcctatctgatagaaaaggatcccatgatcctgaaccgatcttacctgggatcgcaaatcccaagtttgtctatgaagagcggatctaattgcattagtgtctataattgatttcttctgtgtaatactaatcgatagggcctcattggtaagtgctacaagatctcgtgcattggaacccatggttatggacccgaatccattagtatggaacattttcttttccaagtgaaatcccctagtatatgaaagagtgaaaaagtgctttcgttgttgtggaataagaagccttcgtatcttaatacatgtatttaatttattcggagctattagagcgggatccactttttggggaatatgagtcgaagcaataacaagaatatttctagtggaacatctttcacaatccctggagagatagttcactaatagaccgagggataagtaattcgactcattcacatccagatcatgaatgtttggaatccatattatgcaaggagacattgcttttgctaattcgaattgaagggtgatataaaatcggtctatttccggcatcatatccatagttagcgcattcatcatagttagcagctccagctccgtatcaaggtcacgatcgatatcgtcactagcatcaatatcgtcactagcatcaatatcgtcactagcatcaatatcaaaacctttaggcttgttatccaggaacttgttcagaaataccgtaatgaaaggaacataggagtttgtcgctaggtatttgaccaaataggatcgtccagttcctatagaacctatcactaaaatacccctagagggggatagggctaagcggagcgaaaagggttttccatgagatgggaaatgaaaactattagccccacacgaggtttgtgaataagtgattgtctgataatgagcaaggaatatccgtctttctgctaaacaggatgtattgaactcataattcattagatactttttatgaatgtcaactaagtatcgtaagtaaattgctcccggttgttcaatcatttgataaccagagtcattctttgataaatgatcactatgagtcagactcaatagaatttgatcaatccttttttctgtcgttaaggtggagaactgaaccaagaattctctttcttcatcatcaatcgaatcactgttcgcgacccaggattctattttatcatcaatccaatcaccgttcacgttttttctttttcttatcaatgaatagatctctttacttgtatgacttagacatctcgtatttctcgaaaaagtgattcgattgatgggatttggtatgatacttatgagatcgatgatatcgatgagattgatattcaaatatttcttcttagaacaaccccgtatttcttctagagaatctcctaattgttccagagcaactagaaagagattctttaaccagaaagaattcagttcagatgtaggatacctatccagaagttttcgcaactcaatcatgtatgatggaatcatcaaagatttgaccttttcgaactctgtctgtaactcactagaggctcgggaaacaaagagaagatgtgtacgaacgagatatccagcaacaagaagaaggaaaaggattgaatagaggaactcccgaacatttggcgatctcagatgtgtcgatatcaatggtgactcattatttcgatgaatcatttcttcggacagaagaagattatgtaaacacttactcgaaatctcacttatcagattccgttgtggaagacacaattttttctgaagaattcgccatgatatatctgatccatacataatatcatgaaaaatggatacaaattttggactgctacttaatatcggcaataggtctgaaaaagtatctaaaaatatcaaatttagatatttgtaccctgtcgaagtaaggaaccatggcatatatgtttggaatagattccattttgagagagttgaaaaagcactatctcgttgaaaggttctatacatctgccctttctcaacgcatttctttatacaaagactccgttttttcctcttttcggatggtaaatatttctcagaacatggagtgtgaatcaaacccatgtttgaattgaaattgagatactgatgcaagttcttcccttctgaatcagatagattcatatctgaaagaggttgacaataagttctttcaaaattgactatttgtccctctgttagaggtgttccagaaatgtctgcgatcgagtaaatagctctacgaacgaatggattggatcgaattggaaaatggaaagatttgtacaagttatacgtttcgtcaccactttgtggaaaatcgttaggtatgaatatgttagatacctgtgactcgattggtgaaatagtatctctctccaaaaaagcatgtttttttttaccgccgcacaaagaaaatattttcttgcgaatgaacaaaatattgaggaattgtccatacgtaaaatcagaattattgatacgggccttttccacataaaaagggaatcttttgttgcaatagaagcagaagcgatgcggattattcaagaatcgaagtcgatttgctttataaaaagaagatatcaatgaacttctatgaaatggtttcacgggattcagccaattgtcttgatcgtgggatatcattgagaaataggaatccgtgttatcaaaggatttcctgcgattatttctactatggaatgagtcaatcatccactttggtatcttattgaacaaaaacggtgatattgttcctccattgatcaaaaatttcgatttttgggaagtatcatgatcatccaataagaagagtttccattttttcaaatgaatgatttgaagacctattgattctaacaactgattgcagagttgatcattcggacctttcaattcatagatgtggatctcggacctatgaatggggatattcccgaaactcacaaagaaaaaaggaagtgagttagacaaaaagagaagcaacttggacaaaaaaagaagtgacttggacaaaaagaaacgaagtgacttagacaaatcttttttgtcgataacctcagaccaatcaatcgaatattgattaatacgtaatcgatcgaacactacttgaaaacggctcttctgctcagaaacgaaatgttccaaatgttcctggaaattcttgctcccattggaccatttgtatctatatgcatgaggatcccgattcatggatctctcggttcgagaaataaaaataagaggatcgaaccatttcttctgactctttttcaaattcgataaatgttggttgatcgtatatttcattatagttctatgattcagagtatcatttcctatttgatccctttgaattccatattcgaagttgcgatcggatctattcattaaaaagaatcgattcaatacatttcttatgtacccataggtgctatattggatttgaatcagatttcggatcaatatatattgattgactgcctccattatgttgttgctagcaaataccactatttttggttttggatcttccaaatcatttccgcaggagatccggacccatttttttctgatccttcgataaaaagattcattctcttcataaaaactaggaggtagaaccaataaagatttcttgttcgattcatccctggagttaaatacctcattcaagaattgtttttgatccaatccgtaggaatcaatagaaaaggcaaatcccttatgatacaccagatccggctcggttattgatagagtgaatcgatctgccatttcttgaaatctctcttctgattcaaaatcgtggtgtaacgtgtatccccccctgttccggtcatggaatagatgaaataaatcaaaaaatggatttttgttcaagaatgaaatcttattggaactgtccatatccggttcatccttcggaaccatatcacatcccggatctgatgaaataggatgaattgagacggtattttgtaaatacgtaattatcttgaatatattaaccatttctttattttccgatcgcctggaagggacaaaagaaacatcttgttgtttcttcaacaatttctgatctctagtggacctctcaataggattcgaacccagatgaagttctgaccatctgtcagagaaaaaagaacgaatggatcttgtaggattcccaagaaattcttcaatttcttccggaagcagatgaataatcatctgcttttcacgttccgtgaatagccgggacattgacattgaggaatatccagaaaggcatttcgggaatcggtctgattctatctctgttcgttccgtttgaagaaaggaaggatcccaaagaatcgatctttcttttagttgttgaatctctctttgattgatcaatgtgtgatatttcgaatcctcattactaatggaatcgaaatgatctctggattgatcagaagatcctttcaattggctagaatccgttacttgaacgaaactagatcttgtggaatcatattgaatatttgacgatacattccgtaccttgctaaaaaaccgatccttgtttaccaaccacacattgtctaaccaaatccaattctctctcgatacgttcctcaaaaaatccgattcgtgcggatttttcccccaactaacgaagagatcttggcggaattgccacatatgaaattgagcacaattttgcaaagaaatagcccacttgtttctcgagaagagatgggaaacatgctcaatatcatttgattgaatagttgacccagctccttgttgtttgaagaaaccctccacttcaattggtattttttcacgaaaagcagacatgagataacaaatccagtgtttcactaagatttcgaatagctacgatcaaacaattcccaatcatggtccttgtggatcggatcatccatataatatacaaaaagaaactccagatatttgatatctttttctttgaatgagatctcaattccagcgacggtttcattagatatcttacaactagaatccctcttttttccgatccagttcctccaccaccgcgaaccccagttagattcaggcatgatacactttttagttattgggagaacccaagtactctctttcggatccaggaaacagctctcagagatcttttttccttttggaagatacaggagcgaaacaatcaacctattgatattggaagacccaaaagattcttccaatgtatcatttctgggtccaatggaattcataggtataggaagaagccctgtcaaatagagattttttctttcgaccatatttcgattgttaatacgatatataaggaccgctactacaaatagtactacacccttgatcgtgaaatatcgattgcttgttgaaccctgtgaattgcgtgaaagtaggatactccaaattcgggggtcaaagagttttataaaacgttcttggtggaaaaaaatgtgaatgaaagatcccactgaagtgaattgggtccatgaatctaagaaatagtgagaattcttgatctctctcaatatctctctcaattcgaaaatccaagatttgaattgatgtcctttcattgattcctcctaaattacattgatttatcctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttctaatgtcgaatcaggatcaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatagagccgtagacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaggtgggaaatgttggggtgaaccagaaaagtttgggtagagccggatctaagtgttggctaggtaagcgtcctgtagtaagaggagtagttatgaaccctgtagaccatccccatgggggtggtgaggggagagccccaattggtagaaaaaaacccacaaccccttggggttatcctgcacttggaagaagaagtagaaaaaggaataaatatagcgataatttgattcttcgccgccgtagtaagtagtaaataggagagaaaatagaatttgtttcttcgtctttacaaaaaaaaaaaaaataggagtaattaactgtgacacgttcactaaaaaaaaatccttttatagcaaagcatttattaagaaaaattgctatgcttaacacaacgtgggaaaaagaaataatagtaacttggtcccggacatctaccattatacccacaatgatcggccatactattgctgtacataatggaaaggagcattttcctatttatataacagatcgtatggtaggccacaaattgggagaattttcatctactctaaatttccggggacacgcaaaaaacgataatagatctcgtcgttaaaataacgatacttatccttcattattcattagtgggaggtgaaccttatgacaaatatagaaaaagaagatataaaattaaaaacagaagtatacgctttaagtcaatctatctctatgtctgctcacaaagcgcgaagagtacttgatcaaattcttggacgttcctatcgggaaacacttacgatacttgaactcatgccttatcgagcgtgttatcccatttttaaattaatttattctgcagcagcaaatgctaagcacaatatgggtttgaacgaagaatatttagtcattactaaagccacagtcaacgagggtactaccgtgaaaaaattgaaacctcgagctcgaggacgtagttatgcgataaaaagacccacttgtcatataactattgtattgaaagatacagccttatatgaaaaatatgtcgtagaaaactctatcaggtgtttaaaaaaaaccggatggatatataaaaagaagtccacagatattacgtgtcataatatgtatagtagtgggggagtatgggacaaaaaataaatccactgggtttcagacttggtacaacccaaggtcatcattcgctttggtttgcacaaccaaaaaattattccaagggtctacaagaagatcaaaaaatacgggattgtatcaagaattatgtacaaaaaaatataagaatatcctctggtgtcgagggaattgcacgtatagagattcaaaaaagaatcgatctgattcaggtcataatctatatgggattcccaaagttattagtagaaggtaaaccacgaagaattgaagaattacagatgaatgtacaaaaagaattgaattacgtgaaccgaaaactcaacattgctattacaagaattacaaaaccttacggacatcctaatattcttgcagaatttatagccggacaattaaggaatagagtttcgtttcgcaaggcaataaaaaaagctattgaattaactgaacaggcagatacaaaaggaattcaagtacaaattgcagggcgtatcgacggaaaagaaattgcacgtgttgaatggattagagaaggaagggttcccctacaaaccattcgagctaaaattgattattgttcctatagagttcgaactatatatggggtattaggcatcaaaatttggatatttgtagacgaggaataaaataataagtccttccttgtcttttctttcgttctatccagtaatgtaatgaaacaaaaaatgacaaattctttcattctttttctcttcaatcaaaacaaaaatgaacaattagaaattaattctatagggttgaataaagattcgattgaccatttgatataattgctatgcttagtgtgtgactcgttggttttttgtaggattagggttcaaaacaaaaaatggaccggcccatacatagtatgaactcaaaattacagaattaataaccaactcatcgcttcacattatctagatctaaacaaccagtcaagatatgatatattggtcatatcattgtagcaactgaaatcttttttgcataaacacaaaaaaaaaccaaaccaatctgattatgagtttgggaagcgaaatctagaatgatgtggataaatggaagaagggtgagagaaagagataaaaagaacgccaatgatatatgattccaatataatatgtaaggtctatgaatcatttcataaaaagcaatgtaataaagcatcaaactaattcctcccgaattaaatgaatatgttcatagaaaaaaaaatcaagagcctagagccaataaagactgagaagattgactcaagaacaggagctccattgtataattcagacctaaccattaattgagaagcgatgggaacgacggaaacctgtgaatacagaagattctattaaaaacgaatcctaatgattcattgagtgggatggcggaacaaaccaggtatcaattcatttgttctgaaagatcgtgggctaaccttacaattgaaatagatattgaaagagtaaatgttcgcccgcgaaagctttattttaccgaattgctctattttttgagcgatccgatatgataaagacaaaacaaaataaagattcgttatagccttatatattattatattataaataaattataaataaaaaattacattatctagaaatatatgtttagctatatatccaaaagctatatataaacaagatataaaaatttctaatagaaatagattagatgaaaattagatgaaatatcaaagaatcccacgattcagtgtattattcaaaaaaattgaattttatcttaactaaatttttttgaatcatttcattcgcgaggagctggatgagaagaaactctcatgtccggttctggagtagagatggaattttaaaaagacccatccactataaccccaaaagaaccagattccgtaaacaacatagaggaagaatgaagggaatatcttatcgaggtaatcgtatttgtttcggtagatacgctcttcaagcacttgaacctgcttggatcacatctagacaaatagaagcggggcgacgagcaatgacacgaaacgtacgccgtggtggaaaaatatgggtacgtatatttccagacaaaccagttacagtaagacctacggaaacacgtatgggttcggggaaaggatcccccgaatattgggtagctgtcgttaaaccaggtagaatactttatgaaatgggcggagtagcagaaaatatagctagaaaagctatttcaatagcggcgtccaaaatgcctatacgaactcaattcattatttcgggataggaataaaagaaaaagaggtctttgggatgaaaaaaaattgcaggtttctttttttgattttggacaaacaatatttcttttttttttccttcgttctttgcattgaaaaatcgaataaaaaaatgatatgattcaaccccagacccatttgaatgtagcggacaacagcggggcccgagaattgatgtgtattcgaatcataggaactagtaatcgccgatacgctcatattggtgacgttattgttgctgtgatcaaagaagtagtaccaaatatgcctctagaaagatcagaagtaatcagagctgtaattgtacgtacctgtaaagaactcaaacgtgacaacggtatgataatacgatatgatgacaatgctgcagttattattgatcaagaaggaaacccaaaaggaactcgaatttttggtgcgatcgtccgggaattgagacagttaaattttactaaaatagtttccttagcccctgaggtattataagacgagaccatgatatagttatagtaagcgaatgaaatagattaattagtagattgtgtttcacgcatatacctttaatttaatatttaatagaattcataaataaaaaaaaaaaaagagcatgttgattatatcaaaattagcaggcaccaataattttagttcatcatgggcagggacactattgctgacataataacctctatacgaaatgtcgacatggatagaaaagtaacggttcgaatagcatctactaatatcaccgaaaacattgttaaaatacttttacgggaaggttttatcgaaaacgtgaggaaacatcaggaaagcaacaaatattttttggttttaaccctgcgacatagaaggaataggaaaggaacatatagaactattttaaatttaaaacggatcagtcgacctggtctacgaatctattctaactatcaacgaattcctagaattttaggtggtatggggattgtaattctttctacttctagaggtataatgacagaccgagaggctcgcctagaaagaattggtggagaaattttgtgttatatatggtaatccttctgatattcgaattggatccggaacttcctatttgtgaaaaaaaaaagagaaagggcgggttgtctaatatcactactcctccattaattaatactttaagggggttttacctggaatgaaagaacaaaaatggattcatgaaggtttaattactgaatcacttcccaacggtatgttccgggtgcgtttagataatgaaaatatgattctaggttatgtttcaggaaggatccgacgtagttttatacggatactaccaggagatagagtcaaaattgaagtaagtcgttatgattcaaccaaagggcgtataatttatagaatccgaaacaaggattcgaataattagggagtttttcaacttcaacattccttttttcatggagatacaattcgaagttcaaaatttcaagaaacttattttcttccaagaagtagattcttaattaagttaaggtaaggaataacaaatatgaaaataagggcttctgttcgtaaaatttgcgaaaaatgtcgactgatccgtagacggggacgaattatagtaatttgtcccaacccgagacataaacaaagacaaggataatttctcgaaaagagattctctaaagaacccgatgtacaaataaaaaaaaatcatgttttgacatgaaatggatatatccatatatctcttactcatatttatgagatgataaaatatggcaaaacctataccaagaattggttcacgtaggaatggacgtattggttcacgtaagagtgcgcgtagaataccaaagggagttattcatgttcaagcaagttttaacaataccattgtgaccgttacagatgtacggggtcgggtggtttcttggtcctcggccggtacttgtggattcaggggtacaagaagagggacgccatttgctgctcaaaccgcagcaggaaatgctattcgtacagtagtggatcaaggtatgcaacgagcagaagtcatgataaagggtcctggtctcggaagagatgcagcattacgagctattcgtagaagtggtatactattaagtttcgtacgggatgtaactcctatgccacataacggctgtagacctcctaaaaaaagacgtgtataggaataaactgtgtagaaataaacattgaagagatttcaagagaaataaatgattcaatgatctgatcaagtaatattactatggttcgagagaaagtaacagtatctactcggacactgcagtggaagtgtgttgaatcaagagtagacaataagcgtctttgttatggacgctttattctgtctccacttattaaaggtcaagccgacacaataggcattgcgatgcgaagagctttgcttggagaaatagaaggaacatgtatcacacgtgcaaaatctgagaaaataccccatgaatattctaccatagtaggtattcaagaatcagtacatgaaattttaatgaatttgaaagaaattgtattgagaagtaatctgtatggaactcgcggcgcgtttatttgtgccaggggtcctggatatgtaactgctcaagacatcatttcaccgccttctgtggaaatcgttgataatacacaacatatagctagactgatggaaccgattgatttgtgtattggattacaaatcgagaggaatcgcggatatagtataaaaaggccaaataactttcaagacggaagttatcctatagatgctgtattcatgcctgttcgaaatgcgaatcatagtattcattcttatgggaatgggaatgaaagacaagagatactttttctcgaaatatggacaaatgggagtttaactcctaaagaagcacttcatgaagcctcccgtaatttgattgatttatttattccttttctacatgcggaagaagaaactttacatttagagtacaatcaacacaagagcactttaccccctcttacttttcatgatagattggctaaactaaggaaaaacaaaaaagaaatagaattgaaatatatttttattgaccaattagaattgcctcccaggatctataattgcctcaaaaggtccaatatacatacattattagaccttttgaataagagtcaaaaggatcttatgaaaattgaagattttcgcatagaagatgtaaaacagttattgggcattctagaaaaacatttcacaattgattaaccgaagaataataaatagattgaatttttttcatattttttttttttttttagaaaaaaaactgggttttgaatctttaaccaaatccatatattcggaatagattcagaatttaattgaatagatgtatctagggagaattcactttgaagcgactattccctagatacacatgcgggatattttatttcacaattgaatcaatttaaatttaaaaaagacctaaagttagggatttatcaataggtaatgttgctccaatacccaaccaaagggccactgcggtaccaatcaaaaaaacggttgtcgctactggacgacgaaatggattttggaatttattaacattttccaaaaaaggtactgttaataatcccgcaggtactgaaaccattaaaagaacacctaataacttattaggtactgtacgaagtatttgaaatacgggaaagaaataccattcaggtaatatttccaaaggagttgcaaatggatctgctggttcaccaatcattgatggttctagaaccgctaagcctacgttacatgcaatagtacctagaataactactggaaagatatataaaagatcattgggccatgcgggttctccgtaataattatgacccatccctttagctaatttagctcttaatacaggatcgttcaagtcaggtttttttgttattgggataggtgaattcttatagatccatcccccgaaggaaccggacatgataatttttcatcatccggctcgagcaagaattaaaagaaccaaatggatccatataaaatataaaaatctatatgttatccatatccacacatatatgaatgattctatgtaagataaattttatcggattccgttttccggagttgcaactaactatccgctgaaagaactgaagttctttcaggtaaatgctcaatacccaagtaggccgacaaagtcgatcatgatcaagtgctttctgggtcgtctcagaccttgcgattggcgtttatccccaacaaaatatctcgagtttttttacatacaaaggatttacttgttactaatatagtctagcctctgttcttctttagatcccttgtttcactccgatagtatcataaatcgggtcgatgcagaggaaatgaatgcatttccatacttactattaagttaagtaagtgaaatagataaaacataatctggatcatgacgcatcacttattctactggatcttacggagcctgttcatgcacgacatgattcgggtctgatcatagaaaagattctcttcaagcgaaccagcctattctgtatggggcttgcgcggtggttagaacaaagacacatttggttgtgaatttcaatgtggcggataaaggtatatatctgcaaggcccaatcaatagttcaagtcacacactcccataatccattttctcttcggagaattcacttcaactattcgttataaaaaatacaatattgtggagttgaagggaaagatccaaatacatgtcttattcttttcaataatccatatttgtagcaatgaaatactattcttcctacccgtagtgtaaatgattgattataaatatctatgatctatcttctctataaaggaccagaaataccttgcttacgtatcattgggaagtgcattaacataaatacggccgtaagaagaggtaatacaaaagtgtgtaaactataaaaacgggtcaaagtggattgtcccacactagcacttccgcgtaataactctaccaaaggtgatcctattacaggaatagcttcaggtacacctgttacaattttgactgcccaataaccaatttggtcccgaggtaaagaataaccagttacaccaaaagatgcggtcaatacacccagaaccacacctgtaacccaagtcaattcgcgaggttttttaaatccaccggtgagatatacacgaaatacgtgaaggatcatcattaggaccatcatacttgccgaccatcgatgaactgatcggattaaccaaccgaagttcgcttcagtcattatgtattgaacagaagcaaaagcctcagtaaccgtcggacgatagtaaaaagtcatagcaaaccccgtagctacttgtactaaaaaacaagtaagcgtaattcctcctagacaataaaatatgttgacatgaggaggaacatatttactagttatatcatctgcaatcgcctgaatctcgagacgttcttcgaaccaatcatagactttattgagataggtaaaccaagggggctccccctctgagaaccgtatatgagaatttcatctcgtacagctcaagcagaaacacccaaataccagttaaaacggatatataatagaaagtttcaaacttcttaatcctctgattaaggattcaatcttatatgaagatacgaaagaataaaaatccgaaagctcttctttgtgatgataatgccaaaatatcaagtcggcgcattcgtctttatgtttatcgttacaggcctcttgaatcttctcttttcctatttctatttatttgatttgttatttttatttgtgtgtaatgcgatttgactattgtattgttttctttattattgataggaattatcttgttaagaccctatgaatcgattgaaacctcagattcatactaaaaccacgatgattcaataaaaccttcaagctaaacccaaaagattccctgagtaagaaccgttgatcatcatttataaattttaaaatttttggagtccgtttgcgaggtctgaatattaagtatgaatcatagttcatatattccgtgttccagatatcatatattccgtgtttcagatactagaatgaatatccgacgaagtagaatcatctctatcaagatgacagacccattctctgtactaccaataggatcaattctaacaagtcacacactcatattccggaaatacagaaacaaagaaattccgcggtcgaactaccaaaatagaatgggcgagaaatccgagccgattcactttgtattgaaaagctaggacttcgtggttcttgtggagctaattcagtgaaattccgtccaataaaacagaagaattataaatctccaaaataatagataggaataccgcaaatagagccattgcgacacccattaaaggagtagttccccatccaggagctactttaccatattccgaattcaacggttttaataactcccctacagtagttggttttggacgagatctagaactaccctcaacggtttttgtagccataaatcctattgtattcattgagatctgttgactttgtataccattccgttgtaaataaacgatcttatcataaatccattgtggtcttgaaattatataataatggaaacagcaaccctagtcgccatctctatatctggtttacttgtaagttttactgggtacgccttatataccgcctttgggcagccctctcaacaactaagagatccatttgaggaacacggggactagttgaagtaatgagccccccatgttggggggctcattacttcaattgagataatgaaaaatcatttcacctttttagttggaactttaggcggttctcgaaaaaagatagcgaaaaaaattatccctagagtcgagactaagaggaatgtataaaccaatgcttccatagattcgatcgtggtttacaattatagcttccatacctgtttttgtttatttgggaccatctcccggataaagaaagagcaagagtcaaagaaaagacggtgattgaaatcacgatttatctggtaccttatgtcaaatcacaaaaagcaaatagagggaaagataccaaagaaatgttgtgttgtatcagactacttgtcttcttgtagttggatccccaagtttttggaatgttccaaattccacttgagcatccaaatccgggtcaataccagcaaaaacgtctctgaataaggttctagcaccatgccaaatgtgtccgaagaagaagagcagagcaaatgaagcatgtccaaaagtaaaccaaccccttggactgctacgaaaaacaccatcggatttcaaagtagcacgatctaattcaaaaatttcacccaattgagcacgtctagcatattttttcacagtagcaggatcactataactgactccattgagttcgccgccatagaactcaacagttacacctacttgttcgacactatacttcgattctgcccttctgaaaggaacatcggctctaacaattccgtctccgtctaccaaaacgactggaaatgtttcaaaaaaggtaggcatacgacgtacaaaaagttcacgaccttctttatctctaaagatagggtgtcctaaccatccaacagctattccatccccattgtccattgaacccgctctgaataatcccccttttgccggattattgccgatgtaatcataaaaggctaatttttcaggaattttagaccaagcttctgataaactttgattttcggctagcccagcaccaactcttcgatatatttcttgttggaagtatccctgatcccattgataacgagtgggaccaaataattcgatcggggtagttgctgaaccataccacatagttccagcaacaacaaaagctgcaaaaaagacagcagcaatactactggacaggacggtttcaatatttcccatacgtaatcctttgtatagacgttgaggcggacggacactaagatggaataggcctgctaatatgcccaatgtacctgctgcaatatgatgagaggctattcctcccggaacaaaaggatcaaaaccttccacgccccacgctggatttacagattgtacttttccagttagtccataagggtcggacacccagattccaggaccatacaagcctgttacatgaaaggcgccaaaaccaaagcaagccaaccctgatagaaataaatgaattccaaagatcttgggcaaatccaaagaaggttttcctgtacgttcatcacaaaatatttctagatcccaatacacccaatgccagatagctgctaagaagcacaagccagaaaacacaatatgtgccccggccacaccttcgtaactccaaatacccggattcgttatagtcccgcctgtgatactccaaccgccccatgaattagttattcctaaacgagtcatgaagggtataacgaacataccttgtctccacattggatcaagaacggggtcagagggatcaaaaactgctaattcatatagagccatcgaaccggcccaaccagcaaccagagctgtatgcattatatggacagaaatcaatcgaccgggatcattcaatacgacagtatgaacacgataccaaggcaaacccatggaaatacctctttatcaaagaaaaatagacactatgtaactttattgcattagaaaaaactatgctattgatattctcttttcagtggattatctcgaagcaagggttaatgttaatatttgtatttgttctattctgttggtactaatggaacaattctgttcgtaggaacaaagataaacagatctattctatacccaataagtaccaatacgcaatgggggttgatcccattttctatgagtgaatgcacccatacttgttcatcattcgaaggccctattcgtaaaaattttcctttattcattctgtcttcttttatgaacttatccaatctaaggataaaatatgatgaaggccaatattatgaagacaataaactcattgttacgtttccataccaaagtgaaataaagtactaaattcttttttctgtttttttatgcctattggtgttccaaaagtgccttttcgaaatcctggagaggacgatatatcttggattgacgtatagtgcggcttgtcagatatattgggtcatatggtattttcccgttctctccctcgatcgagatatcctctgtttcgcccaagaaagattgattgaatcatcaacaatttggagcgtgaaattcaattagatccattttatttttggggggatctagattaatattatcaaataatttatggttggcttagttggatcaataaaatgaagtatacaggctccgtttataaaaaacccaattggtaatatatgattactatattgtatcataaatgattttatttataaatagaaataggagtgatctcaaactgttaatcaatcgagtaataggatgaatacgtcgaatatttggtgaagacatgaaataaataaaaaaaggaagttgtagtaaaaagaagtggtattgggggcatttgtcctatatgtgcaaatcgaagtcgatcggatctttacccggagtagagcataaacctaaaaaaattaagaaggcccatttagaaacaagaaaatgacatcgtgatttggatcggatctcgatgagacaatacatcaatgataagttagttcgataagtttaatgaattctttttttttttttattttatatatatttatatatattatatggaagggtcaaaacttatctttcttgaaaaatcgaagaaaaagccccctcgttttagaaagagcttgctatgaaaaaaaagagggctggaatctacacattgattctttttcgcgattttttttagaaccgtatgcatcaaaaggtgcatgtacggttcctgagggatacaattttatcctaatcaaccgactttatcgagaaagattactttttttaggccaagaggttgagagcgagatctcgaatcaacttattggtcttatgatatatctcagtatagaggatgaaaacaaagatctgtatttttttataaattctcctggcggatgggtactacccggaatagctatttatgatactatgcaatttgtgccaccagaggtacatacaatatgcctgggattagccgcttcaatgggatcttttatcctggtcggaggaacaattaccaaacgtctagcattccctcacgcttggcgccaatgagttttttatttgatagaaaaaagcagactatgccttcgccatatgaaatatgaatattaagtaataatagcatggcacttcgaattcgatatgagaaaattctttattgttttttttttcaaaacattagattatgtatcgaaagagaagtatgagataaagggtatttccgattttatcttatctatcgggggtccgtttcagcgtcacaaactttttgttttcacaccagaaggctcttaacaatctttatgttatgaaaggatacgaaaataaaaaataatcttatttggttcttattttatttgatcagatcaaaaagaaactttgggattgctgaatcatagaggaaataaatatataacgtaacggagccatcatagtattttttaacttctccgaaaggaagggtggtaattggatcatttaccgatctggatctgacagatcctacatttttcgatggcaggtaaaagtcaattccattgtagagccgtatgcaattcgcaaaagatgcctgtacggttgttcaattctatctttttttcttgttattctttatctcttctcttcgactcatcatacgagatagagaaatcatttattatgttatatcatcagggtaatgatccatcaaccggctgccgctttttatgaggcacaagccggagaatttgtcatggaagcggaagaactactgaaactgcgcgaaatcatcacaaaggtttatgtacaaagaacgggcaaacccttatgggttgtatccgaagacctggaaagggatgtttttatgtcagcaacagaagcccaaactcatggaattgttgatcttgtagcggttcaatgaaaaaagaaaggatttcgtgcaaatccgtgatttgagatcttcttaccgggtttcattttcattaaattaaataaaatgggggtaatttataatcatccggttaggatcgatctaaaccagtacattatgtatatgattcagcatgccaactattaaacaacttattagaaacacaagacagccaatcagaaatgtcacgaaatcccccgctcttcgggggtgtcctcagcgccgaggaacatgtactagggtgtatgtgcgactcgttcagatcatggactgggacgaaaaacaacttttccagtatcaatgatcagtaccagtgaatagaatggaagaactccattcactatctaaactaaaaaaaaaaaagatctatcatattcccctattgtgtattgtgtatgaaatttatggtttccgtcggtgcaaatacaatcacctaaatttaagataataagcaattccccattggcaaaagggttatccattaagcggggaaaatcagcagaaagattaggctcccactcttgcaagaacggactaacagggtcagctacttagctaaccttcataattaaataccgttactgtataggtagatctcattgtgaaagacctattactggataattcatgggtagagccaaagagtgtgaactgtacaagttaccaataagatttattaaatgaaggaaggagctccggtgtatagaaaggacctcaccgtttaagaagtaaccatagaaacgatggaacccactatttctttatccatttaatttcaaattgactacttttttagttaatttactatgtttttgatacctagtatcaatactatttcttatttcgaggtgaaatgcatagaaaaaagaaaaaaaaaatcgtggtcgggaaggttatagtagcaaaagccattggaatttttattttatacattggaagaatccgctttgttattaatagaccaggaaagggtacaaggataactgaaagaaaggaaatcaattagttattcatcaaagtttcatttattcaatgaccagaactagacgaggatatatagctcgtagacgtagaacaaaaattcgtttatttacatcaagctttcgaggagcccattcaagacttactcgaactattactcaacagaaaatcagagctttggtttcgactcatcgggatagagatcggcaaaagagagattttcgtcgtttgtggatcactcggataaatgcagtaattcacgagaatggggcatcctatagttatagtagatttatacacgatctgtacaagaggcagttacttcttaatcgtaaaatacttgcacaaatagctatatccaataggaattgtctttatatgatttccaatgagatcataaaataaagagattgtaaagaattcaccggaatgatttaatgatttaaataaatggagttccccggagaatgaactccgggaaggtagattctaaattagtatgataaaatatgataaagtcgtcaaaatgaaggaatatgttcaataaaaaaaaaaggatttcttcttcttccccgattatttttgtttcttacaacacaacaatcaaatctcgattcttagatttttcgaacaaaacatcaaatccgcgtttgagttcgaattggaatttcgattcaattgaagagtaagcctatttatttctggttctaagaccagtagttctagcggtcgactcggttctttcaaattgtttctcattattaagaaaaggtaacgaagataaaatacgagcttgttttatagcaatagtaattaatcgttgttgtttcaaagtcaatctattcactcgtctagataatatttttccttgttcactaataaatcgactaattaaactcatgtttctataatcaattcgatcccccgattggatcgggggcaaacgcctacgaaaagatcgcttggatttaagaaaaggtcgcttggatttatccatggtttgtttattccttatcccgaaaatcctatttcgttcggatcaaaaatgaattagaattcagaaataggatttggtttatttctatttaaatatatgttatatatattatataatattatatactatattattttactatattatttttactgttccttggaagggtgacacacaggccctcggttcgatctatttttttatctccccatgaatcgtatgtttataacaatagggacagaatttttgcaattccaatcgaccgggcgtattgtgtcgatttttttcagtaatatatctggaaatgcctgttgattccttattaacaccgcctcgtacacaactagtacattccaaaagaacccttattcgggcatctttactcttggccatgaacctcctttgttttttttttattcattcaagtcttctattttcgatccgaagaaagtaaggaaaaaaaatagaagttgctaactcaaaatccaattatgatatgaaggatttcgttgtaatcaatatcaatagagtaatagtaaataataagtaatacaatgatttctaactataactatatttctaatcgcagtacagtatttaatttaaggatcttgtatgatactcttgcactagaccaacatttacatttacgttttccctctattcttaatttgattcgagtctgaacccgagtttcgctgaggttaaatccacttttattctttctcttactcctcccttataaaattctaaaaaagagaaaaaaagaggagggggaaaggaattagtcacagatatttgattgtatctctaatattcttcaccccttctcatgttaattaaaaaaagggaatgtcaacgcatccgggaataaacgattaatctctatcaatagacctgctaaggacccgaaccatatagtacttagtaccggtgccgtggaaagatatgtttttagatctcgcatttaaaatcctccttatttattgtaatacataatggtaatacatatatgatcagatgcatatggaccacttgtatttgtacacagaattcccgattcaaattgaagattcgctagataagattttctttttcttaaaacataaaaagaagtttctttactcctgagcattccccaaaaatattcatttattttttatttcatttttagggtgggtttcatattttatatgtatataagtcttttattattatatgttaatatataataatatgataaaaaaaaaaagaagaaatgggaagaaaaattgtgtatatcaatggaggaaataaggatgtggaaaacaagacaggtattctctacaatgacactgtagaccaattgaaagggatgtagcgcagcttggtagcgcgtttgttttgggtacaaaatgtcacgggttcaaatcctgtcatccctacctattacttctcctctgagcagtaacgaagaatcaattgagatcaattaaaattggatatacataatttttcattttatgatactataatagtatatgcatacaagatgtgttggagttacaaaaagaatccttttctttatagtcttatctattgtgataagaaaacgctcttagttcagtttggtagaacgtgggtctccaaaacccaatgtcgtaggttcaaatcctacagagcgtgattccgtttttgttagttggaattacactgaactaacttcactaacttgaacagcaatctgaatttgacctcctgtggattaaagaataaagaaaagaggaggtcaatcaaaaaaagagatgttaattaatcaaaggtccaactgatcaccacgtctgtattgtaaatatgcagttacgaataatccagccaaagtaataggaattagacctaagacgattccaaatagaaaaacttcaatcatttcatttcaatttgtttgaaaaggggaaaagagaggtaatatctatccctaaatcttaatccgaattgcccatgaatcgcaatgaccaagaattggcaattgacacggtaaggaactcatagaatacatggaatctcacggaaaggtttctctttatgaattgtttattcgattaatttcaaataagtcgtatcttgcttagaccaataaataggactgaggttatagttgaagccgctagtagaaaaccgaaataactagttatagtaggcatgaaggagctaaatgaaatatgttctttattatacatatgtttataaagcacttacctaagtttccatttttgcgagatacgaggataaacaaaaataccaattgaaagaataagttaaattgaaagtttttgattcatcaatcaattattataggcggcactaacaaagatagagtgacagaggtataaaaagaaatcgattcattatctgtggcatctacccataccgtgattccgaatcaacagattcattgagcaactcttgagtaaactaataataaaataagaactgtgccgtgtaacttcattcaaaaatgaaactttctttgcgtcactatgaaacaaaattagaaaatcatttctattttgatcatttcttttttaattgtatcgaatacattttatattttggaacgaagagtgcccttataacaataaaatcttttcttttactttttactttaattttaactcattagattcaatagtaggttcattcacatagtatctcgaatgagaaaaaaaaaaagatatcgcacgatcagatcactcgaaaaaataaaatctgtattttggttcaattagattctaaaaaattcctattatcttttcctttataggttccacattttgtctttccatattataacttctagttaggtagttaggtcaagaaagaacccttagatctaatacaacaatgcgtgcttcgcgaatattgattgttcccattattttattcattgttctctttctttcatcgaatactatctactactgttacttgttattggataactaagaaattctttaaaatgaaaaaaaaaagattcaaaaaaaaaaaaacctcttctacaaccacgaaaacgaaaaggcgatttctagatttcgtatcaataaaattgtgggaatatgataatctctttcatgaattattaaaaagaaatttgtcagattcacatttattttacctgatcttcagtttctagtccgaaaccaatagtagagagaaaccctatactacaggaatttgagagattttctattgaatggcacatggttctacattgataagcaacaagaaaggaagaaagaacttttctaacacttcatttcgatactgattgaaattgcgttgctgtggcagaagaaggatagctatactgattcggtatactctaaagacaccctcggtacaatattgacgatctcacaaatatccattttcagtgaatttctatttactgatctcatcttttacgaaatcgatcgtcctttgactgtacaagaatatgtggagctcggcatgtctggaagcacaggagaacgttcttttgctgatattattaccagtattcgatactgggtcattcatagcattactataccttccctattcattgcgggttggttattcgtcagcacgggtttagcttacgatgtgtttggaagtcctcggccaaacgagtattttacagagagccgacaaggaattccattaataaccggccgttttgatcctttggaacaactcgatgaatttagtagatctttttaggaggccccaatgaccatagatcgaacctatccaatttttacagtgcgatggttggctgttcacggactagctgtacctaccgtttcttttttggggtcaatatcagcaatgcagttcatccaacgataaacctaatccgaattatagagctacgacacaatcaaacccgaacgaacaaaatgttgaattgaatcgtaccagtctttactgggggttattactcatttttgtacttgctgttttattttccaattattttttcaattaagaattaagagaacgaaagagactaataaaataaataataatagtaggaattctcttatcccattcggaaggatctcatctcataattatccatgactgtttatgtctctagcatgaccacttgatgaaatgtggagggaagtggggtaaatggccgatactactggaaggattcctctttggctaataggtactgtaactggtattcctgtgatcggtttaataggcattttcttttatggttcatattccggattgggttcatccctgtagtaatcggatgaattgagttgtcgacatgaaagcgtaagaactcaatgggacccacccccttctttggccaagtttgtctgattcgagagggaaggtcccgttgagttcttaataatcataagattttattcggataaatgccagacaaaacggatctccttttacgatgtttaaaaaaactccatttcattttttttctgatgatgtttttgaaaaacgaacttgattgattgattcagaacatctgctcctcgatagtatctatcgatcctttcaaagttagaagaaagaaggaatcactcgattttctggatgacacagtataatatatatatttccctagatcagatatcatacaaatcctttctatactaatagattcttactctatttattttagtatctaatcaaagttgaaaattttttttataacttcattgaagaagttctatttgttcaataaatttccctctcttttttttttgtttgtccactacttcttatacgtaataaatctaaaattatgataaacctagaaaaaaatctaaactaagaataggaatttttgacgaaggtgtcgaggatcattattatttcgacacaagaaagggatgtggaaaattcctttcttgtgtggaagactaggaagacgaataacccttcctagaatcatttgtttccctcatttcatttatcctttgctttatattctacgcttacttatgtctagtatctagtcgaattggattctattattctaatagaaaactattaatgcattctatgacattgacatttaaatctggcaatagtgacacagtcacaccactccaatttagattgaaaaaaacaaagaagagaaggggtaaagtcaaataatcttcttcacaatatacatactatgtataggaatgcggtacaattaattcccgacatctggtagaaaaagaatataaagaagaaaaagacttttcataattttttttttttgatcatacataattgccaacaagaatttggttctttttacgaacttgatgttgataaatccgcggatctagaaattcatttcggacaattgaaccttctcaaactgtttctttttaagaaccaaaaagatttgtgccaaaataacagaagacaagaagaacaaaaggccttggatacgtaatggatcttgaagtactatttctgcatctccctgaccaaatccacccacattaggattactcgttaatggttgatcaagtttaatagattcaccctctgaaacaagaagttctggtcctggagggataatatcaaccacttgacgtccatccgatgcatccgctatggttatttcgtacccccctttttcttttcgtatgattttgcttactatacctgccgctgtagcattataaactgtattgttactcttgctcccgtcaggataaatctgaccccttcccctgttcccgcctacgtatatgggatattttaagaagtgaacatctttcttagtagcggggtcgggagaaagaataggaaaggtgatttcactatatttttgaccaggaacaggacctatcacaagaatattttttttagtagggcgatagttctgaaaagatagattgcctatcttttctttcatctcgggggaaatacgatcgggtggggctaattcaaacccctcaggtaaaataagaacagcccccacattcaaagcccctcttttaccattagcaagaacttgtttcatttgcatatcataaggaattcgaacaactgcttcaaatacagtatcaggaagtaccgcttgtggaacctcaatatccacgggcttattagctaaatgacaattggcacatacaatacgtccagtcgcttctcgtggattttcataaccctgctgtgcaaaaatgggatatgcatttgaaatggatgtccgagttattatatatatcataagcgatacggaaatggatcgagtaatctgttcctttatccaagaaaaggtatttctagtttgcatggtccaatcattgatcccgaaaatttctacaataaattaggtaggtcgctagtatagttccctatccacgattctgctatttactgaaataattttactggaatataggaggaatcccttggatgggtagaaatataaaaagtaagcacgattttgaacactttgtttatgtacaaagtaacaaacattctaattggattaatatcaacaatggattggatcatttttcagtcattcattgaatgataaatcactacaagtgacggagatacacgatttaaataccggaagatccaatattttaaaattgtatctagaatgaccggaaaggtggaaacaagaccagatataatttgatcgttatgagcaaatccaaaatctttgtagacagagccaatcatcagttcccaaccatggggcgagtggaatccgatacataaatcagttaataaaagaatagaaaaagcttttattgtgtcgcttaagttatataggaattgctgaatccaagagttaagaataagaagttcttcattacccagaatagaataaccacttagaataacgaaacagattatatttgtcgagaagtgcaaaatcgtatggataggatcctcattgtacatcttgatcaattggatcgtttctttgtggattcccatacgaagcttttgtagatgtgtttccgggcattcctttatcatttcgtccaacaagaagagttcctctaattctatgaatttttctagaatactcttttcttgaatatcattcaaaaaagtttcagattgcctagtattccaccaattagtaacccaagattccagacttttattaagtgatagagagatccaccagggcaaaaatactatagatgcaagatatagaaggggagtgaatgctttcttttttgtcattttttttttttcagctgtgaattgttaatgaacccaattcattcgtcgactctcgatctaatagttctatcaagcatgagttctattacaaggtatcgagcctatgaatctattctatgttttttatttgcgattcagcagttagtccttgaatctagaaagaatacagaaatagaataagagtccacttcgaatgaagaaataataaaaaatattgtttccagatatctccgcaattggtcaaattctaagcacccctttcgatgaatgcccaagaatgcccgaaagaaccgcttttttaatgaatattattcggatttcaagacgaaagaactccctttcgaccatttctatcaatatatttaatatttcgaaaaacttttgctggctaccggaataattgagagaaatttctgaagaatattgtgatgggctgaagtggcaaaacaagatagaaatttgatagttatcattataagaggtttagtcattaaggaacacaaaagaaaggataaaaagaaacgccgattgacaaaaaagagagagaatttacaagatatgatctatctgcatctagcgtatcaattccaaatattggacctaaaataaattctttatttcgaaatgttttgatatatgggaatttttcgatttgttacttgctttgttactgtgagtagatttccatacgcataaaagaccatttttgcggacaaaaacagtttccttttatgatcgtatacgtctgctttggctcaaatgagcgaaacttcagttaagttatgctatagaaaaggaagggcggattcttgaattttttccctcctgctaagaaatcagttcatttcaaaatacttcaatcggtacacgcaagaaataggctaattcagcagctttttgttccatttctcgtggcgtcaaattctcatcagtacgagtcaaaggaatggccccctgtcctctgatttccatataaaggacaaggatacgacgggcataaatatcctctttaactgctattctgatggactgaatatctttcataagtaatcggaggaagatccggcgattttttccaggaaatccccaacgaaaaatacacactattccttcttttctatcgaatcgatcataaccactacctacattccacgaaattgtgcaccacaaataggagctaataaagagaccggcaatcccgtagaaagacatcacgatcccttgtggaaaaaaaattatttgctgagacggaaataaagatatcaaattcctaccaagataactggaagttccaaccaataagaaccctaatgaacctaaaaaaaggataaaggcccagcagaaattacttgtttttcgagaccccgttataagttctatccatatacgttctgatcgccaactcatactagatccagttgcattttattgtaattgagagaataacccaaatgaattttactttactctttttgtttccgaagtaactctcatcaactagcactattctgatgtgaacctttaggcgtaattcatcgaattggttaaatctaaaataataacatccccctcatatgatcccctatagatatctacatacatatagatttccatttcagacatccgatgatcctgatctattttaaaatagctataatttatttacccatatatcatgtttccacataccatacataagagctctttcatttatgttctgaggaagccacatgttataccatattccactaaatggatatctgtgttatgatccaagtctaagtcttgaaaaaaaaaagaatggatgagatgtggttccatcggatctaaaaaatcttgtttttttgaacatgaagaaataatgaagccattgcaattgccggaaatactaggcccactaaaggcaccaaaatagagggtaagttaagagttatcatagaatgggtacctcgatttaatatttgtattaatatttgtacctgttattgttataaagatattttataataattagtatagaattcgtatataattatactaagtatatctaagtgagtataaatatagaataagtgcaaggaaaatagtactaaataaatgtacttatccatctttctacatataatatatgtatgataatccactttattattcttcttttattattcttcttttcccgtttttatcttctaatttccatttttttactaaaatttgaattagtattcaaatttgaattcaaatttaataaagaaagagttttaattcccgaaaaattcgtccgatctaagagggattcttagtaaaaatggggattctcggtagatatagaaagatgcaagactctatatctataatctatatttccttatattttctatagttaagtcttatatacataagaagggaacatgaaatttttgtatttgccttgcctaatctaatttcggggaaggaagatttcgttcttttatcttgtcgatagaggcttcctgattactaatcaggaatatgggtaaaaaaaaagatctcgagaaaaaaaaaagaactattcgcaacctttgattctttctacaattcgatcttatgtcactaaagaaaactccatttttctgatttttactttaattccgataaaataactacttgtttgacacaaataaaataattgaacttaaggctctacttgattttttttggattcaaaggaaagaaagcgtgaagctgaaataactcactcagaacaccctttaaagtattacgtggtacgattggatcgaataagcccttatggaataaatattcagccgcttgtgaaccttcaggtactgtctttttcaatgtttgttcaattacccttttacccgcaaatgcaatgtaggaattgggttcggcaataatgatatctcccaacataccaaaacttgctgtcaccccaccagtagtaggagatgtaaggattgatacataaaataactttttatttgattgataatcatataaagcggaagatattttagccatttgcatcaagctcaaacttccttcttgcatacgtgctcctccggaagaacacactagaataagaggtagaaattcattggtggcatattcgatcaaacgggtaattttctcacctactacggatcccatactaccccccataaactgaaaatccataaccccaattgctacgggaataccgtttagttgacctgtgcctgtttgaacagcctcagttaatcctgtctttctttgataaaaatcaatacgctctttataaggttcctcccccgaatgaaattcaataggatccagagagaccatgtcttcatctacaggatcccacgtacccggatcaatcgaaagttcgattctatctgaactactcattttcaaatgatatccgcattgttcgcaaatatttatttttgactttaaattttttttataatttaatccataacaattttcgcattgaatccacaaatgcctgtatttttgagctacatatagaacattagaactttttaaatcactaccattcgtgctagtttgtttactggaactcccgtgttcactcctagttctactttgaccacaaatgtaactataaatgtaactgtcactgtaattgttactaccacttaaaatgtaattattaatgcaactattaatgtgcttattccaactatatttagtatcatacatgtaacgatcatagtggggatgattactcttagatacattattcagataactagaatttacattattcagataactagaattccgataactataaaaaaaactttctagttcactcaaaaaagactgatcgttatcaatctcaaaaatttgattttcaatatcaaaatatatgaaataactgaccccattcctatccctaactaaaaaagtgtcatcagagatgaaattccgaatgtccctgatgccgaataaatgatcaacattactataactagaactcttaatttgactccaattattaatgtttttatccgtattatttataacccggtcttcacttccactggtattttcaataggatcaggactgtccgttgatttacttagcccacacctgtattctaacttctcgttagacaacatcgaattgaaccaccatttttccatagagctttcttgccccctatttacattaaaatacaataaatgaatagtcattcgatgaaaaatcatttgaatatttcatttcctatcacaataagcatatagatccaatcagtaggattattaactaataacgagtgagtattgaaagaaatgattctattttgtgggaatctgggatataacttcactatacgatacggcggaaccccctttcaattataaatataaagagtggtttctcccatggcgtgtcaaattcgcatcgaaaaaaagaagtatttgttctctcctatgaacaatttttttcgtaaaatatcatctaataataagtttctattacaacacggaatgaaaaggacaatatacaggatggggtagaaggagttgtgatacttggctcgatatatggccgaaactacaagatataaaagaatacgccaatcctaaggatccataggattaattgtggatctaacacaacaatagaaaatttgagttgtttagtcttagattttgtattgtatatctagataagtatgtatctatccaaaatatatacatacaatagtctttttgtattcggctcaatccttttttttagtaaaagattgggccgagtttaattgcaattcaatttaggaaacgaacaataattactggattacaaagtatccattgctgggaattcaaatttgatttccttccatacttcacaagcagcagctagttcaggactccatttgctagctgcacggataatttcattaccctcacgagcaagatcacgtccctcattacgagcttgtacacatgcttcaagagctactcgattagctacggcacccggtgcatttccccaagggtgtcctaaagttcctccaccgaactgtagtacggaatcatctccaaagatctcggtcagagcaggcatatgccaaacgtgaatacccccagaagccactggcagaacacctggtagagagacccaatcttgagtgaaataaataccgcgacttcggtctttttcaacaaaatcatcacgtaataaatcaacaaagcccaaagtgatctctctttctccttcaagtttacctactacggtaccggcgtgaatatgatctcctccagacagacgtaaggctttagctagtacacgaaagtgcataccatgattcttctgtctatcaataactgcatgcattgcacgatggatgtgaagaagtaggccattatctcggcaataatgagccaagctagtatttgcggtgaatccccctgttaagtagtcatgcattacgataggaactcccaattctctggcaaatacagcccttttgatcatttcttcgcatgtacctgcagtagcattcaagtaatgccctttgatttcacctgtttcagcctgtgatttaaaaatggcttcggcacaaaataagaaacggtctctccaacgcataaatggttgggagttcacgttctcatcatctttagtaaaatcaagtccaccgcggagacattcataaactgctctaccatagttcttagcggataaccccaatttaggtttaatagtacatcccaataggggacgaccatacttgttcaatttatctctctcaacttggatgccatgaggcgggccttggaaagttttagaataagcaggggggattcgcagatcctctagacgtagagcgcgcagagctttgaacccaaacacattacccacaatggaagtaaacatgttagtaacagagccttcttcaaaaaggtctaaagggtaagctacataagcaataaattgactttcttctccagcaacgggctcgatgtggtagcatcgtcctttgtaacgatcaaggctggtaagtccatcagtccacacagttgtccatgtaccagtagaagattcagcagctaccgcggcccctgcttcttcgggtggaactccaggttgaggagttactcggaatgctgccaagatatcagtaggtttggtctcatattcaggagtataataagtcaatttgtaatctttaacaccggctttgaatccaacacttgctttagtctctgtttgtggtgacataagtccctccctacaactcacgaattaagaattttcacaacaacaaaacaaggtctactcgacatgaattaggtgttaatgaaacctttcacaggaatctttcacaaaattctcaactaatattatcaactaatcagaatggttcattattagatcatggtatttaattcgccaaatacattattattttatactctgtcatatgtatggcgcaacccaatctttgtttttcaagtttctaattccttactttttctttttttgaatcgaaatatctaaatataaataataataaattcaccccttgacagtgatatatgttgtatatgtaaatcctaggtgtgaaaatatgaagaattcatccattaacattaaaagaaaaggtataaaaaagaaaagaataggcttaggctaggcgtaaatcgatatgctgaaataagaaataaataagagtcaatgagaaatgagatagaaataatgaatcgtaaatagagttcaggttcgaattccataaagaatatggatgggattgtctataatgatagacaaatgaaagactttcataatcttattcatcattttgaaaacggcttggttgaacttaaaaattagctcattgaataagtaaacaattgaattggattcggttggatggtaccaacgaaatcgagtgctaactcccatttcttattgaattaaccgatcaactttctatcgaacttttggattcgataattttcgcaaaaaatttcgtttaatttgactttattattattattatgagaataaatcctactacttctggtcctggggtttccacgcttgaaaaaaaaaacctggggcgtatcgctcaaatcattggtccggtcctggatgtagcttttcccccgggcaagatgcctaatatttacaatgcgctggtagttaagggtcgagatactgtcggtcaacaaattaatgtgacttgtgaggtacagcaattattaggaaataatcgagttagagctgtggctatgagtgctacagatggtctaatgagaggaatggaagtgattgacacgggagctcctctaagtgttccagtcggtggagcgactctcggacgaattttcaacgtgcttggagagcctgttgataatttaggtcctgtagatactcgcacaacatctcctattcatagatctgcgcccgcctttatacagttagatacaaaattatccatttttgaaacaggaattaaagtagtggatcttttagctccttatcgccgtggaggaaaaattggactattcgggggagctggagtgggtaaaacagtactcattatggaattgatcaacaacattgccaaagctcatgggggtgtatctgtatttggcggagtaggtgaacgtactcgtgaaggaaatgatctttacatggaaatgaaagaatctggagtgattaatgaaaaaaatatttcagaatcaaaagtggctctagtctacggtcagatgaatgaaccgccgggagctcgtatgagagttggtttgactgccctaactatggcggaatatttccgagatgttaatgaacaagacgtacttctatttatcgacaatatcttccgtttcgtccaagcaggatccgaagtatctgccttattgggcagaatgccttccgctgtgggttatcaacctacccttagtaccgaaatgggtactttacaagaaagaattacttctaccaaggaggggtccataacttctattcaagcagtttatgtacctgcggacgatttgaccgaccctgcccctgccacaacatttgcacatttagatgctactaccgtactatcaagaggattagctgccaaaggtatctatccagcagtagatcctttagattcaacgtcaactatgctccaacctcgtatcgttggtgaggaacattatgaaactgcgcaaagagttaagcaaactttacaacgttacaaagaacttcaagacattatagctatccttgggttggacgaattatccgaagaggatcgtttaaccgtagcaagagcacgaaaaattgagcgtttcttatcacaaccctttttcgtagcagaagtatttaccggttctccagggaaatatgttggtctagcagaaacaattagagggtttcaattgatcctttccggagaattagatggtcttcccgaacaggccttttatttggtaggtaacatcgatgaagctaccgcgaaggctatgaacttagaaatggagagcaaattgaagaaatgaccttaaatctttgtgtactgacccctaatcgaattgtttgggattcaaaagtaaaagaaatcattttatctactaatagtggacaaattggcatattaccaaatcacgcccctattgccacagctgtagatataggtattttgagaatacgccttaacgaccaatggttaacgatggctctgatgggcggttttgctagaataggcaataatgagatcactgttttagtaaatgatgcggagaagggtagtgacattgagccacaagaagctcagcaaactcttgaaatagcggaagctaacttgaggaaagctgaaggcaagagacaaataattgaggcaaatctagctcttagacgagctaggacacgagtagaggctatcaatgtgacttcgtaactagtcatgtgcccgaaaaatcaaaagaagttctgtttatacaccctattttgattctgccgattgaatacaatcaaatacaatcaaatggaatgggattctgatgcaacgaaaaataaaattgcattttaaagccaaaaagcaaatagaataggatggaaaagatacaaaatcaataaaagaaggtgggtagaaaacttattagataccattgactctggtatctaataagttctacctactattggatttgaaccaatgactcccgccgtatgaaagcaatactctaaccactgagttaagtaggtcatttatcatcctaaggagaaacaaatggaacccatcacatcgatggattataaatagaatattatttataagcaataccaatcaaacagatcaaagagttatcatgttggatcatggaatattcatcttgacaagaaattatctacatgataaaatatgtatcacaagtacaagggctatagctcagttaggtagagcacctcgtttacacgcgcgccaatgtttttcaggagagtccatcatgcattgatcttattgagaaatcgatgtcttactccatgactttgagggaacaagagaacaatagcctgacaaacgattcggtccgatttgggtgcccatttaatttaagcgccaaatagaacccatcattttgagatattgataaggtgaatacccagtctattcaatgctaggcctaatgagtataaggacctcaaaaaaaatctcttttcgtcctatgaactttaaggtgtatgaagtttcatatttgattctttaatcagaacgatagagactccatttaacttaagttgatctaggccaaaggcagacctacgtcaagataaccctctttgaaaaactttggtagtgctcctggatcagaatcaaaataatgaatcagagcacatggagccatctctttatctttctgtcaagaaaaaatatggtggactaactgatatttatatcagttaatgaaagagcccaatgcaaaaaaaatgcatgttgggtctttgaaacagttcaaatcattttgataataatcagtttgatctgttttaccgagaaggtctacggttcgagtccgtatagccctaatataataaataagccctataaaataaaaaaatgaaaaacaaaaaacgcatttcaatggatccactcggtatttttccagtctcggataaacaaacaaatttttcttcattttgttttttcttcattaatctttgtaagtaaattacatatgaattttcctgtccacaatcaaagagttagtgatatttcttttctttggctttggtatacctacctaatcctggtgaatttttggagtcaaaatcatgacatgagcccagttaaaaataaaaaactccaacccaaatcaaatctaatagaaatctaatctaatagtaagtcacatggatatagaacgacctgggtacaaaccagggtttgaaaaacgaaaatctttgctaagtttcattataaactgtaaacattctcaacattgttaaataggttttttttcttggtataccttacctagcaaagcacaaaaaaaataagtagtcttctctttccgtatccaatcaatacaagttcctatatctggattctaataactaataaaaggaatataccaacaccaatattatctaaatcctgaaatgtaaattcctagacattctcctacatctgattgcttacgctattctaaatcactaagcaaaaagagacaaaaagaagacagccctcctctttgatgattctagtcataaacataaaaaatagaaaataaaaaaaatagatttccattttgaatattaatttttaattaataattattaattaataaaatttttaattaaaagaaaaaatggaattcgaatttataaacaaaaactcaaaattctatttgttgaaattctttttgtttagagagagtccaaggtgaggtgaaagtgagaaggttttatttgtataagagcaatatatatttataatatatcgaaataaaatcgaagtaagtataatggaaataggattccagtcaatgaatcttcaaaggagatacgtaccacagcaaacaaacgaaactagtcggttcgatcaaaataaaatgaattcttgttttgactaaacagttatggatgacttgacaattccaatttgagtcggctaatccagtatattttccacattcataggagtgcttctatgtttctgctttacgaatatgatattttctgggcttttctaataatatcaagtgttattcccattttggcattttttatttccggagttttagctccgattagtaaaggaccagagaaactttctagttatgaatcgggtatagaaccaatgggcgatgcttggttacaatttcgaatccgttattatatgtttgctctagtttttgtcgtttttgatgttgaaacggtttttctttatccatgggcaatgagtttcgatgtattgggtgtatccgtatttatagaagctttaattttcgtgcttatcctaattgttggttcagtttatgcatggcgaaaaggagcattggaatggtcttagctcctgaatattcagacaataaaaagggaaaaaaaaataacattgagacagttatgaattctattgagtttcccttacttgatcgaacaacccaaaattcagttatttcaactacatcaaacgatctttcaaattggtcaagactctccagcttatggccgcttctctatggtaccagttgttgcttcattgaatttgcttcattaataggatcgcgattcgactttgatcgttatggactggtaccaaggtcgagtcctagacaagcggacctaattttaacagctggtacagtaacaatgaaaatggctccttctttagtgagattatatgagcaaatgcctgaaccaaaatatgttattgctatgggagcatgcacaattacaggggggatgttcagtacagattcttatagtactgttcggggagtcgataagcttattcctgtggatgtctatttgccgggctgtccacctaaaccggaggctgttatagatgctataacaaaacttcgtaagaaaatatctcgagaaatctatgaagatagaatcaggtctcaacaagagaatcggtgttttactaccaatcacaagtttcatgttggacgcagtactcatactggaaattatgatcaaaggttactctatcaatccccatctacttcagagatccctcttgaaacatttttcaaatacaaaagttcagtatcttcccccgaatttgtgaattagtcaagattcttttgtacagaataacaagcagcacataaatttcatcgtaaatgcgaaatacttatcaaataaaaatgcaggagagattaaaaagatgcagggtcgtttgtctgcttggctagtcaagcatgggctagttcatagatctttgggcttcgattatcaaggaatagagactttacaaataaagcccgaggattggcattccattgctgtcattttatatgtatatggttataattatctacgctcacaatgtgcctatgatgtagcaccaggaggactgttagctagtgtgtatcatcttacgagaatagagtatggtgtagatcaaccggaagaggtatgcataaaagtatttgcctcaaggaggaatcctagaattccgtctgttttctgggtttggaaaagtgcggattttcaagaacgagaatcttatgatatgttgggaatctcttatgataatcatccacgcctgaagcgtatcttaatgcctgaaagttggataggatggcccttacgtaaagattatattgcacctaatttttatgaaatacaagatgctcattgaatgataataaactaatcttcacttctacaactccagatattcaagaaatatctgtacgttttggtctagatcaaacagaataattgaagtcttattcgtattgtattatggatgggctaaataaataaaaaaaaaagaaaaggactcattgagattctcaaattttgaagatacttagagcctagccaataggatgaactaaaagaaaagagttctgcatcatgaactttgtaccgcgcacataacttagatgggctctagaaaatcacgtaggggggaatgaagaaatagaaaatagaatatgaaagaaaatacaaagaaatgaaaggggatcggattatatttgtactatatctgagatgaaccttgtctattcccatccttcaactactctagactatacttttgggtctttcaactaactaatttaatctttcgaatatgtatgtatgaagtattaacattctttttgaatgagagtagacaagacacaatatgaacaaaaaaaataaaaaagaagaggaaacataatcgaattcttttcttttacatattttatatactttttacttatctaaaagatggaggagtatatctccagacacctagagggataagtatatatcatgatctagactattaatgaatatgtatatcgattcatctaaacatcaatgaatttgtagaatagatactcagacaaattaatcatgtgccaggaaccagatttgaactggtgacacgaggattttcagtcctctgctctaccagctgagctatcccggctattcccgatacatcatcctcattttactagatgacttggtctatgtcaattaaaaataaaaagacgaaagggtattgtattacaaaacaaagtattatccaggacctggaatttcttggatcttcaaaaaaaaaaactttgtaagtttcagtacgaataatgatatgtactgtgaatcattcaaatggagattccttgctcaaagatgttcgtttgtacgcgtatcatatatatataccacaagacttgtgataagagaaaaaaaatttctgcaaagagaggataggataggataaatagttagggagtcaagtaggcttttttggggatagagggacttgaaccctcacgatttttaaagtcgacggattttcctcttactataaatttcattgttgtcggtattgacatgtagaatgggactctatctttattctcgtccgattaatcagttcttcaaaagatctatcggactatggagtgaatgatttgatcaatgaatattcgattcttttctttcttcaacttggaatcgatttacaacaattctttcatttttcatatcaaaaaatacagattcgagccatcattaatcatttgatataatatttcagtacctatgtatataggtttatccttcatcctttctggttctggagttttgatggaaggattcgtttaacaacgcaacatagtcaactccatttgtttttgttagaacagcttccattgagtctctgcacctatcctttttttattatcgttttctgaacccttggttgttttcggaaaacaggatttggctcaggattgcccattttttattccagggtttccctgaatttgaaagttatcacttagtaggtttccatattaaggctcaatccaattaagtccgtagcgtctaccaatttcgccatatccccccttaattttgttttgagatttgaatctctttgtgatgccgctccccttttcctttcatttatgcttatgctggaacctttgaattcattagataccgattcctaaaaagtccttcctcctttttttcttgcctatcttctttcatctcatctctcttggggaccatatttgtatttggtccaatcagaaatgattctatcatttctgtatctgcaattcaatatacatgagatatataccacacatatatgcttcccttcttctcatctttctcatacaatttgagaatactcgaacggtcgattcttttttttgtcttagcttccacctttccgaatgaaagcagaggaatgtctcattatgatctgaattgcatttatctggattgcatctttctatttcatttttcttatcctttccttagtccttagagcagaccctctataactaaaatgggaattcattaatgattatttaatgatcactaagtattaatatattttaaaaatgaaaaaattatattatggaattctaatgtatatgtatattagaataataagattctaatctaataattagatagagaatttctatcttatatagaaaagtatatgatatatgatatgtaatcatatcctatatgtaataatattataatataaaacaataaaataaatttcaaattttatttgaattcaaaaagaaaaatgaaaaaaaaaaaagaaaaccttactatctaattaagatattgattatttttaaacatataattgataaatagatcgaaattatatattgctctattctattaatcgttaatattcaatatttttttttgaatctatattctttattcttttatatattcatattaattgtgactagctaagaaggaatagttaatagctaagataccagcagtttactgaatttctatgcatgtacaatttctggtgagcccgcttagctcagaggttagagcatcgcatttgtaatgcgatggtcatcggttcgattccgatagctggcttttctctatttgtttggttattgataatgtctctttaaaatcaaagaataaagattattctcctttctccaaaaccgatctattatgtcgtaggaacttacaactatgaatcaaaatagaaggagttagatctctgcagaacaaatcaagaacaatacaaaagggtctggatattgagacaattcatctcattattctttgtagtacaatacttcagtagatttcgcttcatttatcatttagttcagttttaatttaagtttttctgtaaaatgaaatttcaataaaataaggagtctttatgtcgcgttaccgagggcctcgtttcaaaaaaatacgccgtctgggggctttaccgggactaactagtaaaaggcctagagccggaagtgatcttagaaaccaatcgcgttccgggaaaagatctcaatatcgtattcgtctagaagaaaaacaaaaattgcgttttcattatggtcttacagaacgccaattacttaactatgttcgtatcgccggaaaagccaaaggggcaacaggtcgggttttactccaattacttgaaatgcgtttggataacatcctttttcgattgggtatggcttcgactattcctggagcccgccaattagttaatcatagacatattttagttaatggtcgtatagtagatataccaagttatcgctgcaaaccccgagatattattacggcggggaatgaacaaaaatccagagctctgattcaaaatgtttttgattcatcctcccatgaggaattgccaaaacatttgactcttcacccattccaatttaaaggattagtcaatcaaataatagatagtaactgggtcggtttgaaaataaatgaattgctagtcgtagaatattattcccgtcagacttaaacctaactaaaataacgagggttcggtcaatttgaccccccccctttttcgccgaagtaaattgacctacggtaaggggtcagagatttttctcccattcatatatcatagatcggcagggatatttttattccttgtcccccctttacagtacagtattttatgtaccacagcaattaggaatagagaatctatatcaaagaaaggtctaactgttggaatatttgttatttgatacagtgcggtcagtaacattggtgaattaggtgaaggtacggaaagagagggattcgaaccctcggtaaacaaaagcctacatagcagttccaatgctacgccttgaaccactcggccatctctcctacataatgattatgacccagaaaccgagtgaatagcgagtcatttagattattggataggtatgaccaatccaattctaactctaaatataaggattccctttttttagactatggttaatggatatttttagatcatgattctatttagactatgattccatttccataagaattttaaaattcctttccagttttagatttctcaacaacaaccccttacctcatagatctattacaaattcatgaatcatcccagggatttttatatttgtatatttgattgtatagtgtatacccactatgcacacaacacaaaatggacggttattccattttcataaaatgattattcgattctttttcctctttggatcacaattcaatcaaaacttctcgagttatcctaatctctaggaaaaattccttgattcttcaacttcgatgaaattggaatagttatcttcattagtatactactacatttggatgaatcagattcaaatatttcttattgattcctgtcaaaaagaaacaatttgagtagaaggtccatatctttttttttaatgattctttttttatgttatttcgtactgtacaattcctttgtttgtgggattcttttcccacaagaggtaatgaaaagaattatagaatggattgctacctatgcctagatcgcggataaatggaaattttattgataagaccttttcaattgtagccaatatcttattacgaataattccaacaacttcaggagaaaaagaggcatttacctattacagagatggtgcgatttgactttttttttttatttaccgctctcagtcttaggagaaagacacatgattcaggatagaaagaaaagacactattgaaataaatctacgcttgttgaaggtgaagtttgtaaataggacaattccttctgtcgtgtatccccgattgatgcagcctcagatgcttcaattgtcgattctagtattgagcgaaaggttatacctataggttctgtattcgagggcaatcctactccactagtaccaataggcggcataggggaagaagcactacacctaggaatcaacaacacgaaaactttgttataaattaccccttttccttattgggatcgggactaagaagaatggttgggacaacaaacatccatctcgttcgtactttggatacctatataaccatcgaagcctgttgaagtgactaattcctggaaattagggggcgttgaggacaaagaaattgttggagttaccctttctatctagtatagtaccaacacgaacacgcttgatgttaagaaaagatcttttgcaggaaggttggctagagatttcttgtaaaaacactagccccgcccagtttataatgagaatatttccatttttttggattccatgtattattctcattatgcacataatggaggagccgtatgagatgaaaatctcacgtacggttctggaacggagaatttttgaatcaaatgacgaccgtaacggatgtcggctcaatccgaaggaaattatgcggaagctttacagaattattatgaagctatgcgactagaaattgatccctatgatcgaagttatatactctataacataggacttatccacacaagtaatggagagcatacgaaagctttggaatattattttcgggcattagaacgaaacccgttcttaccacaagcttttaataatatggccgtgatctgtcattacgtgcgactatctccactatagaaagaaaaaggaaagaaaaaagaaagatcaaatccactagtaaatactagaaacaaaacgggctttctacatattatgcatcgtccaaaacaacgatttttagcagctgtagtaaagaaagaaacttcatagaagtcgaaatatgaagaaatagatatgcctaaatactttattctatggataaagcatctagatctaattgatagaggaagcaccgtaaagatcaattagcggggttttgggccgatacaataataactgcttacttatgtcatgatatgagataaaagttaggaatcaacttatgtaatagagtcgatacactaaagtattgagcagcggtgtagcatcagatcccaaagatagtaagtctttttttgaaggaaagtctttttcaaagattctatataaatttctacatgaaaccgagatagttacctttcagaaaattctaacgataggtaaaatgcctagtcttctgaaggtgggagaaaagataaaactaaaactgattagtaataaaatcaaaattcaagtttgaaactcatgcaattaacctctttttgttaacccgagaaataaaaaggatatatcttatgagcaatctcattcagatatggtagattaaaacgggacaccaaaataaatgactgctgagccgtatgaggtaggaaactctcaagtacggttctaagggaaggaattgacccgcctattccgaccggggagaacaagccattcgccagggagattctgaaattgcggaagcttggttcgatcaagccgctgagtattggaaacaagctatagcacttactcctggtaattatattgaagcgcataattggttgaagatcacgaggcgtttcgaataaaaacactctgtttattatttagcattttttatatttcttattatttgttggacctatcagtcaaataaaatggatcattcctatgcctatgggaagaaccaatcaaagaatttcattatatcccttctaagatcgttctatttcatttagtatctcgtagggataaacgatacacagatacattagag

SEQ ID NO: 4467 - DNA, 1162 bp, Guizotia abyssinica
tctcgaatatacactgtaattcagtcattacggctgggggatggaatcaggtctgcagtgtttaccgacaaatgtcttcggttattggggacaaatcgatatacttttactgtcgtatcacgatcaactaggacagacatgaacgcgttgggtcgaactcttctttggtgtcgagggaatcgcgatgaatagtcatcgacttcagggaaaggctagaagaatgggacccattatgggacagaccatgcattacagacttatgatcattacgcttcaacccgggtattctattccacctcttagacagaaaagagcggaaatcataatacttaatagcatggcgatgcgtttatacaaaacttctaccccgagcacacgcaatggaaccgtagacagtcaagtgaaatccaatccacgaaataatttgatctatggacagcatcattgtggtaaaggtcgtaatgccagaggaatcattaccgcagggcatagagggggaggtcataagcgtctataccgtaaaatagattttcgacggaatgaaaaagacatatatggtagaatcgtaaccatagaatacgacccgaatcgaaatgcatacatttgtctcatacactatagggatggtgagaagagatatattttacatcccaggggggctataattggagataccattgtttctggtacagaagttcctataaaaatgggaaatgccctacctttgaccgatatgcccttaggcacggctatacataacatagaaatcacacttggaaagggtggacaattagctagagcggcgggtgctgtagcgaaactgattgcaaaagaagggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgccctgtagtaagaggagtagttatgaaccctgtagaccatccacatgggggtggtgaagggagggccccaattggtagaaaaaaacccacaaccccttggggttatcctgcacttggaaaaagaagtagaaaaaggaataaatatagtgataatttgattcttcgtcgccgtagtaaatag

SEQ ID NO: 4468 - DNA, 8175 bp, Euphorbia peplus
atattcatatcataacatatgaacagtaagaactagcattcttattgagactagaattcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagccatcgactcccgggaaagggtagaagaatgagacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatacacgaaataatttgatctatggacagcatcattgtggtaaaggccgtaatgccagaggaataattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattatttctggtacagaagttcctataaaaatgggaaatgccctacctttgaccgatatgcccttaggcacggccatacataacatagaaatcacacttggaaagggtggacaattagctagagctgcaggtgctgtagcgaaactgattgcaaaagagggtaaatcggccacattaaaattaccttctggggaggttcgtttaatatccaaaaactgctcagcaacagtcggacaagtagggaatactggggtgaaccagaaaagtttgggtagagccgggtctaaatgttggctaggtaagcgtcctgtagtaagaggagtggttatgaaccctgtagaccatccccatgggggtggtgaagggagggccccaattggtagaaaaaacccgcaaccccttggggttatcctgcacttggaagaagaagtagaaaaaggaataaatatagtgataatttgattcttcgtcgccgtagtaaataggagaaaaaatcgaatttgtttcttcgtaacaaaaaaaaaataggagaaattaactgtgacacgttcactaaaaaaaaatccttttgtagcaaatcatttattaaaaaaaataaataagcttaacacaaaagcagaaaaagaaataatagtaacgtggtcccgggcatctaccattatacctacaatgatcggccatactattgctatccataatggaaaggagcatttacctatttatataacagatcgtatggtgggccataaattgggcgaatttgcacctactttaaatttccggggacatgcaaaaaatgataataaatcccgccgttaaaagaacaaatcaaatagaaatatttatcattcattaaaaagaggtgaatcttatgataaataaaaaaatagacccatacacagaagtatatactttaggacaacatatacgtatgtccgctcacaaagcacgaagaataattgatcaaattcgtggacgttcttacgaagaaacacttatgatactagaactaatgccttatcgagcatcttatcccatttttaaaattgatttcttctgcagcagcaaatgctagtcacaatatggctttcaacgaaaccgatttaataattagtaaagccgaggttaaccacggtactactgtgaaaaaattaaaacctcaggctagaggacggggttatctaataaaaaaatccacttgtcatataactattgtattaaaaaatatatccttataattataattaaagaatatgaagatccttatcgttaacgaatatgaagaatctcgcatattcttttaaaaccgggactggataaaaaaaacaaaatttacagatatgatatttgacaatatgtatagttaagtagtgggggattatgggacaaaaaataaatccacttggtttcagacttggtacaacccaaagtcatcactctctttggtttgcacaaccaaaaaattactctgagggtctacaagaagatcaaaaaataagaaactgtatcaagaattttgtaaaaaaaaatacaaaaatatcttctggcgttgagggaattgcacgtatagagattcaaaaacgaatcgatgtgattcaagtcataatatatatgggattcccaaaattattaatagaaaatagacctaaacgaatcgaagaattacagatacatgtacaaaaagaactaaattttgtaaaccgaaaactcaatattgttatcacaagaattgcaaatccttatagcaaccctaatattcttgcagaatttatagctggacaattaaagaatagagtttcttttcgtaaagcaatgaaaaaagctattgaattaactgaacaggcggatacaaaaggaattcaagtccaaattgcgggacgtcttgatggaaaagaaattgcacgagtcgaatggattagagagggtagggttcctctacaaaccattcgagctaaaattgattattgttcgtatacagttagaactatttatggggtattaggcataaaaatttggacatttctagacaaaaaataataagcccttaattgacgtgtcttttgattctatccattgatagaagaaaacaaaaaatgacaaactctttcatttttttgttaatcaaaacaaaaagaatgaattagaattctattaactattatattaatttaataattttgaatttcactagaataattaattgaatattaataattttttaataatttaactatatacgtctatttctaattcttcgaattctatttctataaggttgaataaaataataaaataataaaattgattgatataattgctatgcttagtgtgtgactcgttggttttttagagtccgaataaaaaaaaggactgaccagaatatgaactaataagtatacaactaataaccaactcatcgctttgcattatctggatccaaaagtttaaagagtcaagatatgatctattcatcatatcattgtagcaattaaaatcctttttgcataaataaaaaaaaccaatctgattatgagttagaaatcaaaatagaaaattatacggataaatggaagggtgaacgaaagaaaaagaatattaatgatatagaattccaatatgtaaggtctatgagtaatcacataaaagctaatgtagtaaagcatcaataccacaattgatttagaattcaaataatgcgtttctaaaacaaaaaatcaagagccttgagtcaatacagactgagaagattgactcaagaacaaattttatttttatttagaggctccattggaaaattaagacctaaccattaatagagaagtgatgggaacgatggaacctataaatacataagattttaccgaaaaaaaatattaatgatttattggaaggatagcgaaaggaaccagaagacaatctatttattttattatgaaaaatagtccgttacctctacaaataaaataactatcgaaagactaaatatgaaagaggaaatattcgcccgcgaaggtttttttagattctttttgattgcttaattttagcaatcgggtatcctaattagaatatatatatataaatttgttacaacctaatattctaaacaaaaagaagattctaaaaaaaaaaatagaaaaaaattgtttataactcgaactcttagatctataaactctaaaatagaatatatattctaattctaatatatatatacaaatagaaatatatataaatagaaatatatataaatagaaatatatataaatttctattctattaatattctactaatgccctattcgaataatctaagattctaatacttctaatactaataaatagattactaataaatagatttaactaaattaagtaaaatctcaaaaataccctgatttagtatattctttttttactcaaagacatttatatatttttttcattttattcgcgaggagctggatgagaagaaattctcatgtccggttctgtagtagagatggaattgagaaagaaccatcaactataaccccaaaagaacccgattccgtaaacaacatagaggaagaatgaaaggaatatcttttcgaggcaatcgtatttgttttggaagatatgctcttcaagcacttgaacccgcttggattacatctagacaaatagaagcggggcgacgagcaatgacacgaaatgcacgccgtggtggaaaaatatgggtacgtatatttcccgacaaacccgttactttaagacctacggaaacacgtatgggttcggggaaagggtctcctgaatattgggtagctgtcgttaaaccgggtagaatactttatgaaatgggcggagtggcagaaaatatagcgagaaagtctatttcaatagcagcataccaaaatgcctatacgaactcaattccttatttcaaaataagaatctagaaccaaaggaaaaagacccttttgatactaaaaaaaaagcgcaagtttcttttttgttttggacaaacaatatatcttttttgttcctttgcatttaaataacagataaaaaaaaaacgatatgatccaatctcagacccatttgaatgtagcagataacagtggagcccgagaattgatgtgtattcgaatcatagggactagtaatcgccgatatgctcatatcggtgacgttattgttgctgtgatcaaggaagcagcacccaattcacctctagaaagatccgaagtaatcagagctgtaattgtacgtacttgtaaagaacttaaacgtaataacggtataataatacgatatgatgacaatgctgcagttgtcattgatcaagaaggaaatccaaaaggaacacgaatttttggtgcaattgcccgggaattgagacagttaaattttactaaaatagtttcattagcacctgaggtcttataagataaaaaattagaagatataagatcgcaaatttgagattaagaagagaccatgatacagttatagtatttagtattctagttatagtatttgaattaattgaataaaaacaaaaaaaatatttgtgtttcatgcatataccttataattaaataataataaaatgaaaattgagagatttaatgaaataaaaatattaaaaaaaaaacaagagtatgttgattatatcaaaactagataaaaaaaaattgtagtttatcatgggtagggatcctattgctgacataataacctctatacgaaatgctgacatgaatcgaaaaggaaccgttcaaatagcagctactaacatcaccgaaaacattataaaattactcttacgagagggttttattgaaaatgtcaggaaacatcaggaaggcaacaaaaaatttttggttttaactctacgccatagaaggaaaaacaaaggaccatatagaactagtctaaatttaaaacggataagccggccgggtctacgaatctattctaactatcaaaaaattcctagaattttgggcgggatgggcattgtaattctttctacttctcggggtatactgacagaccgggaagctcgactcgaaagaatcggcggagaaatcttgtgttatatatggtaatctttttgctatccgaagtcgatccagacttcttatttcttaaaaaaaaaaaaagacaaggaataggtttctaataacattcctcttacattagttaatacttcacgaggatttgcaatggaatgaaagatcaaaagtggcctcaggaaagtttaattactgaagcactttttcaatttcaataatatgttgcaagttcctttagataatcaagatctgtttttaggttatcttttagccgaggcagtttttttttttttcaactttcaaattccttttgcctttcgtaggaatataattgaagatttcaaaattgaaagaaacttagtttcgtcaaaaaaaatagatatattcaaaaattaagggatggcaaatatgaaaataagagcttctgttcgtaaaatttgtgaaaaatgccgactgatacgtagacgaggacgaattatagtaatttgcttcaacccaagacataaacaaagacaaggataatctttctaagcaagaacactctaaaggatccgagaaaaaaaaaaggatccgttttgacataaaatggatatatccatagacccctgacttatatttatgagatgctaaaatatggcaaaacctttaccacgaattggttcacgcagaactggacgcattggttcacgtaagaatgcacgtaaaataccaaaaggagttattcatgttcaagcaagttttaacaatactattgtgaccgttacagatgtacggggacgagtaatttcgtggtcctccgctggaacttgtggattcaaaggcacaagaagaggaacaccatttgctgctcaaaccacagcaggaaatgctattcgaacagtagtggatcaaggcatgcaacgagcagaagtcatgataaaaggtccgggtctcggacgcgatgcggcattaagagctattcgcagaagtggtatactattaactttcgtccgggatgtaacccctatgccacataatggctgcagacccccgaaaaaaaggcgcgtgtaaaaagaaatagtgaagagatttcaagagaaataaataattcaatcaattcacaataagaatattattatggttcgagagaaagtaacaatatctactcggacactgcagtggaaatgtgttgaatcaagaaaggacaataagcgtctttattacggacgctttattctatctccgcttatgaaaggccaatccgatacgataggcattgcgattcgaagagctttacttggagaaatagaaggaacctgtatcacacgtgcaaaatttgagaaaatatcacacgaattttctactataacaggtattcaagaatcaatacatgaaattttaatgaatttgaaagaaattatattgagaagcaatttgtatggaacttgtgacgcgtctatttgtgtcaagggtcctggatatgtaactgctcaagacatcattctaccaccttttgtggaaatcattgataatacacagcatatcgctagcttaacagaaccaattgatttgtgtattcgattacaaatcgagaggaatcgtggctatcgtataaaaccaacaaaaacctttcaagacggaagttttcctctagatgctgtattcatgccagttcgaaatgcaaatcatagtgttcattcttatggaaatgggaatgaaaagcaagagatgctttttctcgaaatatggacaaacggaagtttaactcctaaagaagcacttcatgaggcttcccgtaatttgattgatttatttattccttttctacatgcagacgaacaaaacttacctttagaaaaaaatcaacacaacgttactttacccctttttatttttcatgatagattgactaaattaagaaaaaaaaaaaagaaataccattgaaatacatttttattgaccaattcgaattgactcctaagatctataattgcctcaaaaggtctaatatacatacattatcggaccttttgaataagagtcaagaagatcttatacaaattgaagattttcacatagacgatgtaaaacatatattgggtattttagaaataaaaaaaatttcgtaatggagtgactaaagaataaaatcgaaatccattggatttcgattcattttggtcttctttagaaacaaaaaagataaaaattttgaatctttagcacaatccatagatttgcaaaatatatccaaatttaaattgaatagatgttatctagggagaattcactttgaagtgactattccctagatatacacgtgatgatattttatttttcaaattaaatcaacttgaaaaagacctaaagttagtagatttctcaataggttaatgttgctccaatacctaacca

SEQ ID NO: 4469 - DNA, 2918 bp, Zostera marina
ttttaggaatagctaatatgtgtgcttgggagtccttgaaaattgaataaaccgagattttaccatgactgcaattttagagagacgcgaaagtacaagcttatggggtcgtttttgcaattgggtaactaacactgaaaaccgtctttacattggatggtttggtgttttgatgatccctaccttattgactgcaacttctgtatttattatcgctttcattgctgcacctccagtagatattgatggtattcgtgaacctgtttcaggatctctactttacggaaacaatattatttctggtgccattattcctacttctgcagctataggtttgcatttttatccaatatgggaagcagcttctgttgatgagtggttatacaatggtggtccttatgaattaattgttctacacttcttacttggtgtagcttgttatatgggtcgtgagtgggaacttagtttccgtttgggtatgcgtccttggattgctgttgcatactcagctcctgttgcagctgctactgctgttttcttgatctatcctatcggtcaaggaagtttttctgatggtatgcctttaggaatttctggtactttcaactttatgattgtattccaggcagaacacaatatccttatgcatccatttcacatgttaggcgtagccggtgtattcggcggttccctatttagtgctatgcatggttctttggtaacttctagtttgatcagggaaaccactgaaaacgaatctgctaacgtaggttatagattcggtcaagaggaagaaacttataatatcgtagccgctcatggttattttggccgattgatcttccaatatgctagttttaacaactctcgttctttacactttttcctagctgcttggcctgtagtaggtatttggtttactgctttaggtattagtactatggctttcaacctaaacggtttcaattttaaccaatccgtagttgatagtcagggtcgtgttattaacacttgggctgatattatcaaccgtgctaaccttggtatggaagtgatgcatgaacgtaatgctcacaacttccctttagacctagctgctgttgaagctccatctataaacggataatacttctcttttagtgcatatgaatataaaatagaaatattaaacttataatgcatttagtgtttctagtctttgttgtttaattcaattatgttttattcacataagaatttttccattgattgatatattatgtctaatatatcaatcaatggaaaaaaggaaattttttggaaatactttaacttaataaataattagcaacaaaaggcttttttttagtgaatgtgccatatcggataactccttttttgtaaatgtaaggggcggatgtagccaagtggatcaaggcggtggattgtgaatccaccatgcgcgggttcaattcccgtcgttcgcccaattttaaaagtttaaatattcctatttacggcgacgaagaataaaattatcactatatttcttctttttcctacttcttcttccaagtgtaggataaccccaaggggtcatgggtttttttctaccaattggggctctcccctcaccgcccccatgcggatggtctacagggttcataactactcctcttactataggacgcttacctagccaacacttagatcccgctttacccaaaattttttggtttatcccaacattacccacttgtccaactgttgctaaacagtttttgggtatcaaacggacctccccagatggtaatcttaatgtggccgatttaccctcttttgcaatcagttttgctacagcacctgctgctctagctaattgtccaccttttccaaatgtgatttctatgttatgtatggccgtgcctaagggcatatcggtcaaaggtagggcatttcccattgatataggaacttctgtaccagaaacaatggtatctccaattatagcccctctgggatgtaaaatatatctcttctcaccatccccatagtgtatgagacaaatgtatgcatttcgattaggatcgtattctatggttacgattctaccagatatgtctttttcattccgtcgaaaatctattttacggtatagacgcttatgacctccccctctatgccctgcggtaatgattcctctcgcattacgacctttaccacaatgatgctgtccatagatcaaattttttcgtggattggatttcacttgactgtctacggctctgttgcgtgtactccgggtagaagttttgtataaatgtatcgccatgttaatgttattaagtattttgctttaagttcttttctctataagaggtggaatataataacccggttgaagcgtaatgatcatacgtctgtaattgtaatgcattgtatgtcccataataggtcccattcttctaccttttctagggagtcgatgactattcatagctattaccttgacaccaaagaagagttcgacccaatgctttatttctgtcctagttaatcctgattcgacattaaaagtatattgattgttctccaataaccgaatacttttttctgtaaatactgcatatttgattccatccataaatccattttcttccctatgagttccagtatcgataagaattctagttcttattgttcgtatgttatgtatgaatataccataccaattcgttatgtatggatgatgagattctatatatacagagccaattccaatggacttattgaacgttcccattggcgtgcatccagcaggaattgaacctacgaatttgccaattatgagttgggcgctttaaccattcagccatggatgcttaatgggtatattgtatcgtgattgaattgtattgtatcgtgattgaattgttatt

SEQ ID NO: 4470 - DNA, 1435 bp, Helianthus annuus
aacaatttaaattctagataaaaatgaaaattttgcttatttattacttttatttattcaataaaaatgagaaagaatatgcttttttatgttaatggaaaaatatagtaatactagataatagtagaggggcggatgtagccaagtggatcaaggcagtggattgtgaatccaccatgcgcgggttcaattcccgtcgttcgcccatgttattatgatttctttttcttcttttgtgttaagcttatttattttttttaataaatgattcgctacaaaaggattttttttgagtgaacgtgtcacagcttcctcctattttttttgtaaagacgaagaaagaaattctattttctctcctatttactacggcgacgaagaatcaaattatcactatatttattcctttttctacttctttttccaagtgcaggataaccccaaggggttgtgggtttttttctaccaattggggccctcccttcaccacccccatgtggatggtctacagggttcataactactccccttactacagggcgcttacctagccaacgcttagatccggccctacccaaatttttctggttcaccccaacattccccacttgtccgactgttgctgagcagtttttggatatcaaacggacctccccagaaggtaattttaatgtggccgatttcccttcttttgcaatcagtttcgctacagcacccgctgctctagctaattgtccaccctttccaagtgtgatttctatgttatgtatggccgtgcctaagggcatatcggtcaaaggtagggcatttcccatttttataggaacttctgtaccagaaacaatggtatctccaattatagcccccctgggatgtaaaatatatctcttctcaccatccctatagtgtatgagacaaatgtatgcatttcgattcgggtcgtattctatggttacgattctaccatatatgtctttttcattccgtcgaaaatctattttacggtatagacgcttatgacctccccctctatgccctgcggtaatgattcctctggcattacgacctttaccacaatgatgctgtccatagatcaaattatttcgtggattggatttcacttgactgtctacggttccattgcgtgtgctcggggtagaagttttgtataaatttatcgccatgctattaagtattttgatttaagttcttttctttctaagaggtggaatagaataacccggttgaagcgtaatgatcatacgtctgtaatgcattgtctgtcccataatgggtcccattcttctagcctttccccgaagtcgatgactattcatcgcgattaccttgacaccaaagaagagttcgacccaatgctttatttctgtcctagttgatcctgattcgacattaaaagtatattgatttttccccc

SEQ ID NO: 4471 - DNA, 2984 bp, Triphysaria pusilla
ctcataattggcgaactcgtaggttcaattcctactggatgcacgccaatgggaccctccaataagtctattggaattggctctgtatcaatggaatctcatcatccatacataacgaatcggtgtggtatattcatatcataatatatgaacagtaagaagtagcattcttattgagactagaactcatagggaagaaaatctatttatggatggaatcaaaaatgcagtatttacagacaaaagtattcggttattggggaaaaatcaatatacttttaatgtcgaatcaggatcaactaggacagaactaaagcattgggtcgaactcttctttggtgtcaaggtaatagctatgaatagtcatcgacttccgggaaagggtcgaagaatgggacctattatgggacatacaatgcattacagacgtatgatcattacgcttcaaccgggttattctattccacctcttataaagaaaagaacttaaatcaaaatacttaatagcatgacgatacatttatacaaaacttctaccccgagcacacgcaatggaaccatagacagtcaagtgaaatccaatccacgaaataatttgatctatggacagcatcattgtggtaaaggtcgtaatgccagaggaatcattaccgcaaggcatagagggggaggtcataagcgtctataccgtaaaatagattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagttagagcagcgggtgctgtagcgaaactgattgcaaaagaggggaaatcggccacattaaaactaccttctggggaggtccgtttgatatccaaaaactgctcagcaacagtcggacaagtggggaatgttggagcgaatcagaaaagtttgggtagagccggatccaagcgttggctgggtaagcgccctgtagtaagaggagtagttatgaaccctgtagaccacccccacggggggggtgaggggagagccccaattggtagaaaaaaacccacaaccccttggggttatcctgcactcggaagaagaagtagaaaaaggaataaatatagtgataatttgattgttcgtcgccgtagtaaataggcgagaaattcgaatttctttcttcgtctttaaaaaaaaaaaaaataaggaggaagctgtgatacgttcactaaaaaaaaatcctttgtagccaatcatctattaataaaaattaataagcttaataaaaaagcagaaaagaaataatagtaacgtggtcccgtgcatctaccattatacccacaatgatcggccatacgattgccgttcataatggtaaggatcatttgcctatttatataacagatcgtatggtaggtcacaaattaggagaatttgtacctactttaaatttccgaggacatgcaaaaagtgataatagatctcgtcgttaatcttattttaaaaaacatatagaatagataggtacttaatgattcattatgtaggagaaaaaccttatgtttatgctaagaaagagaaaaaaaaaacggaagtatacgctttaggccgacatatatctctatccgctgacaaagcaagaagagtaattgatcaaattcgcggacgttcttatgaagaaacccttatgatactcgagctcatgccctatagagcatgttatccaatttttaaattggtttattctgctgcaacaaatgctgcttacaatatgggttctggcgaagccaatttagtaattagtaaagctgaggttaatgagggtactaccgtgaagaaattaaaacctcgagctcgcgggcgtagttatgcgataaaaagaactacctgtcatataactattgtagtgaaagatatatctttagatgaatatgaagaaatgtattctttaaaaaaccctagatggaaaaaggcaactatggtatatcctgatgtgtatagtagtggggtagtatgggacaaaaaataaatccacttggttttagacttggtacaacccagagtcatcattccctttggtttgcacaacccaaaaattattctgagggtctacaagaagataaaaaataagagattttatcaaaaattatgtacaaaagaatatgagaatatcctccggcgccgagggaattgcccgcatagaaattcaaaaaaaaattgacttgatccaagtcgtaatctttatgggattcccaaagttattaatcgaaagtagaccgcgaggaatcgaagaattacagatgaatctacaaaaagaatttcattatgtgaaccgaaaacttaacattgctatcacaagaattacaaaaccttatagaaaccctaatattcttgcagaatttatagccggacaattacaaaatagagtttcatttcgaaaagcaatgaaaaaagctattgaattaactgaacaagcagatacaaaaggaattcaagtacaaatttcagggcgtatcgacggaaaagaaattgcacgtgttgaatggatcagagagggtagggttcccctacaaaccattcgagctaaaattgattattgttcctatacagttcggactatatatggggtattaggcatcaaaatttggatttttatagacaaagaagaggaataaaaaatttgaattgtttttcccttctatactatggatagaacaaaataaggggaacctcgtctattcgttttctaaccaatcttaattctatagggtaaaataaaaattcgattgacctggtgatataattgcta

SEQ ID NO: 4472 - DNA, 15299 bp, Cannabis sativa
cgggccttttatcatgacttctgcttgttgcataccttgatctactactgtccgaatagcatttcctgctgcggtttgagcggcaaatggtgtccctcttcttgtacccttgaatccacaagtaccggcggaggaccaagaaattacccgcccccgtacatcggtaacagttacaatatgaaatttaattgtcttaattctcgggcaattgcgccaaaaattcgagttccttttggattttcttcttgatcaataacaaccgcagcattgtcatcatatcgtattatcataccgttgtcgcgtttgagttcgttacaagtacgtacaattacagctctgattacttcggatctttccagcggtggatttggtattgcttctttgatacagcaacaataacgtcaccaatatgagcatatcgtcgattactagctcctatgattcgaatacacatcaattttctggctccgctgtgatccgctacattcaattgggtttgaggttgaatcatatcatttttgatctgttttttcaatgcaaagggcgaagtaaaaaaaaaaaatgttgtttattcaaaacaaaaaaagaatcctgcaattgtcttttttcatccaaaaacctttttcttttggttctacatctctatcctgaaataatgtattgagttcgtataggcattttggaagccgctattgaaatagcctttctggctatattttcggctaccccactcatttcataaaggattctacccggtttaacgacagctacccaatattcgggagatccttttcccgaacccatacgtgtttctgtaggtcttactgtaactggtttgtctggaagtatacgtacccatatttttccgccgcggcgggcgtttcgtgtcatagctcgtcgccctgcttctatttgtctagatgtgatccaagcgggttcaagagcttgaagagcatatctaccgaagcaaatacgattacctcgataagatattcctttcattcttcctctatggtgtttacggattcgggttcttttggggttatacatagcaattatattaaatcaactgattaatagaatttttattcaaccttatagaattatttatttttgttttgatttaatagaaaaaagtgttttttcttttttgtttttttggtatattacctgatcgatctaaagataagtcaagtaaaggattattagtcctcatcgacaaatatccaaattttgatacctaataccccatagatagttccaactgtataggaacagtaatcaattttagctcgaatggtttgtaggggtaccctaccttctcggatccattcgacacgtgcaatttcttttccgtcgatacgccctgcaatttgtatttgaattccttttgtacctgcttgttcagttaattcaatagcctttttcattgctttgcgaaatgaaactctattttttaattgtccggctataaatcctgctagaatattagggtgtccataaggatttgctattcttgtaatagcaatgtcaagtttccggttcatcgaatgtagttctttttttacattcatctgtaattcttccattttttgggggctattaataattttgggaatcccatatagattatgacatgaatcaagtcgatttttttttgaatctctatccatgcaatcccctcgacactagaagatattttcatatttttttgtacataattcttgatacaatttcgtatttttcgatcttcttgtagatccttagaataattttttggttgtgcaaaccaaagagaacgatgagcttgggttgcaccaagtctgaaaccaagtcgatttattttttgtcccacaatccccgctagtattactatacatataatgtatacatagactgaccttatgaatattaaatcttatataaatataaaaaatatatcatattcatataatatattaatataaattttctttttctacgtataagtctttcagtacaatagttatatgacaagtgtgtctttttattggatagccccgtccccgagcttgcggttttaattttttcacagtgttgccttcgttgacctcagcgttactaataattaaagtagcttcgttgaagcgcatattgtgagtggcgtttgctgccgcggaattaaccaattttaaaattggataacatgctcgatatggcattagttctagtaaacatgtatttgatttctatcactcctcactaatgaacgataagcatctatatttcattttattattattatttattaactaaatattaactgacgacgagatctattatcattttttgcatgtccccggaaatttagagtgggtgcaaattctcccaatttatggcctaccatacattatttattaactaaatattaactaacgacgagatctattatcattttttgcatgtccccggaaatttagagtgggtgcaaattctcccaatttatggcctaccatacgatctgttatataaatgggcaaatgttcttttccattatgaacagcaatagtatgcccgatcattgtaggtataatggtagacgctcgggaccaagttactattatttctttttccgcttttgtgttaagcatattcatttttcttaataaatgattggctacaaaaggatttttttttagtgaacgtgccacaattaattactcctatttttttttatattataaagacgaagaaacaaattctattttctctcctatttactacggcgacgaagaatcaaattatcgctatatttattcctttttctacttcttctgccaagtgcaggataaccccaaggggttgagggtttttttctaccaattggggccctcccttcaccacccccatggggatggtctacagggttcataactactcctcttactacaggacgcttacctagccaacgtttagatccggctctacccaaacttttctggttcaccccaacattccccacttgtccgactgttgctgagcagtttttgggtatcaaacggacctccccagaaggtaattttaatgtggccgatttcccctcttttgcaatcagtttcgctacagcacctgctgctctagctaattgtccaccctttccaagtgtgatttctatgttatgtatggccgtgcctaagggcatatcggttgaagtagggcatttcccatttttataggaacttctgtaccagaaacaatggtatctccaattagagcccctctgggatgtaaaatatatcttttctcaccacccccatagtgtatgagacaaatgtatgcatttcgattagggtcgtattctatagttacgattttaccatatatgtctttgtcattccgtcgaaaatctattttacggtatagacgcttatgacctccccctctatgccctgcggtaatgattcctctggcattacgacctttaccacaacgatgctgtccatagatcaaattatttcgtggattggatttcacttgcctgtctacggctcctttgcgtgtgctcggggtagaagttttgtataaatgtatcgccatgctattaagtattttgatttaagttcttttcgttataagaggtggaatagaataacccggttgaagcgtaatgatcatacgtttgtaatgcattgtatgtcccataataggtcccattcttctaccctttcccggtagtcgatgactattcatagctattaccttgacaccaaagaagagttcgacccaatgctttatttctgtcctagttgatcctgattcgacattagaagtatattgatttttcagcaataaccgaatacttttgtctgtaactacgaaatatttgattccatccataaattttattccctatgagttctagtctcaataagactgttaggtcttactgttcatatgttatgatatgaatataccacaccaattcgttatgtatggatgatgagattccattgatacagagccaattccaatagacttattggagggtcccattggcgtgcatccagtaggaattgaacctacgaattcgccaattatgagttgggcgctttaaccattcagccatggatgcttagcggggatcctcgtacatggtgaataaccaaattccaattgaaatgaaatctttagggtaaatcaatgcaatttaggaggacttaatcttaatgaaaggacatcaattcaaatcctggattttcgaattgagagagatattgagagagatcaagaattctcactatttcttagattcatggacccaattgaattcagtgatatctttcattcacatctttttccatcaagaacgttttataaaactcttggactcccgaatttggagtatcctactttcacgcaattcacatttacagggttcaacgagcaatcgatatttcacgatcaagggtgtagtactatttgtagtagcggtccttatatatcgtattaacaatcgaaagatggtcgaaagaaaaaatctctatttgacagggcttcttcctatacctatgaatttcattggacccagaaatgatacattggaagaatctttttggtcttccaatatcaataggttgattgtttcgctcctgtatcttccaaaaggaaaaaaaatctctgagagctgtttcctggatccaaaagagagtacttgggttctcccaataactaaaaagtgtatcatgcctgaatctaactggggctcgcgatggtggaggaactggctcggaaaaaagagggattctagttgtaagatatctaatgaaaccgtcgctggaattgagatctcattcaaagagaaagatatcaaatatctggagtttctttttgtatattatatggatgatccgatccgcaaggaccatgattgggaattgtttgatcgtctttctccgaggaagaggcgaaacataatcaacttgaattcggcacagctattcgaaatcttagtgaaagactggatttgttatctcatgtttgcttttcgtgaaaaaataccaattgaagcgaagggtttcttcaaacaacaaggagctgggtcaactattcaatcaaatgatattgagcatgtttcccatctcttctcgagaaacaagtgggctatttctttgcaaaattgtgctcaatttcatatgtggcaattccgccaagatctcttctttagttgggggaagaatccgcacgaatcggattttttgaggaacatatcgagagagaattggatttggttagacaatgtgtggttggaaaacaaggatcggttttttagtaaggtacggaatgtatcgtcaaatattcaatatgattccacaagatctagtttcgttcaagtaacggattatagccaattgaaaggatcttctgatcgatccagatatcattttgattccattagtaatgaggattcagaatatcacacattgatcaatcaaagagagattcaacaactaaaagaaagatcgattctttgggatccttcctttcttcaaacggaacgaacagagatagaatcagaccgattccctaaatgtctttctggatattcctcaatgtcccggctattcacggaacgtgagaagcagatgattattcatctgcttccggaagaaatcgaagaatttcttgggaatcctacaagatccattcgttcttttttctctgacagatggtcagaacttcatctgggttcgaatcctactgagaggtccactagagatcagaaattgttgaagaaagaacaagatgtttcttttgtcccttccaggcgatcggaaaataaagaaatagttaatatattcaagataattacgtatttacaaaataccgtctcaattcatcctatttcatcagatccgggatgtgatatggttccgaaggatgaactggatatggacagttccaataagatttcattcttgaacaaaaatccattttttgatttagttcatctattccatgaccggaacagggggggatacacgttacaccacgattttgaatcagaagagagatttcaagaaatggcagatctattcactctatcaataaccgagccggatctggtgtatcataagggatttgccctttctattgattcctacagattggatcaaaaacaattcttgaatgaggtattcaactccagggatgaatcgaaaaagaaatatttattggttctacctcctattttttatgaagaaaatgaatctttttatcgaaggatcagaaaaaaatgggtccggacctcctgcgggaatgatttggaagatccaaaaccaaaaataatggtatttgctagcaacaacataatggaggcagttaatcaatatagattgatccgaaatctgattcaaatccaatatagcacctatgggtacataagaaatgtattgaatcgattctttttaatgaatagatccgatcgcaacttcgaatatgtaattcaaagggatcaaataggaaacgatactctgaatcatagaactataatgaaatatatgatcaaccaacatttctcaaatttgaaaaagagtcagaagaaatggttcgatcctcttatttttatttctcgaaccgagagatccatgaatcgggatcctaatgcatatagatacaaatggtccaatgggagcaagaatttacaggaacatttggaacatttcatttctgagcagaagagccgttttcattttcaagtagtgttcgatcgattacgtattaatcaatattcgattgattggtctgaggttatcgacaaaaaagatttgtctaagtcacttcctttctttttgtccaagttacttctttttttgtccaagtttcttctctttttgtctaactcacttccttttttctttgtgagtttcgggaatatccccattcataggtccgagatccacatctatgaattgaaaggtccgaatgatcaactctgccatcagttgttagaatcaataggtcttcaaatcgttcatttaaaaaaatggaaaccctttttattggatgatcatgatacttcccaaaaatcgaaattcttgatcaatggaggaacaatatcaccatttttgttcaataagataccaaagtggatgattgactcattccatactagaaataatcgcaggaaatcttttgataacacggattcctatttctcaatgatatcccacgatcaagacaattggctgaatcccgtgaaaccatttcatagaagctcattgatatcttctttttataaagcaaatcgacttcgattcttgaataatccacatcacttctgcttctattgtaacaaaggattccctttttatgtggaaaaggcccgtatcaataattatgattttacgtatggacaattcctcaatatcttgttcattcgcaacaaaatattttctttgcgcggcggtaaaaaaaaatatgcttttttggagagagatactatttcaccaatcgagttacaggtgtctaacatattcatacctaacgattttccacaaaatggtgacgaaaggtataacttgtacaaatctttccattttccaattcgatccgatccattcgttcgtagagctatttactcgatcgcagacatttctggaatacttctaacagggggacaaatagtcaattttgaaagaacttattgtcaacctctttcagatattaatctgtctgattcagaagagaagaacttgcatcagtatctcaatttcaattcaaacatgggtttgattcacactccatgttctgagaaatatttaccatccgaaaagaggaaaaaacggggtctttgtctaaagaaatgccttgagaaagggcagatgtatagaacctttcaacgagatagtgctttttcaactctctcaaaatggaatatattccaaacatatatgccatggttccttacttcgacaggatacaaatatctaaatttgatatttttagatactttttcagacctattgccgatactaagtagcagcccaaaatttgtatccatttttcatgatattatgcatggattagatatatcatggcgaattcttcagaaaaaattctgtcttccacaatggaatctgataagtgagatttcgagtaagtgtttacataatcttcttctgtccaaagaaatgattcatcgaaataatgagtcaccattgatatcgacacatctgagatcgccaaatgttcgggttcgggagttcctctattcaatccttttccttcttcttgttgctggatatctcgttcgtacacatcttctttttgtttctcgagcctatagtgagttacagacagagttcgaaagggtcaaatctttgatgattccatcatacatgattgagttgcgaaaacttctggataggtatcctacatctgaactgaattctttctggttaaagaatctctttctagttgctcgggaacaattaggagattctctagaagaaatacagggttctgcttctggcggcaacatgctatggggtggcggtcccacttatggggtcaaatcaatacgttctaagaagaaatatttgaatatcaatctcatcgatatcatcgatttcataagtatcataccaaatcccatcaatcgaatctctttttcgataaatacgagacatctaagtcatacaagtaaagagacctattcattgataagaaaaagaaaaaaggtgaacagtgattggattgatgataaaatagaatcctgggtctcgaacatgattggattgatgataaagaaagagagctcttggttcagttctccgccttaacgacagaaaaaaggattgatcaaattctattgagtctgactcatagtgatcatttatcaaagaatgactctggttatcaaatgattgaacaaccgggagcaatttacttacgatacttagttgacattcataaaaagtctctaatgaattatgagttcaatacatcctgtttagcagaaagacggatattcctttctcattatcagacaatcacttattcacaaacctcctgtggggctaatagttttcatttcccatctcatggaaaacctttttcgctccgcttagccctatccctctctaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagtgacgatatcgaccgtgactttgatacggagctggagcttctaactatgatgaatgcgctaactatggatatgatgccggaaatagaccggttttatatcacccttcaattcgaattagcaaaagcaatgtctccttgcataatatggattccaaacattcatgatctggatgtgaatgagtcgaattacttatccctcggtctattattgaactatctctccagggattgtgaaagatgttccactagaaatattcttgttattgcttcgactcatattccccaaaaagtggatcccgctctaatagctccgaataaattaaatacatgcattaagatacgaaggcttcttattccacaacaacgaaagcactttttcactctttcatatactaggggattccacttggaaaagaaaatgttccatactaatggattcgggtccataaccatgggttccaatgtacgagatcttgtagcacttaccaatgaggccctatcaattagtattacacagaagaaatcaattatagacactaatataattagatctgctcttcatagacaaacttgggatttgcgatcccaggtaagatcggttcaggatcatgggatccttttctatcagataggaagggctgttgcacaaaatgtacttctaagtaattgctccctagatcctatatctatctatatgaagaagaaatcatgtaacgaaggggattcttatttgtacaaatggtacttagaacttggaacgagcatgaagaaattaacgatacttctttatcttttgagttgttctgccggatcggtcgctcaagacctttggtctctacccgaactcgatgaaaaaaatgggatcacttcttatggactcgttgagaatgattctgatctagttcatggcctattagaagtagaaggcactctggtgggatcctcacagacagaaaaaggttgcagccagtttgataatgatcgagtgacattgcttcttcggcccgaaccaaggaatcccttagatatgatgcaaaatggatcttgttctatcgttgatcagagatttctctatgaacaatacaaatcggagtttgaagaaggggaaggagaaggagaaggagtcctcgacccgcaacggatagaggaggatttattcaatcacatagtttgggctcctagaatatggcgcccttggggttttcgatacaatcaaatagaaagccccaacgaattgggatttccctattgggccaggtcatttcggggcaagcggatcatttatgatgaagaggatgggcttcaacagaatgattcggagttcttgcagagtggaaccatgcagtaccagacacgagatagatcttccaaagaacaaggcttttttcgaataagccaattcatttgggaccctgcagatccactctttttcctattcaaagatcagccctttgtctctgtgttttcacatcgagaattctttgcagatgaagagatgtcaaaggggcttcttacttcccaaacagatcttcctacatctatatataaacgctggtttatcaagaatacgcaagaaaagtacttcgaattgttgatttatcgccagagatggcttagaaccaatagttcattatctaatggatttttccgttctaatactccatctgagagttatcagtatttatcaaagctgttcctatctaacggaacgctattggatcaaatgacaaagacattgttgagaaaaagatggcttttcccggatgaaatggttgttgctatctgctacaataacgaatcattggtttaactgaataactaaataaaatagatagacatttctcttcgtctcaggtcgacggatcttctcaattgaaagatcccctatatggataatacacattccagttgaccgactaattctaattgttttgttccgaagcaaagatatccacggagcggttcgtcctattcagatattcacgaccaagaatctctttcggataggccctgaaaggagaagggaagctggaatgccaacaggcgtctattattgaattcacccgacccgatagtacccattttgggaacgtccagcgccaaagtcactgaatgggtaagtcgccaatccctaaaacggactatgtaatgtactttatctgctgggttgggcattttaccagaggtttctattgtatcgatctacccttgtgtgattcctgttgaagcatatactcggggggtgggtgcagggcggacgatttcaaagcggactccccattcattagatagagaagatcaccaagatttcgtgatccgctgccgaacttattccaattcaatgagcattctcaatattcaatattatgccttgaagaggactcgaacctccacgctctttagcacgagattttgagtctcgcgtgtctaccatttcaccaccaaggcatcttgaaagtgaatcgtattccatgaatatgatatctatccagtgtgatgtatggaatatatgacaaaggcggagtgttagagtatttctattgatcggtcatgtcatataggcccgagtcggacatccaattgcttcgatttgaattatccggaggatgccttatatttatatatattatatcaaaaagatggacaatcaaacctatttctcgattcaatagaagcccaaagaggtgaatagggtcccaaataacgagagatatgtagaaagcaggtccgattacgcctattcctaatcctaaatggaatgtaacgacgtagggatccatatgtaaacatagtatctatttagatacgctcgaatgaccccttctcataattagaatgtatataaccctattccggtctggtccggtatggaatgaacttataatcatggaatcgactcgatcatcagattatcgattataagttcataaccctagcccattccccttttgggcggaacagatctactaattctttgattccagttagtaagagggatcttgaactaagaaataggttctagaagctaaaaaagggtatcctgagcaatttcaataatcgggttcattgatattcctggtatagtagatgctatcacacatacaatcatactcaattcgatggaattgtttgatcttaaaggggatcttctataattttgcacgtgaggggttatttcttggtttcgtccagtcattaataacttgattatttttagataatagtagatagaaacaacgctcgtaaggagagtccattgatgagaaggggctggggaaagcttgaacccaattcctacagtgatgaatataagcgcaattgaaattcctggggagttatacatttgtgtattgataagaccattcactatttcttgaagctcgatctctcccccggatgaaccatatagccaagagaaaccatgaaccagaatagaagagcttgccccacccatgagtaaatatttcatagtagcctcattagaccgtacatctttcttggtatatccagataataggtaggagcataaactgaaacattctggagctacaaagatagttattaaatcgttagcaccgcataaaaacattcctcctagagtagctgttaatacgaataacagaaactccgttatagccatttctgtacattcaatgtactctacggatagaggaatacataaagttgaacatagtaaaataagaaattgaaagatttcgttgaaattgttcgtttggaaatttcccgaaaagctaatcataggttcttctctccatcggaacaatagggccgttatgctcattactaaacttgttgaagagatgaaatataaccaaggtatatctttttgatcagaggttgaatcgatcatcagaagaagaattaggccaaaaattaggatacattctggtaaaataaaacttccattgaagagaagcaaatgaaaggctttcataaaaattctcgtagaatcgagaatgaagttttcattctgtacatgccagatcatgaattagtaactgcatccaatctccaaaaaatcccaattgtttcgaactttctctttttggaatggaatttttacggaatccccatgaataggatcaaaccttattccatgatatttacatgagattcctctttcttattcttaaaaaagtccccgagagggcttagttgatccatgatttatgtttcgtctttcgtttctttttcgtttatttcgagaaatatatcgatcaattccgattctttatttttctattgattcttttccgatcgagatgtatggttccatgggtctatgtgtctatatagatcctgttcatggattaacgaaaatgtgcaaaagctctatttgcctctgccattctatgagtctcttcctttttgcgtatggcatcgccactccctttggcagcatccactaattcggaacttaatttgaaaaccatatttcgacccggacgttttcgggatgcccctaataaccaacgaatggcaagtgcttttccttgtgtggatcctatttcaatgggaacctgatgagtcgatccgcctacacgtcttgtttttactgctatatcgggagttactccacgtattgcttgacgtaaaacagatagtggatttgtttctgtcttttgttgaatctttttcatggctcgatagataatttgataagctaatgatttttttccgtgtttcagaatacggttaaccaacatgttaactaatcgattacgataaattggatcggattttgcagttttttcttctgcagtacctcgacgtgacatgagcgtgaaaggggttcaataatcagttttctttttataagggctaaaataatttattttggctttttgaccccatattgtaggaacgcccttgttgacgatcctttactccgacagcatctagggttcctcgaacaatgtgatatctcacaccgggtaaatccttaacccttccccctcttactaagactacagaatgttcttgtaaattatggccaataccaggtatataagcagtgatttcaaatccagaggttaagcgtactctggcaactttacgtaaggcagagtttggttttttgggggtgatagtggaaaagttgacagataagccacccttactgccactctacagaaccgtacatgagattttcatctcatacggctcctcgttcaattcttttgaagtcattggatctttttcctcgttcgagaacctctcccttcttccacttcgttccgaagagtaactaggaccaattcagtcacgttttcattcattttgaatctgggctcttctacttcatttttatttactttaacttttttttattatttttccctctcttttctttttttatttcttttttgattttcttcttttccatcattccttaagtgccataggtttgatcctgtagaatctgactcattttctcattgagcgaaaggtacgaaataaatcagattgatttttcgatcaaaaaaaagtactatttgaaatcttcggttttttcctctttctctatccctatcccgtaggtacagcgtttgaatcaatagagaaccttttcttctgtatctgtataaacgtatctgtataaatcgatattattccattccaattccttcccgatacctcccaaggaaaatcccgaatcggatcccaaattgacgggttagtgtgagcttatccatgcggttatgcactcttcgaataggaatccattttctgaaagatcctggctttcgtgctttggtgggtctccgagatcctttcgatgacctatgttgtgttgaagggatatctatatgatccgatatgattcgatcgattgcgtaaagcccgcggtagcaacggaaccgcggaaagtatacagaaaagacagttcttttctattatattagcattttctattatattagtattagttagtgatctcggctcagtgagtcctttcttccgtgatgaactgttggcaccagtcctacatt

SEQ ID NO: 4473 - DNA, 1190 bp, Cynara scolymus
  misc_feature (501)..(501): n is a, c, g, or t
  misc_feature (691)..(691): n is a, c, g, or t
  misc_feature (789)..(790): n is a, c, g, or t
  misc_feature (1025)..(1025): n is a, c, g, or t
cggggggaaatcgtatacttttatgtcgaatcaggatcaactaggacagaaataaagcattgggtcgaactcttctttggtgtcaaggtaatcgcgatgaatagtcatcgacttcggggaaaggctagaagaatgggacccattatgagacagacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaggtccaatccacgaaataatttgatctatggacagcatcattgtggtaaaggtcgtaatgccagaggaatcattaccgcagggcatagagggggaggtcataagcgtctataccgtaaaatagattttcgacggaatgaaaaagacatatatggtagaatcgtaaccatagaatacgacccgantcgaaatgcatacatttgtctcatacactatagggatggtgagaagagatatattttacatcccaggggggctataattggagataccattgtttctggtacagaagttcctataaaaatgggaaatgccctacctttgaccgatatgcccttaggcacggccatacataacatagaaatcacacttggnaagggtggacaattagctagagcagcgggtgctgtagcgaaactgattgcaaaagaagggaaatcggccacattaaaattaccttctggggaggtccnnttgatatccaaaactgctcagcaacagtcggacaagtggggaatgttggggtgaaccagaaaagtttgggtagagccggatctaagcgttggctaggtaagcgccctgtagtaagaggagtagttatgaaccctgtagaccatccacatgggggtggtgaaggaagggccccaattggtagaaaaaaacccacaaccccttggggttatcctgcacttggaaaaagaagtagaanaaggaataaatatagtgataatttgattcttcgtcgccgtagtaaataggagagaaaatagaatttctttcttcgtctttacaaaaaaaataggaggaagctgtgacacgttcactaaaaaaaaatccttttgtagcgaataatttattaaaaaaataaaatagc

SEQ ID NO: 4474 - DNA, 8232 bp, Eutrema halophilum
taaggtggaatttgctaccagttttcttttttattgaaatctgtgcgttaaaattctcccaatttatgtcctaccataagatctattatataaacgggtaagtgttcccttccattgtgaattcaccatcgcgggttcaattcccgtcgttcgcccgtgatgcccgggaccaagttattatgatttctttttccgcctttgtattaagcttctctattttttttaataaatgctttgctacaaaaggatttttcttagtgaacatgtcacagttaattaactcctattttttttaagacgaagaaagaaattctattttctctcctatttactacggcgacgaagaatcaaagtctcactatattttttcttttttctagttcttcttccaagtgccggataaccccacggggttacgggtttttttctaccaattggagccctcccttcaccacctccatggggatggtcgacagggttcataactactcctcttactacaggacgtttacctagccacatttcgatccggctctacccaaacttttctggtttaccccaacatttcccacttgtccgactgttgctgagcagtttttggatatcaaacggacctctccagaaggtaattttaatgtggccgatttcccctcttttgcaatcagtttcgctacagcacccgccgctctagctaattgtccaccctttccaagtgtgatttctatattatgtatggccgtgcctaagggcatatcggttgaagtagggcatttcccatttttataggaacttctgtaccagaaacaatggtatctccaattatagcccctctgggatgtaaaatatatctcttctcaccatccccatagtgtatgagacaaatgtatgcatttcgattagggtcgtattctatggttacgattctaccatatatgtcttttgcatttcttcgaaaatctattttacggtatagacgcttatgacctccccctctatgccttacggtaatgattcctctggcattacgacctttaccacaatgatgctgcccatagatcaaattatttcgtggattggatttcacttgactgtctacggctccattgcgtgtgctcggggtagaagttttggataaatgtatcgccatgctattaagtattttgatttaagttcttttctttctaagaggtggaatagaataacccggttgaagcgtaatgatcatacgtctgtaatgcattgtatgtcccagaataggtcccattcttttaacctttccggggagtcgatgactattcatagctattaccttgacaccaaagaagagttcgacccaatgctttatttctgtcctagttgatcctgattcgacattaaaagtatattgatttttccccaataaccgaatacttttgtctgtaaatactgcatatttgattccatccataaatctattttcttccctatgagttctagtctcaataagaatgctagttcttactgttcatatgttatgatatgaatataccacaccaattcgttatgtatagatgatgagaagattccattgatacagagccaattccaatagacttattggagggtcccattggcgtgcatccagtaggaattgaacctacgaattcgccaattatgagttgggcgctttaaccattcagccatggatgcttagtggggatcctcgtacatggtgaataaccaaattccaattgaaatgaaatctttaggataaatcaatgcaatttaggaggaatcaatgaaaggacatcaattcaaatcctggattttcgaattgagagaaatagtgagagagatcaagaattctcactatttcttagattcatggacccaattcaattcagtgggatctttcattcatatttttttccaccaagaacgttttataaaactcttggaccctcgaatttttagtatcctacttttgcgcaattcacagggttcaacaagcaatcgatatttcacgatcaagggtgtagtactatttgtagtagcggcccttctatatcgtattaacaatcgaaatatggtcgaaagcaaaaatctctatttgaaagggcttcttcctatacctatgaattccattggacccagaaatgatacatcggaagaatcttttgggtcttccaatatcaataggttgattgtttcgctcctgtatcttacaaaaggaaaaaagatctctgagagctgtttccgggatccgaaagagagtacttgggttctcccaataactaaaaagtgtatcatgcctgaatctaactggagttcgcggtggtggaggaactggatcggaaaaaagagggatttttgttgtaagatatctaatgaaaccgtcgctggaattgatatctcatttaaagagaaagatatcaaatatctggagtttctttttgtatattatatggatgatccgatccgcaagggccatgattgggaattgtttgatcgtctttctccgagtaagaggcgaaacataatcaacttgaattcgggacagctattcgaaatcttagtgaaagactggatttgttatctcatgtttgcttttcgtgaaaaaataccaattgaagtggagggtttcttcaaacaacaaggagctgggtcaactattcaatcaaatgatattgagcatgtttcccatctcttctcgagaaacaagtgggctatttctttgcaaaattgtgctcaatttcatatgtggcaattccaccaagatctcttcgttagttgggggaagaatccgcacgaatcggattttttgaggaaaatatcgagagagaattggatttggttagacaatgtgtggttggtaaacaaggatagattttttagcaaggtacgaaatgtatcgtcaaatattcaatatgattctacaagatctagtttcgttcaagtaacggattctagccaattgaacggatcttctgatcaattcatagatcctttcgattccattagtaatgaggattcggaatatcactatcacacattgatcaatcaaagagagattcaacaactaaaagaaagatcgattctttgggatccttcctttattcaaacggaaggaagagagatagaatcagaccgattccctaaatacctttctggatattcctcaatgccccggctattcacggaacgtgagaagcgaatgaataatcatccgcttccggaagaaagcgaagaatttcttgggaatcctacaagagccattcgttcttttttctctgacagatggtcagaacttcatctgggttcgaatcctactgagaggtccactagggatcagaaattgttgaagaaagaacaagatgtttcttttgtcccttccaggcgatcggaaaataaagaaatagttaatatattcaagataattacgtatttacaaaataccgtctcaattcatcctatttcatcagatctgggatgtggtatggttccgaaggatgaactggatatggacagttccaataagatttcattcttgaacaaaaatccattttttgatttatttcatctattccatgaacggaagagggggggatacacgttacgccacgattttgagtcagaagagagatttcaagaaatggcagatctattcactctatcaataaccgagccggatctggtgtatcataagggatttgccttttctattgattcctccggattggatcaaagacaattcttgaaggaggttttcaacttcagggatgaatcgaaaaagaaatctttattggttctacctcctattttttatgaagaaaatgaatcttttatcgaaggatcagaaaaaattgggtccggatctcctgcgggaattatttggaagatccaaaaccaaaaagagtggtatttgctagcaacaacataatggaggcagtcaatcaatatagattgatccgaaatctgattcaaatccaattccaatatagtccctatgggtacataagaaatgtattgaatcgattctttttaataaagagacctgatcgcaacttcgaatatggaattcaaagggatctaataggaaatgatactctgaatcatagaactataatgaaagatacgatcaaccaacatttatcgaatttgaaaaagagtcagaagaaatggttcgatcctctgatttttctttcgcgaaccgagagatccataaatcgggatcctaatgcatatagatacaaatggtccgatgggagcaagaatttccaggagcatttggaacatttcgtttctgcgcggaagagccgttttcaagtagtgttcgatcgattatgtattaatcaatattcgattgattggtctgaggttattgataaaaaagatttgtctaagtcacttcgtttctttttgtccaagttacttcttacttatcttttgtctaactcacttccttttttctttgtgagtttcgagaatatccccattcataggtctgagatccacatctatgaattgaaaggtccgaacgatcaactctgcaatcagttgttagaatcaataggtcttcaaatcgttcatttgaaaaaattgaaaccctttttattggatgatcataatacttctcaaaaatcgaaattcttgatcaatggaggaacaatatcaccatttttcttcaataagataccaaagtggatgattgactcattccatactagaaagaatcgcaggaaatcttttgataacacggattcctatttctcaatcgtatcccacgatcaagacaattggatgaatcccgtgaaaccatttcagagaagttcattgatatcttctttttctaaagcaaatcgacttcgattcttgaataatccacatcacttctgcttctattgtaacaaaagattccctttttatgtggaaaaggcccgtctcaataattctgattttacgtatggacaattcctcactatcttgttcattcacaacaaaatattttctgcgtgcggtggtaaaaaaaaacatgcttttttggagagagatactatttcaccttcgtcaatcgagtcacaggtatctaacatattcatatctaatgattttccacaaagtggtgacgaaaagtataacttgtacaaatctttccattttccaattcgatccgatccattagttcgtagagctatttactcgattgcagacatttctggaacacctctaatagagggacaaagagtccattttgaaagaacgtattgtcaaactcttcagatatgaatctatccgattcagaagagaagagcttgcatcagtatctcaatttcaattcaaacatgggtttgatttacactccatgttctgagaaatatttacagaggaaaaaacggagtctttgcctaaaaaaatgcgttgacaaagggcagatggatagaacctttcaacgagatagtgctttttcaactctctcaaaatggaatctattccaaacatatatgccatggttctttacttcgacagggtacaaatatctaaatttgatattttagatactttttcagacctattgcggatactaagtagcagtcaaaaatttgtatccatttttcatgatattatgcatggattagatatatcatggcgaattcttcagaaaaaattgtgtcttccacaaaggaatctgataagtgagatttcgagtaagtctttacataatcttcttctgtccgaagaaatgattcatcgaaataatgagtcatcattgatatcgacacatctgagatcgccaaatgttcgtgaggtcctctattcaatccttttccttcttcttgttgctggatatatcgttcgtacacatcttctctttgtttcccgagcctatagtgagttacagacagagttcgaaaagatcaaatctttgatgattccatcatacatgattgagttgcgaaaacttctggataggtatcctacatctgaactgaattctttctggttaaagaatctttttctagttgctctggaacaattaggagattgtctagaagaaatacggggttctggcggcaacatgctatggggtggtgatcccgcttatggggtcaaatcaatacgttctaagaagaaagatttgaaaataaatttcatcgatatcatcgatctcataagtatcataccaaatcccatcaatcgaatcactttttcgagaaatacgagacatctaagtcatacaagtaaagagatctattcattgataagaaaaagaaaaaacgtgagcggtgattggattgatgataaaatagaatctgggtcgcgaacagtgattcgattgatgataaagaaagagaattcttggttcagttctccaccttaagggcagaaaaaaggattgatcaaattctattgagtctgactcatagtgatcatttatcaaagaatgactctggttatcaaatgattgaacaaccgggaacaatttacttacgatacttagttgacattcataaaaagtatctaatgaattatgagttcaatacatcctgtttagcagaaagacggatattccttgctcattatcagacaatcacttattcacaaacttcgtgtggggctaatagttttcatttcccgtctcatcgaaaacccttttcgctccgcttagccctatccccctctaggagtattttagtgataggttctataggaaccggccgatcctatttggtcaaatacctagcgacaaactcctatgttcctttcattacagtatttctgaacaagttcctggataacaagccgaaaggtttttttattgatgatatcgatattgatgatagtgacgatattgatgctagtaacgatattgatgctagtaacgatattgatcgtgaacttgatacggagctggagcttctaactatgatgaatgcgctaactatggatatgatgtcggaaatagaccgattttatatcacccttcaattcgaattagcaaaagcaatgtctccttgcataatatggattccaaacattcatgatcttgatgtgaatgagtcgaattacttagccctcggtctattggtgaactctctctccagggattgtgaaagatgttccactagaaatattcttgttattgcttcgactcatattccccaaaaagtggatcccgctctaatagccccgaataaattaaatacatgcattaaaataagaaggcttcttattccacaacgaaagcactttttcactctttcctatactaggggatttcacttggaaaagaaaatgttccatactaatggattcgagtccataaccatggggtccagtgcacgagatcttgtagcacttaccaatgaggccctatcaattagtattacacagaagaaatcaattatagacactaatacaattagatctgctcttcattgacaaacttgggatttgcgatcccaggtaagatcggttcaggatcatgggatccttttctatcagataggaagggctgttgcacaaaatgtacttataagtaattgccccatagatcctatatctatctatatgaagaagaaatcatgtaacgaaggggattcttatttgtacaaatggtacttcgaacttggaacgagcatgaagaaattcacgatacttctttatcttttgagttgttctggtcgctcaagacctttgtttgataatgatcgagtgacattgctttttcgctccgaaccaagggatcccttatatatgatgcaagatggatcttgttctatcgttgatcagagatttctctatgaaaaatacgaatcggagtttgaagaaggggaaggagaaggagtcctcgacccgcaacagatagaggaggatttattcaatcacatagtttgggctcctagaatatggcgccctcggggctttctatttgattgtatcgaaaggcctaatgaatggggatttccctatttggccgggtcatttcggggcaagcggatcatttatgatgaaaagtatgagcttcaagagaatgattcggagcagagcggaaccatgcagtaccagagacgagataggtcttctaaagaccaaggcttttttagaataagccaattcatttgggaccccgcggatccactctttttcctattcaaagatcagccctttgtctctgtgttttcacatcgagaattctttgcagatcaaacaactgaaataaaacatagtatatcacgttggattcgaatctag

SEQ ID NO: 4475 - DNA, 13371 bp, Quercus alba
caggattctatttgatcatcaatccaatcaccgtcacgttttttctttttcttatcaatgaatagatctctttacttgtatgacttagatgtctcgtatttctcgaaaaagcgattcgattgatgggatttggtatgatactcatgagatcgatgagattgatattcaaatatttcttcttagaacgtattgatttgaccccataagcgggcccaccgccccatagcatgttgccgccggaagcataaccccgtatttcttctatagaatctcctaattgttccagagcaactagaaagagattctttaaccagaaagaattcagctcagatgtaggatacctatccagaagttttcgcaactcaatcatgtatgatggaatcatcaaagatttgaccttttcgaattctgtctgtaactcactataggctcgagaaacaaagagaagatgtgtacgaacgagatatccagcaacaagaagaaggaaaaggattgaatagaggaactcccgaacattttgcgatctcagatgtgtcgatatcaatggtgactcattatttcgatgaatcatttcttcggacagaagaagattatgtaaacacttactcgaaatctcacttatcagattccattgtggaagacacaattttttctgaagaattcgccatgatatatctgatccatgcataatatcatgaaaaatggatacaaatttttggctgctacttagtatcggcaataggtctgaaaaagtatctaaaaatatcaaatttagatatttgtaccctgtcgaagtaaggaaccatggcatatatgtttggaatagattccattttgagagagttgaaaaagcactatctcgttgaaaggttctatacatctgccctttctcaaggcatttctttagacaaagactccgttttttcctcttttcggatggtaaatatttctcagaacatggagtgcgaatcaaacccatgtttgaattgaaattgagatactgctgcaagttcttcccctctgaatcagataaattcatatctgaaggaggtttacaataagttctttcaaaattgactatttgtccctctgttagaggtgttccaaaaatgtctgcgatcgagtaaatagctctacgaacgaatggatcggatcgaattggaaaatggaaagatttgtacaagttataccttctttcgtcaccactttgtggaaaatcgttaggtatgaatatgttagatacctgtaactcgattggtgaaatagtatctctctccaaaaaagcatgttttttttaccgccgcgcaaagaaaatattttgttgcgaatgaacaagatattgaggaattgtccatacgtaaaatcataattattgacacgggccttttccacataaaaagggaatcttttgttacaatcgaagcagaagtgatgtggattattcaagaatcgaagtcgatttgctttataaaaagaagatatcaatgaacttctatgaaatggtttcgcgggattcggccaattgtcttgatcgtgggatatcattgagaaataggaatccgtgttctcaaaagatttcctgcgattatttctagtatggaatgagtcaatcatccaccactttggtatcttattgaacaaaaatggtgatattgttcctccgttgatcaagaatttcgatttctgggaagtatcatgatcatccaataagaagggtttccattttttcaaatgaacgatttgaagacctattgattctaacaactgattgcagagttgatcattcggacctttcaattcatagatgtggatctcggacctatgaatggggatattcccgaaactcacaaagaaaaaaggaagtgagttagacaaaaagagaagaaacttggacaaaaaaagaagtaacttggacaaaaagaaaggaagtgacttagacaaatcttttttgtcgataacctcagaccaatcaatcgaatattgattaatacgtaatcgatcgaacactacttgaaaatgaaaacggctcttctgttcagaaatgaaatgttccaaatgttcctggaaattcttgctcccattggaccatttgtatctatatgcattaggatcccgattcatggatctctcggttcgagaaataaaactacgaggatcgaaccctttcttctggctctttttcaaatttgataaatgttggttgatcgtatatttcattatagttctatgattcagagtatcatttcctatttgatccctttgaattccatattcgaagttgcgatcggatctattcattaaaaagaatcgattcaatacatttattatgtacccacaggtgttatattggatttgaatcagatttcggatcaatttatattgattgactgcctcgattatgttgttgctagcaaatgccactatttttggttttggatcttccaaatcattcccgcaggaggtccggacccatttttctctgatccttcgataaaaggattcattctcttcataaaaaataggaggtagaaccaataaatatttctttttcgattcatccctggagttgaatacctcattcaagaattgtttttgatccaatctgcaggaatcaatagaaaaggtaaatcccttatgatacgacagatccggctcggttattgatagagtgaatatatccgccatttcttgaaatctctcttctgattcaaaatcgtggtgtaacgtgtatccccccctgttccggtcacgaaataaatcaaaaaatggatttttgttcaagaatgaaatcttattggaactgtccatatccagttcatccttcggaaccatatcacatcccggatcggatgaaataggatgaattgagacggtattttgtaaataagtaattatcttgaatatattaactatttctttattttccgatcgcctggaagggacaaaagaaacatcttgttctttcttcaacaatttctgatctctagtggacctctcagtaggattcgaacccagatgaagttctgaccatctgtcagagaaaaaagaacgaatggatcttgtaggattcccaagaaattcttcgatttcttccggaagcagatgattattcatctgcttctcacgttccgtgaatagccgggacattgaggaatatccagagaggcatttaggaaatcggtctgattctatctctgttcgttccgtttgaagaaaggaaggatcccaaagaatcgatccttcttttagttgttgaatctctctttgattgatcaatgtgtgatattccgaatcctcattactaatggaatcgaaatgatctctggattgatcagaagatcctttcaattggctagaatccgttacttgaacgaaactagatcttgtggaatcatattgaatatttgacgatacattccgtaccttgctaaaaaaccgatccttgtttaccaaccacacattgtctaaccaaatccaattctctctcgatattttcctcaaaaaatccgattcgtgcggattcttcccccaactaaagaagagatcttggcggaattgccacatatgaaattgagcacaattttgcaaagaaatagcccacttgtttctcgagaagagataggaaacatgctcaatatcatttgattgaatagttgacccagctacttgttgtttgaagaaaccctccacttcaattggtattttttcacgaaaagcaaagatgagataaccaatccagtctttcactaagatttcgaatagctgtcccgaattcaagttgattctgtttcgcctcttcctcggagaaagacgatcaaacaattcccaatcatgggccttgcggatcggatcatcaatataatatacaaaaagaaactccagatatttgatatctttctctttgaatgagatctcaattccagcgacggtttcattattagatatcttacaactggaatccctctttttccgatccagttcctccaccaccgcgaaccccagttagattcaggcatgatacactttttagttattgggagagcccaagtactctctttcggatccaggaaaaggctctcagagatcttttttccttttggaagatacaggagcgaaacaatcaacctattgatattggaagagccaaaagagtcttccaatgtatcatttctgggtccaatgaaattcataggtataggaagaagtcctgtcaaatagatattttttctttcgaccatctttcgattgttaatacgatatataaggaccactactacaaatagtactacacccttgatcgtgaaatatcgattgcttgttgaaccctgtgaattgcgtgaaagtaagatactccaaattcgggagtccaagagttttataaaacgttcttgatggaaaaaaatgtgaatgaaagatcccactgaattgaattgggtccatgaatctaagaaatagtgagaattcttgatctctctaaattcgaaaatccaggatttgaattgatgtcctttcattgagtcctcctaaattgcattgatttatcctaaggatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattagtgtggtatattcatatcataacatatgaacagtaagaactagcattcttattgagactaaaactcatagggaagaaaatagatttatgaatggaatcaaatatgcagtatttacagacaaaagtattcggttattgggtaaaaatcaatatacttttaatgtcgaatcgggatcaactaggacagaaataaagcattgggtcgaacgcttctttggtgtcaaggtaatagctatgaatagtcatcgactcccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatggacagcatcattgtagtaaaggtcgtaatgccagaggaatcattaccgcagggcatagagggggaggtcataagcgtctataccgtaaaatagattttcgacggaatgaaaaagacatatatggtagaatcgtaaccatagaatacgaccctaatcgaaatgcatacatttgtctcatacactatggggatggtgagaaaagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaaatgttggggtgaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggataggagagaaaatagaatttgtttcttcgtctttacaaaaaaaaagaaataggagttattgaatgtgacatgacacgctcactaaaaataaaaaaaatccttttgtagcgaatcatttattaagaaaaataaataagcttaacacaaaagcggaaaaagaaataataataacttggtcccgaacatctaccattatacccataatgattggccatactattgctatacataatggaaaagaacattttcctatttatataacagatcgtatggtgggccataaattgggggaattcgtacctactataaatttccgaggacacacaaaaaatgataatagatctcgtcgttaaaataagagtagttaataaaagtgaatatagatgcttattgtttattagcgagaggcaaatcttatgataaagaagaatccatataccgaaatatatatgcgctttaagtaaacatatatgtatgtctgctaataaagcggaaagagtaattgaaattgatcagatttgtggacgtttatacgaagaaagacgtatgagactcgaacttatgccttatcgagtgggttatccaattttaaaattggtttattctgcagcaacaaatgctattcacaatgtcggtttaaacgaagcaagtttaatcattagcaaagcggaagtcgtgaagaggtactactgtgaaaaaatgaaaacctcgagctcgagggcgtagttatccgataaaaagacccgtttttcatataactattggattaaaagatatatctgtaaaggaagtataaaaaggaagtataaaggagccaaatacgccatattatacttcaaggcaacgtatggagaaataaaaataagtaagtacacggatatgacgtgtcatgatatatatagtattgggagattatgggacaaaaaataaatccacttggtttcagacttggtgcaacccaaggtcatcattctctttggtttgcacaaccacaaaattattccgaagggctacaagaagatcaaaaaatccgagattggatcaagaattatgtacaaaaaaatattcaaatatcctctggtgttgagggaattgcatgcataaagattcaaaaaagaatcgatttgattcaggtcataatctatatgggattcccaaaattattactagaaggtaaaggtgggcctcgaagaatcgaagaattgcagatagatgtacaaaaagaaattaattgtgtaaaccgaaaactgaacattgctcttacaagaattacaaacccttatggacaccctaatattctcgccgaatttatagccggacaattaaagaatagggtttcatttcgaaaagcaatgaaaaaggctattgaattaactgaacaagcaggtacaaaaggaattcaagtacaaattgcaggacgtatcgacggaaaagagattgcgcgtgtcgaatggatcagagagggcagagttcctctacaaaccattcgagctaaaattgattattgttcctatgcagttggaactatctatggggtattaggcatcaaaatttggatatttgtagacgaggaagcctaagcctttatttgacttgtctttacggaaataaaaaagcaaaaaatgacaaactctttcattctttttctgttaaatcaaaaaaaatgggcaattctataaggttgaataaaaattcaattcatttttttatattgatataattgctatgcttagtgtgtgactcgttggtttttgtagggttagtagtcaaaaaaacggactggcccatagtatgaactaataactatcgaactaataaccaactcaccgcttcatattatctggatctaaagaactagtcacgatatgatatattgatcatatcattgtagcaacttaatttttgtttgcataaacaagcaaaaaaaaaaaaaaccaatctgattttaagttgtgaagcaataacaaaaagaatgcagataaatggaagggtgagagaaagagagaaaaagaatactaatgctatatgattccaatatgtaaggtctctgagcgatcttataaaggatagcgtaataaagcatcaatactaatttgattgatctataattcgattaatttgttcatagaacaaaaaaagtcaagagccctgggtccacaaagactgagaaaattgactcaataacacatttcattttcattaggagctccgctgtagaattcaggcctaaccattaatcgcgaagcgatgggaacgacggaacccgtggatgcagaagattctattgaaaacgaatcctaataattcattgggtaggatggcgaaacgaacccgggaccaatccacttttattctgagaggccatgtcataggataaccctacaactgaaatagatatggaaagagtaaatattcgcccgcgaaagtttttattttattggatttctaaattttgatagatccaatataatatgataataaaaaagacaaaacaaaataaatactcgttataataaaacgaaattctattattattatctattatctttaactaatctataaaataattatctataactataaataaatagaaattgaatacatgtttagttttttttatataaactatcaaaacaagatatacaaatttctaatagattagatattagataaaatctcaaagactcccacgattcagtatattattcattaaatacatgtataccatgttataattgttatttttcattcgcgaggagctggatgagaagaaactctcatgtccggttctgtagtagagatggaattgaaattgaaaaagaaccatcaactataaccccaaaagagccagattccgtaaacaacatagaggaagaatgaaaggaatatcttatcgaggtaatcgtatttgctttggtagatatgctcttcaggcacttgaacccgcgtggatcacgtctagacaaatagaagcagggcggcgagcaatgacacgaaacgtacgccgcggcggaaaaatatgggtacgtatatttccagacaaacctgttacagtaagacccgcggaaacgcgtatgggttccggtaaaggatctcccgaatattgggtagctatcgttaaaccgggtagaatactttatgaaatgggtggagtagcagaaaatgtagccagaaaggctatttcaatagcggcatcaaaaatgcctatacgaacgcaattcattatttcgggataagaatgtataaccaaagaaaagaaatcttttgaatgaaaaaaaaacaaaattataggtttctttttttttgtttttggacaaacaatatttctttttttacttagccccttcgcagtgaaagagcaaataaaaaaaatgatatgattcaacctcaaacccacttaaatgtagcggataacagcggggcccgacaattaatgtgtattcgaatcataggagctagtaatcgacgatatgctcatattggtgacgttattgttgctgtaatcaaggaagcaataccaaatacacctctagaaaaatccgaagtgatcagagctgtaattgtacgtacttgtaaagaactcaaacgtgacaacggtatgatactacgatatgatgacaatgctgcggttgttattgatcaagaaggaaatcccaaaggaactagaatttttggtgcgatcgcacgggaattgagacagttaaatttcactaaaatagtttcattagcacctgaagtattataagtctaataaaacggagactctaatgctattatagcatttgaataaaatatgaatagagtaaactagattaattagtaaatttgtctcacgcatatatctttaacaattcataaaatagaaagaaaaaagcatgttgattatatcaaagttcgggggtaacaataattttaatttatcatgggtaaagacactattgctgatataataacttctatacgcaatgctgacatgaatagaaaaggaacagttcgaataccatctactaacatcaccgaaaaccttgttaaaatactgttaagagaaggttttattgaaaatgtgaggaaacatcaggaaaacaacaaatattttttggttttaaccctacggcatagaaggaataggaaaggtccatgtaaaactgttttaaatttaaaacggatcagtcgacccggtctacgaatctattctagttatcaacgaattcctagaattttaggtgggatggggattgtaattctttctacctctcggggtataatgacggaccgagaggcccaactagaaggaatcggcggagaaattttgtgttatatatggtaagcttccttatatccaaattaagatatggaactttaccatttgtgaaaaagataaagaacaggtttctattctcactctcctcttacattagttaatacttcaaggaggttttaccgcgaatgaaaaaagaaaactggattcaggaaagtttaattcctgaatcacttccgaatggtatgcttcggattcatttagataatgaagatcggattctaggttatggttcaggaaggattcaacgtagttttatacgtataccaacggaagatagagtaaaaattgaaagaagtcattatgattcaaccaaagggcatatagtttctagactccgaaacaaggattcaaacgattaggtggtttttttttcaacttcaatattcctttcggagggatacaattcgaaagtttcaaatttccagaaactaattttcttcaaataagtaaatttgaaattcagttaaggaatgacaaatatgaaaataagggcctccattcgtaaaatttgtgaaaaatgtagactgatccgtagacggggacgaattatagtaatttgttccaacccgagacataaacaaagacaaggataatctttataaaataaaagagactccctaagggacccaatatacaaataaaaaaaagcggaaaagatccgttttggcatgaaatggatatatccatatacctctgacttatatttatgagacgataaaatatggcaaaacccgcacccagaatcggttcacgtaggaatgggcgtattggtttacgtaagagtgcgcgtagaataccaaaaggggttattcatgttcaagcaagtttcaacaataccattgtgactgttacagatgtacgaggccgggtaatttcttggtcctccgccggtacttgtggattcaagggtacaagaagagggacaccctttgcggcacaaaccgcagcaggaaatgctattcggacggtagtggatcaaggtatgcaacgagccgaagtcatgataaaaggccccggtctcggacgagatgcagcattaagggctattcgtagaagtggtgtaatattaagtttcatacgggatgtaacccctatgccacataatggctgtaggccccctaaaaaaggcgtgtgtaaaaataaacaaaacattgaaatgatttcaagagaaataaataatttaatgatttgatcaaataataagattaccatggttcgagagaaagtaatagtatcgactcggacactgcagtggaagtgtgttgaatcaagaggagatagtaatagtctctattatggacgtttcattctgtctccacttatgaaaggtcaagccgatacaataggcattgcggtgcgaagagctttgctcggagaaatagaaggaacatgtatcacacgcgcaaaatttataccacatgaatattctaccataataggtattcaagaatccgtacatgaaattttaatgaatttgaaagaaattgtattgagaagtaatctgtatggaattagtggtgcgtccatttgtgtcaagggtccccgatatgtaactgctcaagatatcatcttaccaccttctgtgcaaattgttgataatacacagcatatagctaacctaacggaaccaattaatttgtatattgaattacaaatcgaaagggatcgcggatatcgtataaaaacaacaaataactctcaagacggaagttatcctatcgacgctgtattcatgcctgttcgaaatgcaaaccatagtattcattcttatgtaaatgggaatgaaaaacaagagatactttttctcgaaatatggacaaatggaagtttaactcctaaagaagcacttcatgaagcctcacgtaatttgattgagttatttattccttttttacatgcggaagaagaaaaattacatttagaaaataatcaacaaaaagttactttacccttttttacttgtcatgatagattggctaaactaaataaaaattcaacagaaatagcattgaaatccatttttatagaccaattagaattgccccctagaatttataattgcctcaaagggtccaatatacataccctcttggaccttttaaataacagtcaaaccgactttatgaaaatgaaacattttcgcagagaagacataaaacatatattggacattctcgaaatagaaaaggatttcgtataaatttcaaatccattggatttcatctttttttttattagttagacaaaaactttagaaaaaaaatgggttttgaatctttagcacaatccataactcagaatagatccaaaattgaattattgcagagatgtatctagggaatagtcgctgcaaagcgaattccccctagatacacatgtcgtgatagtttatttcacaattgaatcaatttaaaaaatacctaaagttaaggatttatcaataggtaatgttgctccaatacccaaccaaagggctactgcggtaccaatcaaaaagactgttgttgctactggacgacgaaatggattttggaatttattaacattctccaaaaaaggtactgttaataaacccgcgggtactaaaaccattaaaagaacccccaataacttattgggcactgtacgaagtatttgaaatacgggaaagaaataccattcgggcaatatttctaaaggagttgcaaatggatccgcgggttcaccaatcattgatggttctagaaccgctaagcctacgttacatgcaatagttcctagaattactactggaaaaatatataaaagatcattgggccatgcgggttctccataataattatgacccatacctttagccaacttagctcttaatacaggatcgttcaagtcaggtttttttgttattgggataggtgaattattatagatccatcccccgagggaaccggacatgataatttttcatcatccggctcgagcacaaatcaaacgaaggcaagtaattctgttcttacaggtaaatgctcaatacccaagtaggcttacaaagttgaccatgatcaagcgctttctgggtcgtctcagaccttgcgattgccttttcttcc

SEQ ID NO: 4476 - DNA, 1037 bp, Ricinus communis
aaagggtagaagaatgagacctattatgggacatacaatgcattacagacgtatgatcattactcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatacacgaaatacacgaaataatttgatctatggacagcatcgttgtggtaaaggccgtaacgccagaggaatcattaccgcaaggcatagagggggaggtcataagcgtctataccgtaaaatcgattttcgacggaatgaaaaagacatatatgggagaatcgtaaccatagaatacgaccctaatcgaaatgcatacatttgtctcatacactatggggatggtgagaagagatatattttacatcccagaggggctataattggagataccattatttctggtacagaagttcctataaaaatgggaaatgccctacctttgaccgatatgcccttaggcacggccatacataacatagaaatcacatttggaaagggtggacaattagctagagctgcaggtgctgtagcgaaactgattgcaaaagaggggaaatcggccacattaaaattaccttctggggaggttcgtttaatatccaaaaactgctcagcaacagtcggacaagtagggaatactggggtgaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggagaaaaaatagaatttgtttcttcgtcttttcaaaataaaaaaaaaaaaaaaaaaaataggagaaattcact

SEQ ID NO: 4477 - DNA, 1559 bp, Vigna unguiculata
ctccctccaaaaagtctatcggatttttgttcaagaatgaaatcttattggaactgtccagttcaccctttggaaccatatcacatcctcgataggatgaaataggatgaattgagacggtattttgtaagtacataattatcttgaataaattcactatttctttcttttccgatcgcctggaaaaagcaagatgtttcttttgttcttttttcaacaatttctgatctctagtagacctatcagtaggattcgaacccagatgaagttctgaccatctgtcagagaaaaaagaacgagtggctctgtatcaatggaatctcatcatccatacataacgaattgatgtggtatattcaaatcataacatatgaacagtaaaaactagtattttaattgagactagaactcatagggaagaaaatagatttatgaatggaataaaatatgcagtatttacagacaaaagtattcggttattggggaaaaatcaatatacttttaatgtcgaatcgggattaactaggacagaaataaagcattgggtcgaactcttctttgatgtcaaagtaatagctatgaatagtcatcgactcccggtaaagggtagaagagtacgacctattatgggacatacaatgcattacagacgtatgatcattacgcttcaaccgggttattctattccacctcttagaaagaaaagaacttaaatcaaaatacttaatagcatggcgatacatttatacaaaacttctaccccaagcacacgcaatggaaccgtagacagtcgtcaagtaaaatccaatccacgaaatcatttgatctatggacagcatcgttgtggtaaaggtcgtaatgccagaggaataattaccgcagggcatagagggggaggtcataagcgtctataccgtcaaattgattttcgacggaatgaaaaaaacatatatggtagaatcgtaaccatagaatatgaccctaatcgaaatgcatccatttgtctcatacactatggggatggtgagaaaaaatatattttacaccccagaggggctataattggagataccattgtttctggtacagaagttcctatcaaaatgggaaatgccctacctttgaccgatatgcccttaggcacggccatacataacatagaaatcacactcggaaagggtggacaattagctagagcagctggtgctgtagcgaaactaattgcaaaagaggggaaatcggccacattaaaattaccttctggggaggtccgtttgatatccaaaaactgctcggcaacagttggacaagtgggaaatgttggggtaaaccagaaaaatttaggtagagccggatctaaatgttggctaggtaaacgtcctatagtaagaggagtagttatgaaccctgtagaccatccgcatgggggtggtgaagggagggccccaattggtagaaaaaaacccgcaactccttggggttttcctgcacttggaagaagaagtagaaaaaggaagaaatatagtgataatttgattcttcgtcgtcgtactaaatag

SEQ ID NO: 4478 - DNA, 1402 bp, Lactuca sativa
atggcgatacatttatacaaaacttctaccccgagcacacgcaatggagccgtagacagtaaagtgaaatccaatccacgaaataatttgatctatggacagcatcattgtggtaaaggtcgtaatgccagaggaatcattaccgcagggcatagagggggaggtcataagcgtctataccgtaaaatagattttcgacggaatgaaaaagacatatatggtagaatcgtaaccatagaatacgacccgaatcgaaatgcatacatttgtctcatacactatagggatggtgagaagagatatattttacatcccaggggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaagggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgccctgtagtaagaggagtagttatgaaccctgtagaccatccacatgggggtggtgaagggagggccccaattggtagaaaacaacccacaaccccttggggttatcctgcacttggaaaaagaagtagaaaaaggaataaatatagtgataatttgattcttcgtcgccgtagtaaataggagagaaaatagaatttctttcttcgtctttacaaaacaaaaaataggaggaagctgtgacacgttcactaaaaaaaatccgtttgtagcgaataatttattaaaaaaataaataagcttaacacaaaagcagaaaaagaaataataataacctggtcccgggcatctaccattatacccataatggtcggccatactattgctatccataatggaaaggaacatttacctatttatataacagatcgtatggtaggacacaaattgggagaatttgcacctactttaaatttccgaggccatgcaaaaagcgataatagatcgcgtcgttaaaaaacgtttgtttatgtataataatatatatagatatttatcattgattagtaggaggcgaactttatgttaaataagagaacaacagaagtatacgctttaggtcaacatatatctatgtctgctcacaaagcgcgaagggtaattgatcaaattcgtgggcgttcctacgaagaaacacttatgatattagaactcatgccttatcgagcatgttatcccatttttaaattagtttattctg

SEQ ID NO: 4479 - DNA, 3056 bp, Tripterygium wilfordii
agaacgaaaagaacttaaatcaaaatacttaatagcatggcgatacatttatacaaaacttctaccccgagcacacgcaatggagccgtagacagtcaagtgaaatccaatacacgaaataatttgatctatggacagcatcgttgtggtaaaggtcgtaatgccagaggaatcattaccgcagggcatagagggggaggtcataagcgtctataccgtcaaatcgattttcgacggaaggaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtagggaatgttggagtgaaccagaaaagtttgggtaaagccggatctaaatgttggctgggtaagcgtcctatagtaagaggagtagttatgaaccctgtagaccatccccatgggggtggtgaagggagggccccaattggtagaaaaaacccgtaaccccctggggttatcctgcacttggaagaagaagtagaaaaaggaataaatatagcgataatttgattcttcgtcgccgtagtaaataggagagaaaatagaatttgtttcttcatctttacaaaaaaaaataggagtaattaactgtggcacgttcactaaaaaaaaataccttttgtagcgaatcatttattaggaaaaataaataagcttaacacaaaggcggaaaaagaaataatagtaacttggtcccgggcatccaccattatacccacaatgatcggacataccattgctatccacaatggaaaggaacatttgcctctttatataacagatcggatggtaggacataaattgggagaatttgcacctactctcaatttccggggacatgcaaaaaatgataatagatctcgtcgttaataaaaaagaatcaaaaaaaaagaaatgggcgaacgataactaataaatagttcattaaaaagaggtggactttatgataaaaaaaaatatatatatacaccatatacaaaagtatacgcaataggtcagcatatgtctatgtctgctcacaaagcgaaaatagtaattgatcagattcgcggacatttttacgaggaaacacttaggatactcgaactcatgccttttgaaatatgttatcccgtttttaaattggtttattctgcagcagcaaatgcaagtcacaatattgagtccaacaaatcaaacttaatcattagcaaagctgaagtcaacgagggcggaactctgaaaaaatttaaacctcgagctcgaggacgaagttatccgataaaacgacgcacttgtcatataactattgtattgaaagatatatctttaaatgaatatgaagaatataaaaactataacgatatatgaagactatgaaaaaaaaaatagaatatagcatatacttaccaaaaccggactggataaagaactaataaagaaaaaatataggatgtgtcgtgatatgtatattagtgggggattatgggacaaaaaataaatccacttggtttcagacttggcacaacccagggtcatcattctctttggtttgtacaaccaacaaattattccgaaagtctgcaagaagatcgcaaaatacgaaactttatcaaaaactatgtacaacaaaacataaaaatatcttccggtgttgagggaattgcacgtatagagattcaaaaaagaattgatctgattcaagtcctaatatatataggattcccgaagttattaatggagagtaggactcgaagaatcgaagaattacagaggaagttacaaaaagaattaaattgtatgaaccgaaaactcaacattgctattacaaggattgcaaatccttatggacatcctactattcttgcagaatttctagccggacaattaaaaaaccgagtttcatgtcgtaaagcaatgaaaaaagctattgaattagctgaacagacgaatacaaaaggaattcaagtacaaattgcagggcgtatcaacggaaaagaaattgcacgtgttgactggatcagagaaggtagagttcctctacaaacaattcgagctaaaatcgattattgttcctatactgttcaaactctttatggggtattgggaatcaaaatttggatatttggagacgaggaataataaacctttacttgacttgttttgatttttatgttgtaacccagaacagaaaataacaaactttttaagtcgttttataaaaaatgagcaattcgagattccattctcaattcgaaattctattctatagggttgaataaaaatgcgattgaaaatttcatcttatttcatcttgatataattgccatgcttagtcccaaaagaaccagattccgtaaacaacatagaggaagaatgaaaggaatatcttatcgaggtaatcatatttctttcggtagatatgctcttcaggcacttgaacccgcgtggattacatctagacaaatagaagcaggtcggcgggcaatgacacgaaatgtccgccgcggtggaaaaatatgggtacgtttatttccagacaaaccagttacggtaagacctatagaaacacgtatgggttctgggaaaggatctcctgaatattgggtagctgtcgttaaacccaatattcaggagatcctttatgaaatggacggagtaggagaaaatatagctcaaaaagctatttcaatagcggcttcaaaaatgcctatacgaactcaattcattatttcggtatagaaatgtag

SEQ ID NO: 4480 - DNA, 1152 bp, Eutrema halophilum
aaatctgtgcgtttttattttagacaatacaaaaaagaatagtattgtagggcggatgtagtcaagtggattaaggcagtggattgtgaattcaccatcgcgggttcaattcctgtcgttcgcccgtgatgcccgggaccaagttattatgatttctttttccgcctttgtattaagcttctctatttttcttaataaatgctttgctacaaaaggatttttttttagtgaacatgtcacagttaattaactcctattttttttaagacgaagaaagaaattctattttctctcctatttactacggcgaagaagaatcaaagtctcactatattttttcttttttctagttcttcttccaagtgccggataaccccacggggttacgggtttttttctaccaattggagccctcccttcaccacctccatggggatggtcgacagggttcataactactcctcttactacaggacgtttacctagccaacatttcgatccggctctacccaaacttttctggtttaccccaacatttcccacttgtccgactgttgctgagcagtttttggatatcaaacggacctctccagaaggtaattttaatgtggccgatttcccctcttttgcaatcagtttcgctacagcacccgccgctctagctaattgtccaccctttccaagtgtgatttctatattatgtatggccgtgcctaagggcatatcggttgaagtagggcatttcccatttttataggaacttctgtaccagaaacaatggtatctccaattatagcccctctgggatgtaaaatatatctcttctcaccatccccatagtgtatgagacaaatgtatgcatttcgattagggtcgtattctatggttacgattctaccatatatgtcttttgcatttcttcgaaaatctattttacggtatagacgcttatgacctccccctctatgccttacggtaatgattcctctggcattatgacctttaccacaatgatgctgcccatagatcaaattatttcgtggattggatttcacttgactgtctacggctccattgcgtgtgctcggggtagaagttttggataaatgtatcgccatgctattaagtattttgatttaagttcttttcttt

SEQ ID NO: 4481 - DNA, 11859 bp, Amborella trichopoda
atccgtagagtacattgaatgtacagaaatggctataacggagtttctgttattcgtattaacagctactctaggaggaatgtttttatgcggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaatttcaattgcgcttatattcatcactgtaggaattgggttcaagctttccccagccccttctcatcaatggactcctgacgtatacgaaggagtgcggttcgttcgataaattcctacctctctatctatctctgagatgtttggatttttcaaaactccatggacatgcagaagagaaatgctatccccactcggaccaagacataacttttacttgttcaaataacaattaaggtgaagcagggtcaggaacaacgaatctctttatcataaagagattcattttgcaagttcgttattacgggtagttcctacaaagcaaaggatcggactaatgacgtatacaatacttgaattctcgatgtagatgctacatagttggttctcatccttcagagactacgagtgtaataggagcatccgtcgacaaaaggatcaccctaagatgatcatctcatgtctattgagaacgaatcaaatcagatggttctatttctcaatctttctgacttgctcctacggaaccaaggtcgaaaagattgagaaaaatcagtcattcacaaccactgatgaaggattcctcgaaaagttaaggattagtaatcctttttagaaatcgaatggattcggtcttatacatacgcgaggaaggtaatcaaaaaagaaagaagataagttcttctttcttttatcacttaggagccgtgcgagatgaaagtctcatgcacggttttgaatgagagaaagaagtgaggaatcctcttttcgactctgactctcccactccagttgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcgtattcgtccataggtcaaattggatatgtaattattggaataattgttggagactcaaatggtggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctctgtctcttatccttaggaggtcttcctccactagcaggttttttcggaaaacttcatttattctggtgtggatggcaggcaggcctatatttcttggtttcaataggactccttacgagcgttgtttctatctactattatctaaaaataatcaagttattaatgactggacgaaaccaagaaataacccctcacgtgcaaaattatagaagatcccctttaagatcaaacaattccatcgaattgagtatgattgtatgtgtgatagcatctactataccaggaatatcaatgaacccgattattgaaattgctcaggatacccttttttagcttctagaacctatttcttagttcaagatccctcttactaactggaatcaaagaattagtagatctgttccgcccaaaaggggaatgggctagggttatgaacttataatcgataatctgatgatcgagtcgattccatgattataagttcattccataccggaccagaccggaatagggttatatacattctaattatgagaaggggtcattcgagcgtatctaaatagatactatgtttacatatggatccctacgtcgttacattccatttaggattaggaataggcgtaatcggacctgctttctacatatctctcgttatttgggaccctattcacctctttgggcttctattgaatcgagaaataggtttgattgtccatctttttgatataatatatataaatataaggcatcctccggataattcaaatcgaagcaattggatgtccgactcgggcctatatgacatgaccgatcaatagaaatactctaacactccgcctttgtcatatattccatacatcacactggatagatatcatattcatggaatacgattcactttcaagatgccttggtggtgaaatggtagacacgcgagactcaaaatctcgtgctaaagagcgtggaggttcgagtcctcttcaaggcataatattgaatattgagaatgctcattgaattggaataagttcggcagcggatcacgaaatcttggtgatcttctctatctaatgaatggggagtccgctttgaaatcgtccgccctgcacccaccccccgagtatatgcttcaacaggaatcacacaagggtagatcgatacaatagaaacctctggtaaaatgcccaacccagcagataaagtacattacatagtccgttttagggattggcgacttacccattcagtgactttggcgctggacgttcccaaaatgggtactatcgggtcgggtgaattcaataatagacgcctgttggcattccagcttcccttctcctttcagggcctatccgaaagagattcttggtcgtgaatatctgaataggacgaaccgctccgtggatatctttgcttcggaacaaaacaattagaattagtcggtcaactggaatgtgtattatccatataggggatctttcaattgagaagatccgtcgacctgagacgaagagaaatgtctatctattttatttagttattcagttaaaccaatgattcgttattgtagcagatagcaacaaccatttcatccgggaaaagccatctttttctcaacaatgtctttgtcatttgatccaatagcgttccgttagataggaacagctttgataaatactgataactctcagatggagtattagaacggaaaaatccattagataatgaactattggttctaagccatctctggcgataaatcaacaattcgaagtacttttcttgcgtattcttgataaaccagcgtttatatatagatgtaggaagatctgtttgggaagtaagaagcccctttgacatctcttcatctgcaaagaattctcgatgtgaaaacacagagacaaagggctgatctttgaataggaaaaagagtggatctgcagggtcccaaatgaattggcttattcgaaaaaagccttgttctttggaagatctatctcgtgtctggtactgcatggttccactctgcaagaactccgaatcattctgttgaagcccatcctcttcatcataaatgatccgcttgccccgaaatgacctggcccaatagggaaatcccaattcgttggggctttctatttgattgtatcgaaaaccccaagggcgccatattctaggagcccaaactatgtgattgaataaatcctcctctatccgttgcgggtcgaggactccttctccttctccttccccttcttcaaactccgatttgtattgttcatagagaaatctctgatcaacgatagaacaagatccattttgcatcatatctaagggattccttggttcgggccgaagaagcaatgtcactcgatcattatcaaactggctgcaacctttttctgtctgtgaggatcccaccagagtgccttctacttctaataggccatgaactagatcagaatcattctcaacgagtccataagaagtgatcccatttttttcatcgagttcgggtagagaccaaaggtcttgagcgaccgatccggcagaacaactcaaaagataaagaagtatcgttaatttcttcatgctcgttccaagttctaagtaccatttgtacaaataagaatccccttcgttacatgatttcttcttcatatagatagatataggatctagggagcaattacttagaagtacattttgtgcaacagcccttcctatctgatagaaaaggatcccatgatcctgaaccgatcttacctgggatcgcaaatcccaagtttgtctatgaagagcagatctaattatattagtgtctataattgatttcttctgtgtaatactaattgatagggcctcattggtaagtgctacaagatctcgtacattggaacccatggttatggacccgaatccattagtatggaacattttcttttccaagtggaatcccctagtatatgaaagagtgaaaaagtgctttcgttgttgtggaataagaagccttcgtatcttaatgcatgtatttaatttattcggagctattagagcgggatccactttttggggaatatgagtcgaagcaataacaagaatatttctagtggaacatctttcacaatccctggagagatagttcaataatagaccgagggataagtaattcgactcattcacatccagatcatgaatgtttggaatccatattatgcaaggagacattgcttttgctaattcgaattgaagggtgatataaaaccggtctatttccggcatcatatccatagttagcgcattcatcatagttagaagctccagctccgtatcaaagtcacggtcgatatcgtcactatcatcaatatcgtcactatcatcaatatcgtcactatcatcaataagaaaacccttaggcttgttatccaggaacttgttcagaaatactgtaatgaaaggaacataggagtttgtcgctaggtatttgaccaaataggatcgtccagttcctatagaacctatcactaaaatacccctagagagggatagggctaagcggagcgaaaaaggttttccatgagatgggaaatgaaaactattagccccacaggaggtttgtgaataagtgattgtctgataatgagaaaggaatatccgtctttctgctaaacaggatgtattgaactcataattcattagagactttttatgaatgtcaactaagtatcgtaagtaaattgctcccggttgttcaatcatttgataaccagagtcattctttgataaatgatcactatgagtcagactcaatagaatttgatcaatccttttttctgtcgttaaggcggagaactgaaccaagagctctctttctttatcatcaatccaatcactgttcgagacccaggattctattttatcatcaatccaatcactgttcaccttttttctttttcttatcaatgaataggtctctttacttgtatgacttagatgtctcgtatttatcgaaaaagagattcgattgatgggatttggtatgatacttatgaaatcgatgatatcgatgagattgatattcaaatatttcttcttagaacgtattgatttgaccccataagtgggaccgccaccccatagcatgttgccgccagaagcagaaccctgtatttcttctagagaatctcctaattgttcccgagcaactagaaagagattctttaaccagaaagaattcagttcagatgtaggatacctatccagaagttttcgcaactcaatcatgtatgatggaatcatcaaagatttgaccctttcgaactctgtctgtaactcactataggctcgagaaacaaaaagaagatgtgtacgaacgagatatccagcaacaagaagaaggaaaaggattgaatagaggaactcccgaacccgaacatttggcgatctcagatgtgtcgatatcaatggtgactcattatttcgatgaatcatttctttggacagaagaagattatgtaaacacttactcgaaatctcacttatcagattccattgtggaagacagaattttttctgaagaattcgccatgatatatctaatccatgcataatatcatgaaaaatggatacaaattttgggctgctacttagtatcggcaataggtctgaaaaagtatctaaaaatatcaaatttagatatttgtatcctgtcgaagtaaggaaccatggcatatatgtttggaatatattccattttgagagagttgaaaaagcactatctcgttgaaaggttctatacatctgccctttctcaaggcatttctttagacaaagaccccgttttttcctcttttcggatggtaaatatttctcagaacatggagtgtgaatcaaacccatgtttgaattgaaattgagatactgatgcaagttcttctcttctgaatcagacagattaatatctgaaagaggttgacaataagttctttcaaaattgactatttgtccccctgttagaagtattccagaaatgtctgcgatcgagtaaatagctctacgaacgaatggatcggatcgaattggaaaatggaaagatttgtacaagttatacctttcgtcaccattttgtggaaaatcgttaggtatgaatatgttagacacctgtaactcgattggtgaaatagtatctctctccaaaaaagcatatttttttttaccgccgcgcaaagaaaatattttgttgcgaatgaacaagatattgaggaattgtccatacgtaaaatcataattattgatacgggccttttccacataaaaagggaatcctttgttacaatagaagcagaagtgatgtggattattcaagaatcgaagtcgatttgctttataaaaagaagatatcaatgagcttctatgaaatggtttcacgggattcagccaattgtcttgatcgtgggatatcattgagaaataggaatccgtgttatcaaaagatttcctgcgattatttctagtatggaatgagtcaatcatccactttggtatcttattgaacaaaaatggtgatattgttcctccattgatcaagaatttcgatttttgggaagtatcatgatcatccaataaaaagggtttccatttttttaaatgaacgatttgaagacctattgattctaacaactgatggcagagttgatcattcggacctttcaattcatagatgtggatctcggacctatgaatggggatattcccgaaactcacaaagaaaaaaggaagtgagttagacaaaaagagaagaaacttggacaaaaaaagaagtaacttggacaaaaagaaaggaagtgacttagacaaatcttttttgtcgataacctcagaccaatcaatcgaatattgattaatacgtaatcgatcgaacactacttgaaaatgaaaacggctcttctgctcagaaatgaaatgttccaaatgttcctgtaaattcttgctcccattggaccatttgtatctatatgcattaggatcccgattcatggatctctcggttcgagaaataaaaataagaggatcgaaccatttcttctgactctttttcaaatttgagaaatgttggttgatcatatatttcattatagttctatgattcagagtatcgtttcctatttgatccctttgaattacatattcgaagttgcgatcggatctattcattaaaaagaatcgattcaatacatttcttatgtacccataggtgctatattggatttgaatcagatttcggatcaatctatattgattaactgcctccattatgttgttgctagcaaataccattatttttggttttggatcttccaaatcattcccgcaggaggtccggacccatttttttctgatccttcgataaaaagattcattttcttcataaaaaataggaggtagaaccaataaatatttctttttcgattcatccctggagttgaatacctcattcaagaattgtttttgatccaatctgtaggaatcaatagaaagggcaaatcccttatgatacaccagatccggctcggttattgatagagtgaatagatctgccatttcttgaaatctctcttctgattcaaaatcgtggtgtaacgtgtatccccccctgttccggtcatggaatagatgaactaaatcaaaaaatggatttttgttcaagaatgaaatcttattggaactgtccatatccagttcatccttcggaaccatatcacatcccggatctgatgaaataggatgaattgagacggtattttgtaaatacgtaattatcttgaatatattaactatttctttattttccgatcgcctggaagggacaaaagaaacatcttgttctttcttcaacaatttctgatctctagtggacctctcagtaggattcgaacccagatgaagttctgaccatctgtcagagaaaaaagaacgaatggatcttgtaggattcccaagaaattcttcgatttcttccggaagcagatgaataatcatctgcttctcacgttccgtgaatagccgggacattgaggaatatccagaaagacatttagggaatcggtctgattctatctctgttcgttccgtttgaagaaaggaaggatcccaaagaatcgatctttcttttagttgttgaatctctctttgattgatcaatgtgtgatattctgaatcctcattactaatggaatcaaaatgatatctggatcgatcagaagatcctttcaattggctataatccgttacttgaacgaaactagatcttgtggaatcatattgaatatttgacgatacattccgtaccttactaaaaaaccgatccttgttttccaaccacacattgtctaaccaaatccaattctctctcgatatgttcctcaaaaaatccgattcgtgcggattcttcccccaactaaagaagagatcttggcggaattgccacatatgaaattgagcacaattttgcaaagaaatagcccacttgtttctcgagaagagatgggaaacatgctcaatatcatttgattgaatagttgacccagctccttgttgtttgaagaaacccttcgcttcaattggtattttttcacgaaaagcaaacatgagataacaaatccagtctttcactaagatttcgaatagctgtgccgaattcaagttgattatgtttcgcctcttcctcggagaaagacgatcaaacaattcccaatcatggtccttgcggatcggatcatccatataatatacaaaaagaaactccagatatttgatatctttctctttgaatgagatctcaattccagcgacggtttcattagatatcttacaactagaatccctcttttttccgagccagttcctccaccatcgcgagccccagttagattcaggcatgatacactttttagttattgggagaacccaagtactctcttttggatccaggaaacagctctcagagattttttttccttttggaagatacaggagcgaaacaatcaacctattgatattggaagaccaaaaagattcttccaatgtatcatttctgggtccaatgaaattcataggtataggaagaagccctgtcaaatagagattttttctttcgaccatctttcgattgttaatacgatatataaggaccgctactacaaatagtactacacccttgatcgtgaaatatcgattgctcgttgaaccctgtaaatgtgaattgcgtgaaagtaggatactccaaattcgggagtccaagagttttataaaacgttcttgatggaaaaagatgtgaatgaaagatatcactgaattcaattgggtccatgaatctaagaaatagtgagaattcttgatctctctcaatatctctctcaattcgaaaatccaggatttgaattgatgtcctttcattaagattaagtcctcctaaattgcattgatttaccctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattggtgtggtatattcatatcataacatatgaacagtaagacctaacagtcttattgagactagaactcatagggaataaaatttatggatggaatcaaatatttcgtagttacagacaaaagtattcggttattgctgaaaaatcaatatacttctaatgtcgaatcaggatcaactaggacagaaataaagcattgggtcgaactcttctttggtgtcaaggtaatagctatgaatagtcatcgactaccgggaaagggtagaagaatgggacctattatgggacatacaatgcattacaaacgtatgatcattacgcttcaaccgggttattctattccacctcttataacgaaaagaacttaaatcaaaatacttaatagcatggcgatacatttatacaaaacttctaccccgagcacacgcaaaggagccgtagacaggcaagtgaaatccaatccacgaaataatttgatctatggacagcatcgttgtggtaaaggtcgtaatgccagaggaatcattaccgcagggcatagagggggaggtcataagcgtctataccgtaaaatagattttcgacggaatgacaaagacatatatggtaaaatcgtaactatagaatacgaccctaatcgaaatgcatacatttgtctcatacactatgggggtggtgagaaaagatatattttacatcccagaggggctctaattggagataccattgtttctggtacagaagttcctataaaaatgggaaatgccctacctttgaaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatacccaaaaactgctcagcaacagtcggacaagtggggaatgttggggtgaaccagaaaagtttgggtagagccggatctaaacgttggctaggtaagcgtcctgtagtaagaggagtagttatgaaccctgtagaccatccccatgggggtggtgaagggagggccccaattggtagaaaaaaaccctcaaccccttggggttatcctgcacttggcagaagaagtagaaaaaggaataaatatagcgataatttgattcttcgtcgccgtagtaaataggagagaaaatagaatttgtttcttcgtctttataatataaaaaaaaataggagtaattaattgtggcacgttcactaaaaaaaaatccttttgtagccaatcatttattaagaaaaatgaatatgcttaacacaaaagcggaaaaagaaataatagtaacttggtcccgagcgtctaccattatacctacaatgatcgggcatactattgctgttcataatggaaaagaacatttgcccatttatataacagatcgtatggtaggccataaattgggagaatttgcacccactctaaatttccggggacatgcaaaaaatgataatagatctcgtcgttagttaatatttagttaataaataataataataaaatgaaatatagatgcttat

SEQ ID NO: 4482 - DNA, 8315 bp, Eutrema halophilum
tttcagttgtttgatctgcaaagaattctcgatgtgaaaacacagagacaaagggctgatctttgaataggaaaaagagtggatccgcggggtcccaaatgaattggcttattctaaaaaagccttggtctttagaagacctatctcgtctctggtactgcatggttccgctctgctccgaatcattctcttgaagctcatacttttcatcataaatgatccgcttgccccgaaatgacccggccaaatagggaaatccccattcattaggcctttcgatacaatcaaatagaaagccccgagggcgccatattctaggagcccaaactatgtgattgaataaatcctcctctatctgttgcgggtcgaggactccttctccttccccttcttcaaactccgattcgtatttttcatagagaaatctctgatcaacgatagaacaagatccatcttgcatcatatataagggatcccttggttcggagcgaaaaagcaatgtcactcgatcattatcaaactgactgcaatttctgtccgtgaggatcccaccaaagcgccttgcacttctaataggccatgaaatagatccgaatcattctcaatgaatccataataagaagtgatcctatttttttcatcgggtccgggtagagaccaaaggtcttgagcgaccagaacaactcaaaagataaagaagtatcgtgaatttcttcatgctcgttccaagttcgaagtaccatttgtacaaataagaatccccttcgttacatgatttcttcttcatatagatagatataggatctatggggcaattacttataagtacattttgtgcaacagcccttcctatctgatagaaaaggatcccatgatcctgaaccgatcttacctgggatcgcaaatcccaagtttgtcaatgaagagcagatctaattgtattagtgtctataattgatttcttctgtgtaatactaattgatagggcctcattggtaagtgctacaagatctcgtgcactggaccccatggttatggactcgaatccattagtatggaacattttcttttccaagtgaaatcccctagtataggaaagagtgaaaaagtgctttcgttgtggaataagaagccttcttattttaatgcatgtatttaatttattcggggctattagagcgggatccactttttggggaatatgagtcgaagcaataacaagaatatttctagtggaacatctttcacaatccctggagagagagttcaccaatagaccgagggctaagtaattcgactcattcacatcaagatcatgaatgtttggaatccatattatgcaaggagacattgcttttgctaattcgaattgaagggtgatataaaatcggtctatttccgacatcatatccatagttagcgcattcatcatagttagaagctccagctccgtatcaagttcacgatcaatatcgttactagcatcaatatcgttactagcatcaatatcgtcactatcatcaatatcgatatcatcaataaaaaaacctttcggcttgttatccaggaacttgttcagaaatactgtaatgaaaggaacataggagtttgtcgctaggtatttgaccaaataggatcggccggttcctatagaacctatcactaaaatactcctagagggggatagggctaagcggagcgaaaagggttttcgatgagacgggaaatgaaaactattagccccacacgaagtttgtgaataagtgattgtctgataatgagcaaggaatatccgtctttctgctaaacaggatgtattgaactcataattcattagatactttttatgaatgtcaactaagtatcgtaagtaaattgttcccggttgttcaatcatttgataaccagagtcattctttgataaatgatcactatgagtcagactcaatagaatttgatcaatccttttttctgcccttaaggtggagaactgaaccaagaattctctttctttatcatcaatcgaatcactgttcgcgacccagattctattttatcatcaatccaatcaccgctcacgttttttctttttcttatcaatgaatagatctctttacttgtatgacttagatgtctcgtatttctcgaaaaagtgattcgattgatgggatttggtatgatacttatgagatcgatgatatcgatgaaatttattttcaaatctttcttcttagaacgtattgatttgaccccataagcgggatcaccaccccatagcatgttgccgccagaaccccgtatttcttctagacaatctcctaattgttccagagcaactagaaaaagattctttaaccagaaagaattcagttcagatgtaggatacctatccagaagttttcgcaactcaatcatgtatgatggaatcatcaaagatttgatcttttcgaactctgtctgtaactcactataggctcgggaaacaaagagaagatgtgtacgaacgatatatccagcaacaagaagaaggaaaaggattgaatagaggacctcacgaacatttggcgatctcagatgtgtcgatatcaatgatgactcattatttcgatgaatcatttcttcggacagaagaagattatgtaaagacttactcgaaatctcacttatcagattcctttgtggaagacacaattttttctgaagaattcgccatgatatatctaatccatgcataatatcatgaaaaatggatacaaatttttgactgctacttagtatccgcaataggtctgaaaaagtatctaaaatatcaaatttagatatttgtaccctgtcgaagtaaagaaccatggcatatatgtttggaatagattccattttgagagagttgaaaaagcactatctcgttgaaaggttctatccatctgccctttgtcaacgcatttttttaggcaaagactccgttttttcctctgtaaatatttctcagaacatggagtgtaaatcaaacccatgtttgaattgaaattgagatactgatgcaagctcttctcttctgaatcggatagattcatatctgaagagtttgacaatacgttctttcaaaatggactctttgtccctctattagaggtgttccagaaatgtctgcaatcgagtaaatagctctacgaactaatggatcggatcgaattggaaaatggaaagatttgtacaagttatacttttcgtcaccactttgtggaaaatcattagatatgaatatgttagatacctgtgactcgattgacgaaggtgaaatagtatctctctccaaaaaagcatgtttttttttaccaccgcacgcagaaaatattttgttgtgaatgaacaagatagtgaggaattgtccatacgtaaaatcagaattattgagacgggccttttccacataaaaagggaatcttttgttacaatagaagcagaagtgatgtggattattcaagaatcgaagtcgatttgctttagaaaaagaagatatcaatgaacttctctgaaatggtttcacgggattcatccaattgtcttgatcgtgggatacgattgagaaataggaatccgtgttatcaaaagatttcctgcgattctttctagtatggaatgagtcaatcatccactttggtatcttattgaagaaaaatggtgatattgttcctccattgatcaagaatttcgatttttgagaagtattatgatcatccaataaaaagggtttcaattttttcaaatgaacgatttgaagacctattgattctaacaactgattgcagagttgatcgttcggacctttcaattcatagatgtggatctcagacctatgaatggggatattctcgaaactcacaaagaaaaaaggaagtgagttagacaaaagataagtaacttggacaaaaaaagaagtaacttggacaaaaagaaacgaatgacttagacaaatcttttttatcaataacctcagaccaatcaatcgaatattgattaatacataatcgatcgaacactacttgaaaacggctcttccgcgcagaaacgaaatgttccaaatgctcctggaaattcttgctcccatcggaccatttgtatctatatgcattaggatcccgatttatggatctctcggttcgcgaaagaaaaatcagaggatcgaaccatttcttctgactctttttcaaattcgataaatgttggttgatcgtatctttcattatagttctatgattcagagtatcatttcctattagatccctttgaattccatattcgaagttgcgatcaggtctctttattaaaaagaatcgattcaatacatttcttatgtacccatagggactatattggaattggatttgaatcagatttcggatcaatctatattgattgactgcctccattatgttgttgctagcaaataccactctttttggttttggatcttccaaataattcccgcaggagatccggacccaattttttctgatccttcgataaaagattcattttcttcataaaaaataggaggtagaaccaataaagatttctttttcgattcatccctgaagttgaaaacctccttcaagaattgtctttgatccaatccggaggaatcaatagaaaaggcaaatcccttatgatacaccagatccggctcggttattgatagagtgaatagatctgccatttcttgaaatctctcttctgactcaaaatcgtggcgtaacgtgtatccccccctcttccgttcatggaatagatgaaataaatcaaaaaatggatttttgttcaagaatgaaatcttattggaactgtccatatccagttcatccttcggaaccataccacatcccagatctgatgaaataggatgaattgagacggtattttgtaaatacgtaattatcttgaatatattaactatttctttattttccgatcgcctggaagggacaaaagaaacatcttgttctttcttcaacaatttctgatccctagtggacctctcagtaggattcgaacccagatgaagttctgaccatctgtcagagaaaaaagaacgaatggctcttgtaggattcccaagaaattcttcgctttcttccggaagcggatgattattcattcgcttctcacgttccgtgaatagccggggcattgaggaatatccagaaaggtatttagggaatcggtctgattctatctctcttccttccgtttgaataaaggaaggatcccaaagaatcgatctttcttttagttgttgaatctctctttgattgatcaatgtgtgatagtgatattccgaatcctcattactaatggaatcgaaaggatctatgaattgatcagaagatccgttcaattggctagaatccgttacttgaacgaaactagatcttgtagaatcatattgaatatttgacgatacatttcgtaccttgctaaaaaatctatccttgtttaccaaccacacattgtctaaccaaatccaattctctctcgatattttcctcaaaaaatccgattcgtgcggattcttcccccaactaacgaagagatcttggtggaattgccacatatgaaattgagcacaattttgcaaagaaatagcccacttgtttctcgagaagagatgggaaacatgctcaatatcatttgattgaatagttgacccagctccttgttgtttgaagaaaccctccacttcaattggtattttttcacgaaaagcaaacatgagataacaaatccagtctttcactaagatttcgaatagctgtcccgaattcaagttgattatgtttcgcctcttactcggagaaagacgatcaaacaattcccaatcatggcccttgcggatcggatcatccatataatatacaaaaagaaactccagatatttgatatctttctctttaaatgagatatcaattccagcgacggtttcattagatatcttacaacaaaaatccctcttttttccgatccagttcctccaccaccgcgaactccagttagattcaggcatgatacactttttagttattgggagaacccaagtactctctttcggatcccggaaacagctctcagagatcttttttccttttgtaagatacaggagcgaaacaatcaacctattgatattggaagacccaaaagattcttccgatgtatcatttctgggtccaatggaattcataggtataggaagaagccctttcaaatagagatttttgctttcgaccatatttcgattgttaatacgatatagaagggccgctactacaaatagtactacacccttgatcgtgaaatatcgattgcttgttgaaccctgtgaattgcgcaaaagtaggatactaaaaattcgagggtccaagagttttataaaacgttcttggtggaaaaaaatatgaatgaaagatcccactgaattgaattgggtccatgaatctaagaaatagtgagaattcttgatctctctcactatttctctcaattcgaaaatccaggatttgaattgatgtcctttcattgattcctcctaaattgcattgatttatcctaaagatttcatttcaattggaatttggttattcaccatgtacgaggatccccactaagcatccatggctgaatggttaaagcgcccaactcataattggcgaattcgtaggttcaattcctactggatgcacgccaatgggaccctccaataagtctattggaattggctctgtatcaatggaatcttctcatcatctatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatccaaaacttctaccccgagcacacgcaatggagccgtagacagtcaagtgaaatccaatccacgaaataatttgatctatgggcagcatcattgtggtaaaggtcgtaatgccagaggaatcattaccgtaaggcatagagggggaggtcataagcgtctataccgtaaaatagattttcgaagaaatgcaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaaatctacttcaaccgatatgcccttaggcacggccatacataatatagaaatcacacttggaaagggtggacaattagctagagcggcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgtggctaggtaaacgtcctgtagtaagaggagtagttatgaaccctgtcgaccatccccatggaggtggtgaagggagggctccaattggtagaaaaaaacccgtaaccccgtggggttatccggcacttggaagaagaactagaaaaaagaaaaaatatagtgagactttgattcttcgtcgccgtagtaaataggagagaaaatagaatttctttcttcgtcttaaaaaaaataggagttaattaactgtgacatgttcactaagaaaaatccttttgtagcaaagcatttattaaaaaaaatagagaagcttaatacaaaggcggaaaaagaaatcataataacttggtcccgggcatcacgggcgaacgacgggaattgaacccgcgatggtgaattcacaatggaagggaacacttacccgtttatataatagatcttatggtaggacataaattgggagaattttaac

SEQ ID NO: 4483 - DNA, 897 bp, Phaseolus coccineus
atcaaaatacttaatagcatggcgatacatttatacaaaacttctaccccaagcacacgcaatggagccgtagacagtcaagtaaaatccaatccacgaaatcatttgatctatggacagcatcgttgtggtaaaggccgtaatgccagaggaataattaccgcagggcatagagggggaggtcataagcgtctataccgtcaaattgattttcgacggaatgaaaaaaacatatatggtagaatcgtaaccatagaatatgaccctaatcgaaatgcatccatttgtctcatacactatggggatggtgagaaaaaatatattttacaccccagaggggctataattggagataccattgtttctggtacagaagttcctataaaaatgggaaatgccctacctttgaccgatatgcccttaggcacggccatacataacatagaaatcacactcggaaagggtggacaattagctagagcagctggtgctgtagcgaaactaattgcaaaagaggggaaatcggccacattaaaattaccttctggggaggtccgtttgatatccaaaaactgctcggcaacagttggacaagtgggaaatgttggggtaaaccagaaaaatttaggtagagccggatctaaatgttggctaggtaaacgtcctatagtaagaggagtagttatgaaccctgtagaccatccgcatgggggtggtgaagggagggccccaattggtagaaaaaaacccgcaactccttggggttttcctgcacttggaagaagaagtagaaaaaggaagaaatatagtgataatttgattcttcgtcgtcgtactaaatagtagagaaaatagaaattgtttcttcgtctttacaagaaaaaggagtaattaact

SEQ ID NO: 4484 - DNA, 855 bp, Arabidopsis lyrata
atcaaaatacttaatagcatggcgatacatttatacaaaacttctaccccgagcacacgcaatggagccgtagacagtcaagtgaaatccaatccacgaaataatttgatctatgggcagcatcattgtggtaaaggtcgtaatgccaaaggaataattaccgcaaggcataaagggggaggtcataagcgtctataccgtaaaatagattttcgacgaaatgcaaaagacatatatggtagaatcgtaaccatagaatacgaccctaatcgaaatgcatacatttgtctcatacactatggggatagtgagaagagatatattttacatcccagaggggctataattggagataccattgtttttggtacagaagttcctataaaaatgggaaatgccctacctttgaaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcaaaatgttggctaggtaaacgtcctgtagtaagaggagtagttatgaaccctgtcgaccatccccatggaggtggtgaagggagggctccaattggtagaaaaaaacccgtaaccccctggggttatcctgcacttggaagaagaactagaaaaaggaaaaaatatagtgagactttgattcttcgtcgccgtagtaaatag

SEQ ID NO: 4485 - DNA, 852 bp, Cannabis sativa
atggcgatacatttatacaaaacttctaccccgagcacacgcaaaggagccgtagacaggcaagtgaaatccaatccacgaaataatttgatctatggacagcatcgttgtggtaaaggtcgtaatgccagaggaatcattaccgcagggcatagagggggaggtcataagcgtctataccgtaaaatagattttcgacggaatgacaaagacatatatggtaaaatcgtaactatagaatacgaccctaatcgaaatgcatacatttgtctcatacactatgggggtggtgagaaaagatatattttacatcccagaggggctctaattggagataccattgtttctggtacagaagttcctataaaaatgggaaatgccctacctttgaaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatacccaaaaactgctcagcaacagtcggacaagtggggaatgttggggtgaaccagaaaagtttgggtagagccggatctaaacgttggctaggtaagcgtcctgtagtaagaggagtagttatgaaccctgtagaccatccccatgggggtggtgaagggagggccccaattggtagaaaaaaaccctcaaccccttggggttatcctgcacttggcagaagaagtagaaaaaggaataaatatagcgataatttgattcttcgtcgccgtagtaaataggagagaaaatagaat

SEQ ID NO: 4486 - DNA, 855 bp, Glycine max
catggcgatacatttatacaaaacttctaccccaagcacacgcaatggagccgtagacagtcaagtaaaatccaatccacgaaatcatttgatctatggacagcatcgttgtggtaaaggccgtaatgccagaggaatcattaccgcagggcatagagggggaggtcataagcgtctataccgtaaaattgattttcgacggaatgaaaaaaacatatatggtagaatcgtaaccatagaatatgaccctaatcgaaatgcatacatttgtctcatacactatggggatggtgagaaaaaatatattttacaccccagaggggctataattggagataccattgtttctggtacagaagttcctataaaaatgggaaatgccctacctttgaaatctacttcaaccgatatgcccttaggcacggcaatacataacatagaaatcacactcggaaagggtggacaattagctagagcagcaggtgctgtagcgaaactaattgcaaaagaggggaaatcggccacattaaaattaccttctggggaggtccgtttgatatccaaaaactgctcggcaacagtcggacaagtgggaaatgttggagtaaaccagaaaaatttaggtagagccggatctaaatgttggctaggtaagcgtcctgtagtaagaggagtagttatgaaccccgtagaccatccgcatgggggtggtgaagggagggccccaattggtagaaaaaaacccgcaactccttggggttttcctgcacttggaagaagaagtagaaaaaggaagaaatatagtgataatttgattcttcgtcgtcgtactaaatagtagagaaaatagaaatt

SEQ ID NO: 4487 - DNA, 4571 bp, Arabidopsis lyrata
atagagatttttgctttcgaccatatttcgattgttaatatgatatagaagggccgctactacaaatagtactacacccttgatcgtgaaatatcgattgcttgttgaaccctgtgaattgcgcaaaagtaggatactaaaaatttgagggtccaagagttttctaaaacgttcttggtggaaaaaaatatgaatgaaagatcccactgaattgaattgggtccatgaatctaagaaatagtgagaattcttgatctctctcactatttctctcaattcaaaaatccaggattttaattgatgtcctttcattgattcctcctaaattgcattgatttatcctaaagatttcatttcaattggaatttggttattcaccatgtacgaggatccccactaagcatccatgcatgaatggttaaagcgcctaactcataattggcgaattcgtaggttcaattcctactggatgcacgccaatgggaccctccaataagtctattggaattggctctgtatcaatggaatcttctcatcatctatacataacgaattggtgtggtatattcatatcataacatatgaacagtaagaactagcattcttattgagactagaactcatagggaagaaaatcgatttatggatggaatcaaatatgcagtatttacagacaaaagtattcggttattgggggaaaaatcaatatacttttaatgttgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccttagacggtcaagtgaaatccaatccacgaaataatttgatctatgggcagcatcattgtggtaaaggtcgtaatgccagaggaataattttccgcaaggcatagagggggaggtcataagcgtctataccgtaaaatagattttcgacgaaatgcaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaaatctacttcaaccgatatgcccttagacacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcaaaatgttggctaggtaaacgtcctgtagtaagaggagtagttatgaaccctgtcgaccatccccatggaggtggtgaagggagggctccaattggtagaaaaaaacccgtaaacccctggggttatcctgcacttggaagaagaactagaaaaggaaaaaatatagtgagactttgattcttcgtcgccgtagtaaataggagagaaaatagaatttctttcttcgtcttaaaaaaataggagttaattaactgtgacacgttcactaaaaaaaaacccttttgtagcaaagcatttattaagaaaaatagagaagcttaatacaaaggcggaaaaagaaatcataataacttggtcccgggcatccaccattatacccacaatgattggccatactatcgctattcataatggaagggaacacctacccgtttatataatagatcttatggtaggacataaattaggagaattttcacctactataaattttcgaggacatgcgaaaaatgataatagatctcgtcgttaattaaatgaattaaaaaaaatgaatatagattttttttgagtgagaggtaaacattatgataaagaagagaaagaagaaatcatatacttccgtatatgctttagggcaatatatatctatttctgcccataaagcacggagagttattgatcaaatacatggacgttcctacgaagaagcacttatgatattagaacttatgccttatcgaggatgttatcccatttttaaattggtttattctgccgcagcgaacgctagtcacaataagggtttcaaagaaaccaatttagtcattagtaaagctgaggtgaaccaaagaaatactgtgaaaaaattaaaacctcgtgcccgaggacgaagttacccaataaaacgatccacttgtcatataactatcgtattggaagatatatccttctatcaacaatatgaagaatatttaatgtatttagaaaaacctggatgcagcaatgaaaacagaaatctaacatgttatgatagatatagtagtggagacctatgggacaaaaaataaatccacttggtttcagacttggtacaacccaaagtcatcattctctttggtttgcacaaccaaaaaagtattcagaaggtttagaagaagataaaaaaatacgagactgtattaaaaattatgtccaaaaaaatataagaatatcctctggtatggagggaattgcacgtatcgaaattcaaaaaagaatcaatctcatccagatcataatctatatgggatttcctaaattattaattgaagataaaccccgaagagtcgaagaattacagataaatgttcaaaaagaacttaattgtgtcaatagaaaactcaacattgctattaccagaatttccaatccgtatggggatcctaatattcttgcagaatttatagctggacaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggtcttaggaataaaaatttggatattcgtagacgaagaataaaaaaaactttctttatctttacattttatccgatgataaaaaacgaactatgtagtataacactatacagtaataaaaaaagaaataaaaataaaaacttgtagtcttcttttttatgtttaagaaaaaaaataagcaattctataaggttgaataaacatttccatcaaaactcctttgatataattgctatgcttagtgtgtgactcgttggtttagggttagattacgataaaaaaaaaagaacttacctataagagcaactaataactacagcattaataaataacctaagcaactcattgcttcgcattatctggatccaaaaaattagtcaagatatgataggctgatcatatcattggagcaactgactaaaaaaaaaaaaagaataaagaaagatgattattaagttatgaaaggtaatcaaaaagtatgcggataaatggaaggatgaaagaaagagcgaaaaaattgaatattaatgatatatgattccaatttggaaaatctatgaggtcactgtaagaaaagcaatgtaataaagcatcaatacagattcattcataataattagataaatctgttccgaaaacaaaaaattaagagccttgagccaataaaaactgagaaaattgcctcaaaaaaaaaaatgaaattcaaaatttcatgtaaaagctccattgtagaattcaggcctaatgattaatcaagaagcgatgggaacgacggaacccatgaatatataggattctagtgaacaagaaatcttagtaattcattggacaggatggcggaataaaccagaaactttattatctattctgatttctgattttgattctgagacctcggggtataaacagcaaacttaaatagatattgaaagagtaaatattcgccggcgaaaaattggtttttttttttcaaataaaaaaagtaataaaagatgaaaaaaacaatgaaaaaaataaaataaggatttgttataatattctaactctaacaaaaattacatttgtaatgatgatattacgttatttttaaataaatcgaaataaaattgatctttgattctatttaaaaaaagacatacacaaatttagaagagataagatgaaataaaaaaaaataccatgattaataggattaatcattaactacatctatatcttaattaatccttttattcgcgaggagctggatgagaagaaactctcacgtccagttctgcagtagagatggaatttctcatttagaaaaaacccatcaactataac

SEQ ID NO: 4488 - DNA, 2192 bp, Phaseolus coccineus
ttctgaccatctgtcagagaaaaaagaacgagtggctctgtatcaatggaatctcatcatccatacataacgaattgatgtggtatattcaaatcataacatatgaacagtaaaaactagtattttaattgagactagaactcatagggaagaaaatatatttatgaatggaataaaatatgcagtatttacagacaaaagtattcggttattggggaaaaatcaatatacttttaatgtcgaatcgggatcaactaggacagaaataaagcattgggtcgaactcttctttgatgtcaaagtaatagctatgaatagtcatcgactcccggtaaagggtagaagagtacgacctattatgggacatacaatgcattacagacgtataatcattacgcttcaaccgggttattctattccacctcttagaaagaaaagaacttaaatcaaaatacttaatagcatggcgatacatttatacaaaacttctaccccaagcacacgcaatggagccgtagacagtcaagtaaaatccaatccacgaaatcatttgatctatggacagcatcgttgtggtaaaggccgtaatgccagaggaataattaccgcagggcatagagggggaggtcataagcgtctataccgtcaaattgattttcgacggaatgaaaaaaacatatatggtagaatcgtaaccatagaatatgaccctaatcgaaatgcatccatttgtctcatacactatggggatggtgagaaaaaatatattttacaccccagaggggctataattggagataccattgtttctggtacagaagttcctataaaaatgggaaatgccctacctttgaccgatatgcccttaggcacggccatacataacatagaaatcacactcggaaagggtggacaattagctagagcagctggtgctgtagcgaaactaattgcaaaagaggggaaatcggccacattaaaattaccttctggggaggtccgtttgatatccaaaaactgctcggcaacagttggacaagtgggaaatgttggggtaaaccagaaaaatttaggtagagccggatctaaatgttggctaggtaaacgtcctatagtaagaggagtagttatgaaccctgtagaccatccgcatgggggtggtgaagggagggccccaattggtagaaaaaaacccgcaactccttggggttttcctgcacttggaagaagaagtagaaaaaaaaagaaatatagtgataatttgattcttcgtcgtcgtactaaatagtagagaaaatagaaattgtttcttcgtctttacaagaaaaaggagtaattaactgtgacgcgttcactaaaaaaaatccttttgtagcgaatcatttattaagaaaaataaataagcttaacacaaaagcggaaaaagatataatattaacttggtccagagcatctaccattatacctacaatgattggccataccattgctatccataatggaaaagaacatttacctatttatataacagatcgtatggtaggccataaattaggagaattttcacctactctaaacttccgaggacatgcgaaaaatgataatagatctcgtcgttaacgttcattttcacatccattttgaaagaggaatgcataaatccataaatattacaaaattgaattattaggaaaatgaagttcaactcatttcttttagaattcatgaaattcatgaaataatgaataataataaaattcttttttcattcagaattcaatcaattcaataaaatattcaattgatttgtaaaaatagactcttatgataaagaagaacctctatacagaagaacctgtatacagaagaacctctatacagaagaacctctatacagaagccttgtcttttggtcaaataaaaaaaaggttcatgtctatttacaacacaaagtacaaatagtaattgatgtgatttgtacataaataaaacattatgatactagaactataatttctatttgctttagttgaatatcttcttttattcgattcgattttttgaattgtttatttgacaatagtcgatgctagtcacaatagaaatttcaacgaacttagtcaatgagctataatgagttataaagatatatctatagataaaaaagacacaaataaaaacattttatgtaa

SEQ ID NO: 4489 - DNA, 1481 bp, Trigonella foenum-graecum
tttacttgatctgtagtggacctcttagcttagtaggatttgaatcgagacgaagttctgaccatctgtcagagaaaaaagaccgattggctctgtctgtatcaatggaatctcatcatccatacataacgaattggtgtgatatattcaaatttaaatatatgaacagtaaaaaaaaactagtattcttattgagactagaactcatagggaagaaaatagatttatgaatggaataaaatatgcagtatttacagacaaaagtattcggttattgggaaaaaatcaatatacttttaatgtcgaatcaggatcaactaggacagaaataaaacattgggtcgaactcttctttggtgtcaaggtaatagctatgaatagtcatcgactcccaataaagggtagaagaatgcgatctattatgggacatacactgcattacaaacgtatgatcattacgcttcaaccgggttattctattccacctcttagaaagaaaagaacttaaataaaaatacacttaatagcatggcgatacatttatacaaaacttctatcccgagcacccgcaatggagccgtaggcagtcaagtgaaatccaattcacgaaatcgtttgatttatggacagcatcattgtggtaaaggccgtaatgccagaggaatcattaccgcagggcatagagggggaggtcataagcgtctataccgtaaaattgattttcgacggaatgaaaaagacatatatggtcgaatcgtaactatagaatacgaccctaatcgaaatgcacacatttgtctcatacactatggggatggtgagaaaagatatattttacaccccagaggggctataattggagataccattgtttatggtacagaagttcctataaaaatgggaaatgccctacctttgaccgatatgcccttaggcacggccatacataacatagaaataacacttggaaagggtggacaattagctcgagcagcaggtgctgtagcgaaactgattgcaaaagaggggaaatcggcaacattaaaattaccttctggagaggtccgtttgatatccaaaaactgctcagcaacagttggacaagtcgggaatgttggagtaaaccagaaaagtttgggcagagccggagctaaacgttggctaggtaagcgtcctgtagtaagaggagtagttatgaaccctgtagaccatccacatggtggtggtgaagggagggccccaattggtagaaaaaaaccctcaactccttggggttatccggcacttggaagaagaagtagaaaaaagaataaatatagtgataatttgattcttcgtcgccgtagtaaatagtgtagagtagagaaaatagaatttgtttcttcgtctttccaaaagaaaagattgatttactatgacattatatgatttgattttgtttttttagagattatataatataattttttaaaatataagag

SEQ ID NO: 4490 - DNA, 2163 bp, Plantago ovata
aaagcattgggtcgaactcttctttggtgtcaaggtaatagctatgaatagtcatcgacttccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcatcattgtggtaaaggtcgtaatgccagaggaatcattaccacaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctctaattggagataccattgtttctggtaccgaagttcctataaaagtgggaaatgccctacctttgaccgatatgcccttaggcaccgccatacataacatagaaatcacacttggaaagggtgggcaattagttagagcagcgggtgctgtagcgaaacttattgcaaaagaggggaaatcggccacattaaaattaccttctggggaggtccgtttgatatccaaaaactgctcagcaacagtcggacaagtggggaatgttggggcgaagcagaaaagtttgggtagagccggagccaaacgttggctaggtaagcgtcctgtagtaagaggagtcgttatgaaccctgtagaccatccccacggaggggggaggggagagcccccattggtagaaaaaacccacaactccttggggttatcctgcacttggaagaagaagtagaaaaaggaataaatatagtgataatttgattcttcgtcgccgtactaagtagaaataggcgaaaaatcgaattttttcgtctttacatttacaaaaaaaaaaaagaaaaataggagtcagctgtgatacgttcaatcaaaaaaaatccttttgtagccaaccatctattaagaaaaattgataaacttaataaaaaagcagaaaaagaaataatagtaacttggtcccgtgcatctaccattatacccacaatgatcggccacacaattgctattcataatggtaaagaacatttacctatttatataacagatcatatggtaggtcacaaattgggagaatttgtacctactttaaatttccgaggacatgaaaaaagcgatactagatctcgtcgttaatcttatcttaaaaaaatatggatagatattttagatttattagtaggagacaaaccttatgctaaagatggtaaagtcaagcaaggaaagacttttcgacccacaagtaataaaaaaaaaaaacagaagtatacgcattaggtcgtcatatatctctatctgctgacaaagcacgaagagtaattgatcagattcgcggacgttcttatgaggaaacacttatgatactagacctcatgccctatagagcatgttatcccatttttaaattagtttattctgcagcagcaaatgctagttacagcatgggttccagcgaagcgaatttaataattagtaaagctgaagttaacgaggggactacggcaaagaaattaaaacctcgagctcgaggacgtagttatcgaataaaaagaaccagctgtcatataactattttcgtaaaagataaatctttagatgaatatgaaatggtgtcaaagtatcctccggtaaaaaaatctagaaacaagattataattccggtatacgatccgacgtatgatgatgtggatattactggaggggtatgggaccctgaagggatatgggacgacactggaggggtatgggacaaaaaataaatccacttggtttcagacttgggacaacccaaagtcatcattccctttggtttgcacaaccaaaaaattattctgagggtctacaagaagaccaaaaatccgaaatttggtcaaaattatgtacaaaaaatatgccactatattccggaaccgagggaattgcacgcataga

SEQ ID NO: 4491 - DNA, 1006 bp, Eutrema halophilum
atggcgatacatttatccaaaacttctaccccgagcacacgcaatggagccgtagacagtcaagtgaaatccaatccacgaaataatttgatctatgggcagcatcattgtggtaaaggtcataatgccagaggaatcattaccgtaaggcatagagggggaggtcataagcgtctataccgtaaaatagattttcgaagaaatgcaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaaatctacttcaaccgatatgcccttaggcacggccatacataatatagaaatcacacttggaaagggtggacaattagctagagcggcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccatccccatggaggtggtgaagggagggctccaattggtagaaaaaaacccgtaaccccgtggggttatccggcacttggaagaagaactagaaaaaagaaaaaatatagtgagactttgattcttcttcgccgtagtaaataggagagaaaatagaatttctttcttcgtcttaaaaaaaataggagttaattaactgtgacatgttcactaaaaaaaaatccttttgtagcaaagcatttattaagaaaaatagagaagcttaatacaaaggcggaaaaagaaatcataataacttggtcccgggcatcac

SEQ ID NO: 4492 - DNA, 3959 bp, Lotus japonicus
aaaatcgatttatgaatggaatcaaatatgcagtatttacagacaaaagtattcggttattggggaaaaatcaatatacttctaatgtcgaatcgggatcaactaggacagaaataaagcattgggtcgaactcttctttggtgtcaaggtaaaagctatgaatagtcatcgactcccggcaaagggtagaaaagtgcgacttattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatcgagccgtagacagtcaagtgaaatccaatccacgaaatcgtttgatctatggactacattgttgtagtaaaggccgtaatgccagaggaatcattaccgcagggcataggggggggggtcataagcgtctataccgtaaaatcgattttcgacggaatgaaaaaaacatatatgggaaaatcgtaaccatagaatacgaccctaatcgaaatgcatacatttgtctcatacactatggggatggtgagaaaagatatattttacaccccagaggggctataattggagataccattgtttctggtacagaagttcctataaaaatgggaaatgccctacctttgaaatctacttcaaccgatatgcccttaggcacggccatacataacatagaaatcacattcggaaagggtggaaaattagctagagcagcaggtgctgtagcgaaactgattgcaaaagaggggaaatcggcaacattaaaattaccttctggggaggtccgtttgatatccaaaaactgctcagcaacagtcggacaagtaggaaatgttggggtaaaccagaaaagtttgggcagggccggatcgaaatgttggctaggtaagcgtcctgtagtaagaggagtggttatgaaccctgtagaccacccccatggggggggtgaagggagggcccccattggtagaaaaaaacccgtaactccttggggttatcctgcacttggaagaagaagtagaaaaaggaagaaatatagtgataatttgattcttcgtcgccgtactaaatagtagagtaaagaaaatagaatttgtttcttcgtctttacaaaaaaaaggagtaattaactgtgacacgttccctaacaaaaaatccttttgtagcgaatcgtttattaagaaaaataaataatcttaacacaaaatcagaaaaagaaataataataacttggtccagaacatctaccattatacccgcaatgattggccataccattgctattcacaatggaaaagagcatttaccgatttatgtaacggatcgtatggtaggccataaattgggagaattttctcctactctaaacttccggggacacgcaaaaaatgataatagatctcggcgttaacgttaaatttaatgtaattttagtaatagtaattaaaaacttactcaactcaacaataatttcattatttttaaatgaatataattttaactaaaaaaaaataataaattttgattcatttctttttttcgttaaaatacaaccctctaagacgtaagaactaatacactgaaggagaaccttattttttggtaaaaaaaagagatataaaagaaaaagtagtaaaatctatacgtaataaaaaaccgtatatatagataaagagaaaaaagtagaaaagtagcacgtatcattttatgtatagtagtggggaattatgggacaaaaaataaatccgcttggtttcagacttggtacaactcaaagtcatgattctatttggtttgcacaaccaacaaattattccgagaatttaaaagaagataaaaaaataagagattgtatcaagacttatatacaaaaaactataaaaatatcttcgggtgtcgagggaattggacggataaagattcaaaaaagaatcgatctgattcaagtcataatctatatgggatttccaaagttattaatagacggtaagcctcgaagaatcgaagaattacagataaatgtgcaaaaaaaaatgaattatgtgaatagaaaactcaacatagctattacaagaattgcaaatgcttatagagatcctaatattcttgcagaattcatagccggacaattaaaaaatagagtttcgtttcgtaaagcaatgaaaaaagctattgagttaactgaacaggcggggacaaaaggagttcaagtacaaattgcgggacgtatcgacggaaaagaaattgcacgcgtagaatggatccgagaaggtagggttcccctacaaaccattcgagctaaaattgattattgttcctatacagttcgaactatttatggcgtattagggatcaaagtttggatatttttaaacaaagaataaaaaacttttccttatctttaaagtaaagttctgtctttggataaaacaaaaaatgacaaattttataagattgaattgaataaaaaagttcaattaatcatttcatatcgatagaattgctatgcttagtccaaaaagaaccagattccgtaaacaacatagaggaagaatgaaaggaatatcccatcgaggtaatcaaatttgctttggaagatatgctcttcaggcacttgaaccagcttggataacatctagacaaatagaagcggggcggagggcaatgtcacgaaatgtgcgccgaggtggacaaatatggacggaaaaaaatgatatgattcaacctcaaacccatttaaatgtagccgataatagcggagcccgcaaattgatgtgtattcgaatcataggagctagtaatcgacgatacgcttatattggtgacattgttgttgctgtaatcaaagaagcagtaccgaatacacccttagaaagatcagaagtgatcagagctgtaattgtacgtacttgtaaagaactcaaacgtagcaatggtataataatacagtatgatgataatgctgcagttgtcattgatcaagaaggaaatccaaaaggaactcgaattttttgcgcaatcgcccgggaattgagacagttcaatttcactaaaatagtttcattagcgcctgagatattataaaacaagaccttgatatagatatattatgaaaaaaaaaaaaatagattcttttttagattatatatgacatatataccttttgtagtgtagtatatattagagatctatatagatggatatatttcagtatctatttcataattcataacctaaataaaaaaaacaagaataatagataaataataataatagacggaaatagaaacaaaaaatagaaaaaatgagcacgttgattatatcgcaagtaagggtcaagaatcattttcgtttatcatgggtaaggacaccatcgctgacataataacctctatacgcaatgctgacatgaatagaaaaagaactgttcaaataccatttactaacatcaccgaaaacactgtaaaaatacttttacgagagggttttattgaaaacgtgagaaaacatcgggaaagcgacaaatcttttttagttttaactctacgatatagaagaaatacgaaaggatcatataaaacttttttaaatttaaaacggatcagtacacccggtctacgaatctattataactatcaaaaaattcctagaattttaggaggtatggggattgtaattctttctacttcgaggggtataatgacagatcgagaggctcgattagaaaaaatcggcggagaagttttatgttatatatggtaatatttctgacatactaatcatataagaaacgtctacccccattttttggaaaaagggagaaaacacagattttgaatattattcctcatacaataaagaggttttaaccggaaaaaaaaaag

SEQ ID NO: 4493 - DNA, 1842 bp, Fagopyrum esculentum
tttaaatactataaatttactttaatatgcaattgttaaagttaaaaaaaattcaatttgatacttatactactatagtataatacaataagtataatacaatacgaaaacgtaattgtatgtatatctataatataatatgattatgatactccaattatgttatgatatttcactgaaaattgaatcactgaaaatgaaaatatgtcgaacatttctatattctatttcaatgaaaatgtcaacaatgaaaatatcaatgatatttgtataaaatgaaaattgtatttgtgttgatttatcctaaagatttcatttcaattggaatttggttattcaccatgtacgaggatccacgctaagcatccatggctgaatggttaaagcgcccaactcataattggcgaattcgtaggttcaattcctactggatgcacgccaatgggaccctccaataagtataagtctattggaattggctctgtatcaatgaaatctcatcctccatacataacgaattggtatattcatttcataacataggaacagtaagaactagcattcttattgagactagaactcatagggaataaaatagatagaatcacatatgcaatatttacagacaaaagtattcggttagttattggggaaaaatcaatatacttctaatgtcgaatcaggatcaactaggacagaaataaagcattgggtcgaactcttctttagtgtcaaggtaatagctatgaatagtcatcgactcccccgaaagggtagaagaatgggacctattatgggacatacaatgtattacagacgtatgatcattacgcttcaaccgggttattctattccacctcttagaaagaaaagaacttaaatcaaaatccttaatagcatggcgatacatttatacaaaacttctaccccgaacacaggcaatagggccgtagacagtcaagtgaaatccaatccacgaaataatttgatctatggacagcgtcgttgtggtaaaggtcgtaatgccagaggaatcattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagagggactctaattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaagggaaatcggccacattgaaattaccttctggggaggtccgtttgatatccaaaaactgctcagcaacagtcggacaagtggggaatgttggagtgaaccagaaaagtttgggtagagccggatctaagcgttggctaggtaaacgtcctgtagtaagaggagtcgttatgaaccctgtagaccatccccatgggggtggtgaagggagggccccaattggtagaaaaagcccaacaaataaatggggctttcctgcacttggaagaagaagtagaaaaaggaataaatatagtgataatttgattattcgtcgacgtagtaaataggagatcaatttgaattagtttcttcgtcttttaaaaaaataggagtaattaaccgtgacacgttcactaaaaaaaatcctttagttagcgaatcatttatttaagaaaacttagataag

SEQ ID NO: 4494 - DNA, 980 bp, Tabernaemontana elegans
aaccgtagacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaacccacaaccccttggggttatcctgcacttggaagaagaagtagaaaaaggaataaatatagtgataatttgattcttcgtcgccgtagtaaataggaaagaaaatcgaattttttcttcgtctttacaaaacaaaaagaaaaaaaaataggagtaagctgtgacacgttcactaaaaaaaataactttcgttagccaaccaatttatttactaaaaaattaagtataaacttaaactaacaaaagaaagaaaaagaaaataggcggacgacggaagtagtaaccgaccgcatggtgga

SEQ ID NO: 4495 - DNA, 1518 bp, Manihot esculenta
gatgtcctttcattgattcctcctaaattgcatggatttatcctaaagatttcatttcaattggaatttggttattcaccatgtacgaggatccccgctaagcatccatggctgaatggttaaagcgcccaactcataattggcgaattcgtaggttcaattcctactggatgcacgccaataggaccctccaataagtctattggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagccatcgactcccgggaaagggtagaagaatgagacctattatgggacatacaatgcattacagacgtatgatcattacgcttcaaccgggttattctattctatctcttagaaagaaaagaacttaaatcaaaatacttaatagcatggcaatacatttatacaaaacttctaccccgagcacacgcaatggagccgtagacagtcaagtgaaatccaatacacgaaatacataaaataatttgatctatggacaacatcgttgtggtaaaggccgtaacgccagaggaatcattaccgcaaggcatagagagggaggtcataagcgtctataccgtaaaatcgattttcgacggaatgaaaaagacatatatgggagaatcgtaaccatagaatacgaccctaatcgaaatgcatatatttgtctcatacactatggggatggtgagaagagatatattttacatcctagaggggctataattggagataccattatttatggtacaaaagttcctataaaaatgggaaatgccctacctttgaaatctacttcaaccgatatgcccttaggcacggccatacataacatagaaatcacatttggaaagggtggacaattagctagagctgcaggtgctgtagcaaaactgattgcaaaagaagagaaatcggccacattaaaattaccttctggggaggttcgtttaatatccaaaaactgctcagcaacagtcggacaagtagggaatactggggtgaaccagaaaagtttgggtagagccggatctaaatgttggctaggtaagcgtcctgtagtaagaggagtagttatgaaccctatagaccatccccatgggggtggtgaagggagggccccaattggtagaaaaaaatccgcaaccccttggggttatcctgcacttggaagaagaagtagaaaaaggaataaatatagtgataatttgattcttcgtcgccgtagtaaataggagaaaaaatagaatttgtttcttcgtctttt

SEQ ID NO: 4496 - DNA, 1518 bp, Ricinus communis
gatgtcctttcattgattcctcctaaattgcattgatttatcctaaagatttcatttcaattggaatttggttattcaccatgtacgaggatccccgctaagcatccatggccgaatggttaaagcgcccaactcataattggcgaattcgtaggttcaattcctactggatgcatgctaatgggaccctccaataagtctactggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatctacttttaatgtcgaatcaggatcaactaggacagaaataaagcattaggtcgaacttttctttggtgtcaaggtaatagctatgaatagccatcgactcccgggaaagggtagaagaatgagacctattatgggacatacaatgcattacagacgtatgatcattactcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatacacgaaatacataaaataatttgatctatggacaacatcgttgtggtaaaggccgtaacgccagaggaatcattaccgcaaggcatagagagggaggtcataagcgtctataccgtaaaatcgattttcgacggaatgaaaaagacatatatgggagaatcgtaaccatagaatacgaccctaatcgaaatgcatatatttgtctcatacactatggggatggtgagaagagatatattttacatcctagaggggctataattggagataccattatttatggtacaaaagttcctataaaaatgggaaatgccctacctttgaaatctacttcaaccgatatgcccttaggcacggccatacataacatagaaatcacatttggaaagggtggacaattagctagagctgcaggtgctgtagcaaaactgattgcaaaagaagagaaatcggccacattaaaattaccttctggggaggttcgtttaatatccaaaaactgctcagcaacagtcggacaagtagggaatactggggtgaaccagaaaagtttgggtagagccggatctaaatgttggctaggtaagcgtcctgtagtaagaggagtagttatgaaccctatagaccatccccatgggggtggtgaagggagggccccaattggtagaaaaaaatccgcaaccccttggggttatcctgcacttggaagaagaagtagaaaaaggaataaatatagtgataatttgattcttcgtcgccgtagtaaataggagaaaaaatagaatttgtttcttcgtctttt

SEQ ID NO: 4497 - DNA, 1196 bp, Ananas comosus
aacgttcaataagtctattggaattggctctgtatcaatggaatctcatcatccatacataacgaattggtatggtatattcataccataacatatgaacagtaagaactagaattcttatcgatactggaactcatagggaagaaaatggatttatggatggaatcaaatatgcagtatttacagaaaaaagtattcggttattggggaacaatcaatatacttctaatgtcgaatccggatcaactaggacagaaataaagcattgggtcgaactcttctttggtgtcaaggtaatagctatgaatagtcatcgactacccggaaagggtagaagaatgggacctattatgggacatacaatgcattacagacgtatgatcattacgcttcaaccgggttattctattccacctcttatagagaaaagaacttaaagcaaaatacttaataacacggcgatacatttgtacaaaacttctaccccgagaacacgcaatggagccgtagacagtcaagtgaaatccaatccacgaaataatttgatctatggacggcatcgttgtggtaaaggtcgtaatgccagaggaatcattaccgcaaggcatagagggggaggtcataagcgtctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgaccgatatgcccttaggcacggccatacataacatagaaatcacacgtggaaagggtggacaattagctagagcagcaggtgctgtagcgaaactgattgcaaaagagggtaaatcggccacattaagattaccatctggggaggtccgtttgatatccaaaaactgcttagcaacagtcggacaagtgggtaatgttggggtgaaccaaaaaagtttgggtagagccggatctaagtgttggctaggtaagcgtcctgtagtaagaggggtagttatgaaccctgtagaccatccccatgggggcggtgaagggagagccccaattgggagaaaaaaacccacaacccct

SEQ ID NO: 4498 - DNA, 823 bp, Pisum sativum
atggcgatacatttatccaaaacttctagcccgagcacacgcaatggagccgtaaacagtcaagtgaaatccaattcacgaaatcgtttgatttctggacagcatcattgtggtaaagggcgtaatccgagaggaatcattaccgcagggcatagagggggaggtcataagcgtctataccgtaaaattgattttagacgcaatgaaaaagacatatatggtagaatcataaccatagaatatgaccctaatcgaaatgcacacatttgtctcatacactatggggatggtgagaaaagatatattttacaccccaaaggctataattggagataccattgtttatggtacagaagttcctataaaaatgggaaatgccctacctttgaccgatatgccgttaggcacggccatacataacatagaaataacacttggaaagggtggacaattagctagagcagcgggtgctgtagcgaaactgattgcaaaagagggtaaatcagcaacattaaaattaccttctggagaggtccgtttgatatcaaaaaactgctcagcaacagtcggacaagtagggaatgttggggtaaaccagaaaagtttgggcagagtcggagctaaacgttggcgaggcgagcgtcctgtagtaagaggggtagttatgaaccctgtagaccatccacatgggggtggtgaagggagggcgccaattggtagaaaaaaaccctcaactccttggggttatcctgcacttggaagaagaactagaaaaagcaataaatatagtgataatttgattcttcgtcgccgtagtaaatag

SEQ ID NO: 4499 - DNA, 1307 bp, Jatropha curcas
ttacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatacacgaaataatttgatctatggacagcatcgttgtggtaaaggacgtaatgccagaggaatcattaccgcaaggcatagaggggggggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattatttctggtacagaagttcctataaaaatgggaaatgccctacctttgagtgaggttttgattgatcaaaaagaagaatctacttcaaccgatatgcccttaggcacggccatacataacatagaaatcacacttggaaagggtggacaattagctagagctgcaggtgctgtagcgaaactgattgcaaaagaggggaaatcggccacattaaaattaccttctggggaggttcgtttaatatccaaaaactgctcagcaacagtcggacaagtaggcaatactggggtgaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttgggggtatcctgcacttggaagaagaagtagaaaaaggaataaatatagtgataatttgattcttcgtcgccgtactaagtagtaaataggagaaaaaatagaatttttttcttcgtcttttcaaaaaaaagaaaaaaaaataggagaaattaactgtgacacgttcactaaaaaaaaacccttttgtagcaaatcatttattaaaaaaaataaataagcttaacacaaaagcagaaaaagaaataatagcaacgtggtcccgggcatctaccattatacccacaatgatcggccatactattgctatccataatggaaaggggcatttacctatttatataacggatcgcatggtgggccataaattgggagaattttcacctactttaaatttccgggaacatgccaaaaatgataataaatctcgtcgttaattcgtttatcttaattccta

SEQ ID NO: 4500 - DNA, 3312 bp, Brassica napus
caagtgaaatccaatccacgaaataatttgatctatgggcagcatcattgtggtaaaggtcgtaatgccagaggaatcattaccgtaaggcatagagggggaggtcataagcgtctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaacccgtaaccccctggggttatcctgcgcttggaagaagaactagaaaaaggaaaaaatatagtgagactttgattcttcgtcgccgtagtaaataggagagaaaatcgaatttctttcttcgtcttaaaaaaaataggagttaattaactgtgacacgttcactaaaaaaaaatccttttgtagcaaagcatttattaagaaaaatagagaagcttaatacaaaggcggaaaaagaaatcataataacttggtcccgggcatctactattatacccacaatgattggccatactatcgctatacataatggaagggaacacttacccgtttatataatcgaccttatggtaggacataaattgggagaattttcacctactataaattttagaggacacgcgaaaaatgataatagatctcgtcgttaattaaatgaattcaaaaaaatgaataatgaatataattttttttttagtgagaggtaaaccttatgataaagaagaaaaagaagaaatcatatacttccgtatatgctttagggcaatatatatctatgtctgcccacaaagcacggagagttattgatcagatccgtggacgttcctacgaagaagcacttatgatattagaacttatgccgtatcgaggatgttatcccatttttaaattagtttattctgcagcagcaaatgctagtcataataagggtttcaaagaaaccaatttagtcattagtaaagctgaagtgaatcaaggaaatacggtgaaaaaattaaaacctcgggcacgaggacggagttacccaataaaaagatccacttgtcatataactatcgtattggaagatatatccttatatcaacaatatgaagaatatttaatgtatttaaaaaaacctggatgcagcaatgaaaacataaatctaacatgttacgatacatatagtagtggaggcccatgggacaaaaaataaatccacttggtttcagacttggtacaacccaaagtcatcattctatttggtttgcacaaccaaaaaagtattctgaaggtttagaagaagataaaaaaatacgagactgtattaaaaattatgtccaaaaaaatataagaatatcctctggtatggagggaattgcacgtatcgaaattcaaaaaagaatcgatctcattcagatcataatctatatgggatttcctaaattattaattgaagataaaccccgaagaatcgaagaattacagatgaatgttcaaaaagaacttaattgtgtcaatagaaaactcaacattgctattacccgaatttccaatccgtatgggcatcctaatattcttgcagaatttatagctggccaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggttttaggaataaaaatttggatattcgtagacgaagaataaaaaaactttatttgtctttacattttatccaatgataaaaaacgaaaactatgtagtataacactataaagaaataaaaataaaaacttgtagtcttcttttttatgtttaagaaaaaaaaataagcaattctataaggttgaataaacatttccatcaaaactcctttgatataattgctatgcttagtgtgtgactcgttggtttagggttagattacgataaaaaaaaaaaagaacttaccaactaataactacagcattaataaataacctaagcaactcattgcttcgcattatctggatccaaaaaattagtcaagatatgataggctgatcatatcattggagcaactgactaaaaaaaaagaataaagaaagatgattattaagttatgaaaggtaatcaaaaagtatgcggataaatggaaggatgaaagaaagagcgaaaaaattgaatattaatgatatatgattccaatttggaaaatctatgaggtcactgtaagaaaagcaatgtaataaagcatcaatacagattcattcataataattagataaataataataattagataaatctgttccgaaaacaaaaaattaagagccttgagacaatcaaaactgagaaaattgcctctaaaaaaaaagagattcaaaatttcatgtaaaagctccattgtagaattcaggcctaatgattaatcaagaagcgatgggaacgacggaacccatgaatatataggattctagtgaacaagaaatcttagtaattcattggacaggatggcggaataaaccagaaactttattatctattctgattttgattctgagacctcgggggataaacagcaaacttaaatagatattgaaagagtaaatattcgccggcgaaaaatttgggttttttttttttactaattaaaacagtaataaagatgaaaaacaatagaaaaaataaggattagttatatattctatctataaatacattctatgtatgatattacgttattttaattaatag

SEQ ID NO: 4501 - DNA, 2663 bp, Tripterygium wilfordii
gcacacgcaatggagccgtagacagtcaagtgaaatccaatacacgaaataatttgatctatggacagcatcgttgtggtaaaggtcgtaatgccagaggaatcattaccgcagggcatagagggggaggtcataagcgtctataccgtcaaatcgattttcgacggaaggaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtagggaatgttggagtgaaccagaaaagtttgggtaaagccggatctaaatgttggctgggtaagcgtcctatagtaagaggagtagttatgaaccctgtagaccatccccatgggggtggtgaagggagggccccaattggtagaaaaaacccgtacccctggggttatcctgcacttggaagaagaagtagaaaaaggaataaatatagcgataatttgattcttcgtcgccgtagtaaataggagagaaaatagaatttgtttcttcatctttacaaaaaaaaaataggagtaattaactgtggcacgttcactaaaaaaaaataccttttgtagcgaatcatttattaggaaaaataaataagcttaacacaaaggcggaaaaagaaataatagtaacttggtcccgggcatccaccattatacccacaatgatcggacataccattgctatccacaatggaaaggaacatttgcctctttatataacagatcggatggtaggacataaattgggagaatttgcacctactctcaatttccggggacatgcaaaaaatgataatagatctcgtcgttaataaaaaagaatcaaaaaaaaagaaatgggcgaacgataactaataaatagttcattaaaaagaggtggactttatgataaaaaaaaatatatatatacaccatatacaaaagtatacgcaataggtcagcatatgtctatgtctgctcacaaagcgaaaatagtaattgatcagattcgcggacatttttacgaggaaacacttaggatactcgaactcatgccttttgaaatatgttatcccgtttttaaattggtttattctgcagcagcaaatgcaagtcacaatattgagtccaacaaatcaaacttaatcattagcaaagctgaagtcaacgagggcggaactctagaaaaaaatttaacctcgagctcgaggacgaagttatccgaataaaacgacgcacttgtcatataactattgtattgaaagatatatctttaaatgaatatgaagaatataaaaactataacgatatatgaagactatagaaaaaaaaaaatagaatatagcatatacttaccaaaaccggactggataaagaactaataaagaaaaaatataggatgtgtcgtgatatgtatattagtgggggattatgggacaaaaaataaatccacttggtttcagacttggcacaacccagggtcatcattctctttggtttgtacaaccaacaaattattccgaaagtctgcaagaagatcgcaaaatacgaaactttatcaaaaactatgtacaacaaaacataaaaatatcttccggtgttgagggaattgcacgtatagagattcaaaaaagaattgatctgattcaagtcctaatatatataggattcccgaagttattaatggagagtaggactcgaagaatcgaagaattacagaggaagttacaaaaagaattaaattgtatgaaccgaaaactcaacattgctattacaaggattgcaaatccttatggacatcctactattcttgcagaatttctagccggacaattaaaaaaccgagtttcatgtcgtaaagcaatgaaaaaagctattgaattagctgaacagacgaatacaaaaggaattcaagtacaaattgcagggcgtatcaacggaaaagaaattgcacgtgttgactggatcagagaaggtagagttcctctacaaacaattcgagctaaaatcgattattgttcctatactgttcaaactctttatggggtattgggaatcaaaatttggatatttggagacgaggaataataaacctttacttgacttgttttgatttttatgttgtaacccagaacagaaaataacaaactttttaagtcgttttataaaaaatgagcaattcgagattccattctcaattcgaaattctattctatagggttgaataaaaatgcgattgaaaatttcatcttatttcatcttgatataattgccatgcttagtgtgtgactcgttgatttttttagtttttaggttctaaataaaagaggtaccggcccatataaataataatattagatccataagtaa

SEQ ID NO: 4502 - DNA, 855 bp, Medicago truncatula
cttcaaccgggttattctattctacctcttagaaaagaacttaaataaaaatacacttaatagcatggcgatacatttatacaaaacttctatcccgagcacccgcacacgaaatcgtttgatttatggacagcatcattgtggtaaaggccgtaatgccagaggaatcattaccgcagggcatagagggggaggtcataagcgtctataccgtaaaattgattttcgacgtaatgaaaaagacatatatggtcgaatcgtaactatcgaatacgaccctaatagaaatgcacacatttgtctcatacactatggggatggtgagaaaagatatattttacaccccagaggggctataattggagataccattgtttatggtacagaagttcctataaaaatgggaaatgccctacttcaaccgatatgcccttaggcacggccatacataacatagaaataacacttggaaagggtggacaattagctagagcggctggtgctgtagcgaaactgattgcaaaagaggggaaatcggcaacattaaaattaccttctggagaggtccgtttgatatcaaaaaactgctcagcaacagtaggacaagtagggaatgttggagtaaaccaaaaaagtttgggcagagccggagctaaacgttggttaggtaagcgtcctgtagtaagaggagtagttatgaaccctgtagaccatccacatggtggtggtgaagggagggccccgattggtagaaaaaaaccctcaactccttggggttatcctgcacttggaagaagaagtagaaaaaaaaataaatatagtgataatttgattcttcgtcgccgtagtaaatag

SEQ ID NO: 4503 - DNA, 1293 bp, Ricinus communis
ctagcattcttattgagactagaactcatagggaagaaaatagatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagccatcgactcccgggaaagggtagaagaatgagacctattatgggacatacaatgcattacagacgtatgatcattactcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatacacgaaatacacgaaataatttgatctatggacagcatcgttgtggtaaaggccgtaacgccagaggaatcattaccgcaaggcatagagggggaggtcataagcgtctataccgtaaaatcgattttcgacggaatgaaaaagacatatatgggagaatcgtaaccatagaatacgaccctaatcgaaatgcatacatttgtctcatacactatggggatggtgagaagagatatattttacatcccagaggggctataattggagataccattatttctggtacagaagttcctataaaaatgggaaatgccctacctttgagtgcggttttgattgatcaaaaagaagaatctacttcaaccgatatgcccttaggcacggccatacataacatagaaatcacatttggaaagggtggacaattagctagagctgcaggtgctgtagcgaaactgattgcaaaagaggggaaatcggccacattaaaattaccttctggggaggttcgtttaatatccaaaaactgctcagcaacagtcggacaagtagggaatactggggtgaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggagaaaaaatagaatttgtttcttcgtcttttcaaaataaataaaaaaaaaaaaaaaataggagaaattcact

SEQ ID NO: 4504 - DNA, 952 bp, Leymus cinereus x Leymus triticoides
cagaaataaagcattgggtcgaactcttctttggtgttaaggtggtagctgtgaatagccatcgactacctggaaaaggtagaagaataggacctattctgggccatacaatgcattacagacgtatgatcattacccttcaaccgggttattctattccacttctagatagagaaaaaaactaaaggagaatacttaataatatggcgaaacatttatacaaaacacctatcccgagcacacgcaagggaaccgtagacaggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatgcataacataggaatcacacgtggaaggggtgggcaattagctagagcagcacgtgctgtagcgaaactcattgcaaaagagggtaaatcggccactttaagattaccatctggggaggtccgtttagtatcccaaaactgcttagcaacagtcggacaagtgggtaatgttggggtgaaccaaaaagtttgggtagagccggatctaagtgttggctaggtaacgcccgtagtaagagggtagttatgaaccctgtggacaccccatgggggcggtgaggaaagctccattgtagaaaaaaccacaacccttggttatctgcgcttgttaag

SEQ ID NO: 4505 - DNA, 834 bp, Lotus japonicus
catggcgatacatttatacaaaacttctacgggcacacgcaatcgagccgtagacagtcaagtgaaatccaatccacgaaatcgtttgatctatggactacatcgttgtagtaaaggccgtaatgccagaggaatcattaccgcagggcatgggggggggggtcataagcgtctataccgtaaaatcgattttcgacggaataaaaaaacatatatgggaaaatcgtaaccatagaatacgaccctaatcgaaatgcatacatttgtctcatacactatggggatggtgagaaaagatatattttacaccccagaggggctataattggagataccattgtttctggtacagaagttcctattaaaatggggaatgccctacctttgaaatctacttcaactgatatgcccttaggcacggccatacataacatagaaatcacattcagaaagggtggaaaattagctagagcagcaggtgctgtagcgaaactgattgcaaaagaggggaaatcggcaacattaaaattaccttatggggaggtccgtttgatatccaaaaactgctcagcaagagtcggacaagtaggaaatgttggggtaaaccataaaagtttgggcagagccagatcgaaatgttggctatgtaagcgtcctgtagtaagaggagtagttatgaaccctgtagaccacccccatggggtggtgaagggagggcccccattggtagaaaaaaacccgtaactccttggggttatcctgcacttggaagaagaagtagaaaaaggaagaaatatagtgataatttgattcttcgtcgccgtactaaatagt

SEQ ID NO: 4506 - DNA, 1080 bp, Liriodendron tulipifera
ctagaattcttatcgatactggaactcatagggaagaaaatggatggaatcaaatatgaagtctttacagaaaaaagtattcggttattggagaacaatcaatatacttttaatgtcgaatcaggattaactaggacagaaataaagcattgggtcgaactcttctttggtgtcaaggtaatagctatgaatagtcatcgactcccgggaaagggtataagaatgggacctattatgggacatacaatgcattacagacgtatgatcattacgcttcaaccgggttattctattctaactcttatacagaaaagaacttaaatcaaaatacttaataacatggcgatacatttatacaaaacttctaccccgagcacacgcaatggagccgtagacagtcaagtgaaatccaatccacgaaataatttgatccatggacagcatcattgtggtaaaggtcgtaatgccagaggaatcattaccgcagggcatagggggggaggtcataagcgtctataccgtaaaatcgattttcgacggaatgaaaaagacacatctggtagaatcgtaaccatagaatacgaccctaatcgaaatgcatacatttgtctcatacactatggggatggtgagaagagatatattttacaccccagaggggctataattggagataccattgtttctggtacagaagttcctatatcaatgggaaatgccctacctttgaccgatatgcccttaggcacggccatacataacatagaaatcacacttggaaagggtggacaattagctagagcagcaggtgctgtagcgaaactgattgcaaaagagggtaaatcggccacattaagattaccatctggggaggtccgtttgatatccaaaaactgctcagcaacagtcggacaagtgggtaatgttggggtgaaccagaaaagtttgggtagagccggatctaagtgttggctaggtaagcgtcctgtagtaagaggagtagttatgaaccctgtagaccatccccatgggggtggtgaagggagggccccgattggtagaaaaaaacccacaacccct

SEQ ID NO: 4507 - DNA, 1164 bp, Manihot esculenta
catggcgatacatttatacaaaacttctaccccgagcacacgcaatggagccgtagacagtcaagtgaaatccaatacacgaaataatttgatctatggacagcatcgttgtggtaaaggccgtaacgccataggaatcattaccgcaaggcatagagggggaggtcataagcgtctataccgtaaaatcgattttcgacgaaatgaaaaagacatatatgggagaatcgtaactatagaatacgaccctaattgaaatgcatacatttgtcttatacactatggggatggtgagaagagatatattttacatcccagaggggctataattggagataccattatttctggtacagaagttcctataaaaatgggaaatgccctacctttgagtgcgaataatctacttcaaccaatatgcccttaggcacggccatacataacatagaaatcacatttggaaagggtggacaattagctagagctgcaggtgctgtagcgaaactgattgcaaaagaggagaaatcggccacattaaaattatcttctggggagcttcatttaatatccaaaaactgctcagcaacagtcggacaagtagggaatactggggtgaaccagaaaagtttgggtagagccggatctaaatattggctaggtaagcgttctgtagtaagaggagtagttatgaaccctgtagaccatccccatgggggtggtgaagggagggccccaattggtagaaaaaaacccgcaaccttggggttatcctgcacttggaagacgaagtagaaaaaggaataaatatagtgataatttgattcttcgccgtttacaaaaaaaaagaaaaaaataggagttaattaactgtgacacgttcactaaaaaaaatccttttgtagcgaatcatttattaagaaaaataaataaacttaacacaaaagcagaaaaggaaataataataacttggtctcgagcgtctaccattatacctacaatgatcgggcatactattgctatccataacggaaaggagcatttgcctatttatataacagatcgtatggtaggacataaattgggagaattttcaccgactctaaatttccgggggcatgcgaaaaatgataatagatctcggcgttaataatttattaattctaa

SEQ ID NO: 4508 - DNA, 1194 bp, Glycine max
taaaaactagtattttaattgagactagaactcatagggaagaaaatagatttatgaatggaataaaatatgcagtatttacagacaaaagtattcggttattggggaaaaatcaatatacttttaatgtcgaatcgggatcaactaggacagaaatcaagcattgggtcgaactcttctttgatgtcaaagtaatagctatgaatagtcatcgactcccggtaaagggtagaagagtacgacctattatgggacatacaatgcattacagacgtatgattattacgcttcaaccgggttattctattccacctcttagaaagaaaaaaacttaaatcaaaatacttaatagcatggcgatacatttatacaaaacttctaccccaagcacacgcaatggagccgtagacagtcaagtaaaatccaatccacgaaatcatttgatctatggacagcatcgttgtggtaaaggccgtaatgccagaggaatcattaccgcagggcatagagggggaggtcataagcgtctataccgtaaaattgattttcgacggaatgaaaaaaacatatatggtagaatcgtaaccatagaatatgaccctaatcgaaatgcatacatttgtctcatacactatggggatggtgagaaaaaatatattttacaccccagaggggctataattggagataccattgtttctggtacagaagttcctataaaaatgggaaatgccctacctttgaccgatatgcccttaggcacggcaatacataacatagaaatcacactcggaaagggtggacaattagctagagcagcaggtgctgtagcgaaactaattgcaaaagaggggaaatcggccacattaaaattaccttctggggaggtccgtttgatatccaaaaactgctcggcaacagtcggacaagtgggaaatgttggagtaaaccagaaaaatttaggtagagccggatctaaatgttggctaggtaagcgtcctgtagtaagaggagtagttatgaaccccgtagaccatccgcatgggggtggtgaagggagggccccaattggtagaaaaaaacccgcaactccttggggtttcctgcacttggaagaagaagtagaaaaaggaagaaatatagtgataatttgattcttcgtcgtcgtactaaatagtagagaaaatagaaatt

SEQ ID NO: 4509 - DNA, 1593 bp, Ricinus communis
tctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcgattattggggaaaaatcaatatacttttaatgtcgaatcaggatcaactaggacaaaaataaagcattgggtcgaactcttctttggtgtcaaggtaatagctatgaatagccatcgactcccgggaaagggtagaagaataagacctattatgggacatataatgcattacagacgtatgatcattactcttcaaccgggttattctattccacttcttagaaagaaaataacttaaatcaaaatacttaatagcatggcgatacatttatacaaaacttctaccccgagcacacgcaatggagccgtagacagtcaagtgaaatccaatacacgaaataatttgatctatggacagcatcgttgtggtaaaggccgtaacgccataggaatcattaccgcaaggcatagagggggaggtcataagcgtctataccgtaaaatcgattttcgacgaaatgaaaaagacatatatgggagaatcgtaactatagaatacgaccctaattgaaatgcatacatttgtcttatacactatggggatggtgagaagagatatattttacatcccagaggggctataattggagataccattatttctggtacagaagttcctataaaaatgggaaatgccctacctttgagtgcgaataatctacttcaaccaatatgcccttaggcacggccatacataacatagaaatcacatttggaaagggtggacaattagctagagctgcaggtgctgtagcgaaactgattgcaaaagaggagaaatcggccacattaaaattatcttctggggagcttcatttaatatccaaaaactgctcagcaacagtcggacaagtagggaatactggggtgaaccagaaaagtttgggtagagccggatctaaatattggctaggtaagcgttctgtattaagaggagtagttatgaaccctgtagaccatccccatgggggtggtgaagggagggccccaattggtagaaaaaaacccgcaaccttggggttatcttgcacttggaagaagaagtagaaaaaggaataaatatagtgataatttgattcttcgtcttttcaaaataaataaaaaaaataggagaaattcactgtgacacgttcattaaaacaaatccttttgtagcaaatcatttattaaaaaaaaataaataagcttaacacaaaagtagaaaaagaaataatagtaacgtggtctcgggcatctaccattatacccacaatgatcggccatactattgctatacataatggaaatgagcatttacctatttatataacagatcgtatggtgagccacaaattgggagaatttgcacctactcgaaatttccggggacatgcaaaaaatgataataaatctcgtcgttaattcgttaattttaattcctaa

SEQ ID NO: 4510 - DNA, 1604 bp, Cucumis melo
gaactggcattcttatacagactcgaactcatagggaagaaaatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtaaaatccaatccacgaaataatttgatctatggacagcatcgttgtggtaaaggtcgtaatgccagaggaatcattaccgcagggcatagagggggaggtcataagcgtctataccgtaaaatagattttcgacggaatgaaaaagacatatatggtagaatcgtaaccatagaatacgaccctaatcgaaatgcatacatttgtctcatacactatggggatggtgagaaaagatatattttacatcccagaggggctataattggagataccattgtttctggtacagaagttcctataaaaatgggaaatgccctacctttgaccgatatgcccttaggcacggccatacataacatagaaatcacacttgggaaggggggacaattagctagagcagcaggtgctgtagcgaaactgattgcaaaagaggggaaatcggccacattaaaattaccttctggggaggtccgtttgatatccaaaaattgctcagcaacagtcggacaagtggggaatgctggggtaaaccagaaaagtttgggtagagccggatctaaatgttggctaggtaagcgtcctgtagtaagaggagtagttatgaaccctgtagaccatccccatgggggtggtgaagggagggccccaattggtagaaaaaaaccccgcaaccccttggggttatcctgcacttggaagaagaagtagaaaaaggaataaatatagtgataatttgattcttcgtcgccgtagtaaataagagagaaaatctaatttgtttcttcgtctttacaaaaaaaaaataggaggtaaattcactgtggcgcgctcattaaaaaaaaatccttttgtgggaaaccatttattaaaaaaataaatacgcttaacacaaagggagaaaaagaaataatagtaacttggtcccgagcatctaccattatacccacaatgattgggcatactattgctattcataatggaaaggaccatttgcctgtttatataacggatcgtatggtaggtcataaattgggagaattcgcacccactcgcaatttccgggggcatgtgaaaaatgataatagacctcgtcgttaataattaatattatgaaaaaaaaagtgaatagtgaatatagatacctatcgttcattactaagaggtaaaccttatgataaaaaaaaaaaaaaaa

SEQ ID NO: 4511 - DNA, 1267 bp, Brachypodium distachyon
atacttaataatacggcgaaacatttatataaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaatgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcttataacaatgggaaatgccctacctttgagtgcgagaaaagaagaatctacttcaaccgatatgcccttaggcacggccatgcataacatagaaatcacacgtggaaggggtggccaattagctagagcagcaggtgctgtagcgaaacttattgcaaaagagggtaaatcagccactttaagattaccatttggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaacccccatgggggcggtgaagggaaagcccccattggtagaaaaaaacccacaaccccttggggttatcctgcgcttggaagaagaactaggaaaaggaaacgtagggctttgaaaccaaatacgttacctacaatggaagtaaacatgttagtaacggaaccctcttcaaatagatctaatggataagctacataacagatccattgactgtcttccccaggaacaggctcgatgtcatagcatcgtcctttgtaacaatcaagactagtaagtccatcagtccaaacagttgtccatgtaccaatagaagattcggcagctactgcagcccctacttcttcgggcggaaccccaggttgaggagatactcggaatgctaccaagatatcagtatccttggtttcatactccggggtgtagtaagtcaatctataatctttaacaccagctttaaatccaacacttgctttagtttctgtttgtggtgacataagtccctccttacaactcttgaattaagaattctcacaataacaagttctactcgatgtgaatt

SEQ ID NO: 4512 - DNA, 1442 bp, Panicum virgatum
gcgcgctgacgctaaccctgtctgcagacggagcggcggttcagtgaccaccgccgtgcagcaagggaacacccgagttcacccggcggttaggtgcaaggataggcatgcttgaacaatacatcggcggatcgattgagctgtattttagtcttctggttgtggattgaagtagaggtgaagaagtttgacagttggtatcttttcaagaatacattgaagtgcaagatgccaaaaataaagaatctctccaatgcgtgtaaagtatcattttctccagacgggcctatatctgaagaggcacttgagagagtccgtgcactgttagatgagataaggcctttagatgttggcctagataatgaagcacaaattgcacgcaattggaatagttctacacgtccatccaatgggagacggggacgtaatggggctaaccagttcactgctccaatcaaatatttgcacattcacgaatgtgaaagtttctctatgggtatattttgtatgccaccttcttcagttattccacttcataatcatcctggaatgactgtacttagcaagcttctttatggaagactacatgctgaatcctatgattggattaacgtacctgatcatccaagtgatcaattacaagcaagaccagcaaagcttgtcagggattgtgaaatgactgcaccagagacgaccattctttaccctaatagaggtggtaacatccacactttcagagccatcacaccttgtgctctcttcgacgtcctttctccaccatactctgctgaggacggacggcattgttcttacttccgaaagtctctagtgaatcaacaacctgttgttttgcctactgagatagatagctcacaagtagtctggttggaggagttggaggaccatcagcccccagaaggctttgtggtcgcgagaggtctgtataaaggccctgtaataaggagatgatttggttggagcatcgtatccagcgaactatgaatcacctgaaagaggatgcaggcttctagtatccattgcatgtgagttctagtatggcaagcaccaaatggtcattgtgcagtccatggtttactttgtacatgacaaagtgatctgtgataatttaacagcaactttacagaacaagaatggatgtttatgatttgatcagaactttaattatgtgccgcaccgctgtagtatctctgacctagatatggagctgttatcagatcaagaccgtggcgtacatacttttgagcttagtctagcatatcagttgtcatgctgtactaaaggatatccatggaacatgctttttcacttgatggcgtgggggccccattttgtctcccggcgtgtaatagcattattagtagtttctgggatcttgtctatacagtttggaaaaaaaaaaagtcgcatggctgtcctttatc

SEQ ID NO: 4513 - DNA, 2000 bp, Setaria italica
ccagcaaaagcccctgccctacctgacctcccccgacgcgcgagcgccccccctccatggcgaggcggcgcagctgctgatgcctcgcggcgtcggatcgggcgcggcggccacgaaccctagcggcgtgcggaggcgctcgccgatcccccgacgccccaatccgccggcgcggctcctcggatcctccccgcgagattcgggcctcgccccgtctcgtgctgccgaggtgaggttctggccttctgggtgcggtgagggggatctgcacccgtttgtgtgtcttcccaactgcccagcccaccatactccagcagcgactcagtcgactgcccaagtgccgaccccccaaggtagcgtgcgtgcgtcgcctcggtaccgtgcgtgcgtgcgctgtgacgctaaccctatctaggagacggagcggcgggcgagtgaccaccgccggtaaggcggtaaaggaaagaggatagcggcctgcaacaagagaacaccctactcagccggcttctaggtgcaaggataggcaacctgtgctccaacaatctgttgatcagtctttcggttgcggaataaagtagagctttaagaagtttgataattggtatcttttcaagaatacattgaagtgcaagatgccaaaaataaagaatctctcgaatgcgtgtaaagtatcattctctccagacggacccatatctgaagaggcacttgagagagtccgtgcactgttagaggagataaggcctttagatgttggcctagataatgaagcacaaattgcacgcaattggaatagttcaacacgctcatcaaatgggagacgaggacgtaatggggctaaccagttcgccactccaatcaaatatttgcacattcatgaatgtgaaagtttctctatgggtatattttgtatgccaccttcttcagttattccacttcataatcatcctggaatgactgtacttagcaagcttctttatggaagattgcatgctgaatcttatgattggattgatgtacctgatcatccaattgatcaattacaagcaagaccagcaaagcttgtcagagatcgtgaaatgactgcaccagagacgagcattctttaccctaatagagggggtaacatccatactttcagagccatcacaccttgtgctctcttcgatgtcctttctccaccatactctgctgaggacgggcggcattgttcttacttccggaagtctctagtgaatcaaccacctgttgttttgcctgctgagatagatagctcacaagttgtctggttggaggagttggaggaccatcagccccccgatggctttgttgttgcgagaggtctgtacaaaggccctgtaataaggatataatttggttggagcatggtatccagcgaactacggatcagctgaaagaggatgcaggcttgtagcatctatttcatctagtatcgcaaacatcaatggtcactgtgcagtccatggtttactttgtacatgttaaagtgatctatgataatttaacagcaactttacagaacaagaatggaagtttatggtttgaccaccactttaattatgtgtcgtgctgctggagtatctctgacctagctatggagctgttatcagatcaagaccttggcgtacatacttttgagcttagtctagcataacaactgtcatgctcttctaagggaatcactggaacaagctttttcacttgggggggcttacattgtaatagcatatttagtagtttcggggatgtctatacagtaaggggaaaaattgtcacacgagttgtgtcctttccccccttttgtgttccattttcgaacgttgacaggaatgtaaccgaacgcatgttgtccgttatgcagcccccaagtcatcacattgccttttctcctcgttagcgattggtgtttattttgcgtgctggatgtgtttaatttatgctttgatgtttgatttgtggccattgaaccattttgt

SEQ ID NO: 4514 - DNA, 1421 bp, Setaria italica
agagaacaccctactcagccggcttctaggtgcaaggataggcaacctgtgctccaacaatctgttgatcagtctttcggttgcggaataaagtagagctttaagaagtttgataattggtatcttttcaagaatacattgaagtgcaagatgccaaaaataaagaatctctcgaatgcgtgtaaagtatcattctctccagacggacccatatctgaagaggcacttgagagagtccgtgcactgttagaggagataaggcctttagatgttggcctagataatgaagcacaaattgcacgcaattggaatagttcaacacgctcatcaaatgggagacgaggacgtaatggggctaaccagttcgccactccaatcaaatatttgcacattcatgaatgtgaaagtttctctatgggtatattttgtatgccaccttcttcagttattccacttcataatcatcctggaatgactgtacttagcaagcttctttatggaagattgcatgctgaatcttatgattggattgatgtacctgatcatccaattgatcaattacaagcaagaccagcaaagcttgtcagagatcgtgaaatgactgcaccagagacgagcattctttaccctaatagagggggtaacatccatactttcagagccatcacaccttgtgctctcttcgatgtcctttctccaccatactctgctgaggacgggcggcattgttcttacttccggaagtctctagtgaatcaaccacctgttgttttgcctgctgagatagatagctcacaagttgtctggttggaggagttggaggaccatcagccccccgatggctttgttgttgcgagaggtctgtacaaaggccctgtaataaggatataatttggttggagcatggtatccagcgaactacggatcagctgaaagaggatgcaggcttgtagcatctatttcatctagtatcgcaaacatcaatggtcactgtgcagtccatggtttactttgtacatgttaaagtgatctatgataatttaacagcaactttacagaacaagaatggaagtttatggtttgaccaccactttaattatgtgtcgtgctgctggagtatctctgacctagctatggagctgttatcagatcaagaccttggcgtacatacttttgagcttagtctagcataacaactgtcatgctcttctaagggaatcactggaacaagctttttcacttgggggggcttacattgtaatagcatatttagtagtttcggggatgtctatacagtaaggggaaaaattgtcacacgagttgtgtcctttccccccttttgtgttccattttcgaacgttgacaggaatgtaaccgaacgcatgttgtccgttatgcagcccccaagtcatcacattgcc

SEQ ID NO: 4515 - DNA, 1641 bp, Pennisetum glaucum
gtgaccaccgccggtaaaggattctaggggacagcggcctgcaacaagagaacacccgagtcaccgggcggctaggtgcaaggataggcaacctgtgctccgacaatctgtggatcagtctttcgtctgcgtagtaaagtagatctgtaagaactttgataattggtatcttttcaagaatacattgaagtgcaagatgccaaaaataaagaatctctccaatgcttgtaaagtatcattctctccagacggacccatatctgaagaggcacttgagagagtccgcgcactgttagatgagatcaggcccttagatgttggcctcgataatgaagcacaaattgcacgcaattggaatagttccacacgcccattgaatggaagacgaggacgtaatggggccagccagttcgctgctccgatcaaatatttgcacattcatgaatgtgaaagtttctctatgggtatattttgtatgccaccttcttcagttattccacttcataatcatcctggaatgactgtacttagcaagcttctttatggaacactgcatgctgaatcttatgattggattgatgtacctgatcatccaatggatcaattacaagcaagaccagcaaagcttgtcagagatcgtgaaatgactgcaccagagacaagcattctttaccctaatagaggcggtaacatccatactttcagagccatcacaccttgcgctctcttcgatgtcctttctccaccatactctgctgaggatgggcggcactgttcttacttccggaagtctctagtgaatcaaccacctgttgttttgcctgctgagatagatggctcacaagtaatctggttggaggagttggaggaccatcagccccctgatggctttgttgttgcgagaggtctgtacaaaggccctgtaataaggagataatgttgttggagcatggtatccagcgaactacaaatcagctgaaagaggatgcaggcttgtagtatctattgcgtctaccatcgtaaacatcaatggtcactgtgcagtccatggtttactttgtacatgtcaaagtgatctatgataatttaatagcaactttacagaacaagaatggatgcttatggtttgaccagcactttaattatgtatcgtgctgctggagtatctctgacctagctgtggagctgtcagctgttttcagatcaagaccttgtggcgcacatatttttgagcctagtctagcattcaatcgccatgctcttctaaggaattactggaaccagctttttctgttaatggtgtcgggcctagcattttctctcagcatctaataggcatatttagtatttagtagtttcgggatgcaaggggaaaaggtttgtcacaagaatttctcctcccttttgtgctccattttcgattgctgacacaaatgtaactgtacactgaacgtacgttgcccgttgtgcagtccaagtcatcacactgcctcctcgttagtgattgtttattttgcttggatatgtgttcagccaaacgaacagggtgaggctttgatgttgatttgtagcaatatgacatggtttgctttgagaaagggatattgaataaaccttgtacatgttaggatggacgaaaaa

SEQ ID NO: 4516 - DNA, 1671 bp, Brachypodium distachyon
gccggggggaatcggagggaaccagtgggcgttggccacagccgggcagagaggtggaggcgagcaggggcggcgtggggcacagcttctgcagtcagttttcagactccttccccaacccaaggtgcaaggattgacaaaccgtgtggatcaataccgatatctcagtctttgggttggaaatctgtctgagcctcctgaagcttcatagtctttgtcttctcagtaatacattggagttcaagatgccaaaaataaagaacctttctgaggcatgtaaagtatcattttctcctggtggacccatatctgaagaagcactcgagcgggttcgtgctctgttagatgagatcagacctttagacgttggcctagataatgaagcacaaattgcacgtaattggaacagttctgcacgtcaacaaaacgggaggcgaggacgtaatgggtctaatcagtgcgcacctccaatcaaatatctgcatattcatgaatgtgaaagtttctctatgggcatattttgtatgccaccttcatcagttattccacttcacaatcatccaggaatgacagtgctgagcaagcttctttatggcaagctgcatgcagagtcttatgattggattgatgtagctgatccacctggccaattacagccaagaccagcaaagtgtgtaagagatcgtgaaatgactgcgccagagacaaccattctttatcctgatagaggtggtaacatccacactttcagagcagtcacaccttgtgctctctttgatgtcctttctccaccatattctgctgagaatgggagggactgttcatactttcggaagtctctagtgaaggaaccatctgttgtgttacccagtgaaataaatagctccgaggtagtctggttggaggaattggaggaccatcagcctccggagggctttgttgttgctagaggtctgtacaaaggccctgtgataaggagatagttaggtttaaagcacttttgtccacggaccgtggatcagctgcatgtggcttagtagagcaagcatcgtccagttgacctgcaccctgcgactcccaaagtacacaaagtcatctgcgatgatttaggggcaattttacagaagaatggagcatatttaaggccattttgatcgtgtctgctcgctacttggagcaaaatgctgtttgtgatgtagttactggctcttatcagctgaaggccgtggagtatatacttgtgttgagaagaggagagagctgtctgtcattctgtattaggtagaaggaacggcgggtgcttctcgtctgatatgattattccagaagaaaagaagatttggtgtggtgaaccgatttgtccatctcatgatgtaaacagtcttcataaatattcttttgtaccaacttttatgtctatggatgaacagtgtcatcggtgagttgccattgttgagttgtagagggcttaaaaaattacatctctttttagttcatttgcgttttagtacatcacaatttgaactaaaaccatttgaactaaaaccacgacaagaatttaggaacggaggattaacaaaactaatttgatactctctccggtcctaaattattgtcgaaatattacatgtatctagacgctttttaagaatagacacatccatatttgaa

SEQ ID NO: 4517 - DNA, 1925 bp, Brachypodium distachyon
aaaaaaactcggtccattcttccatctctcccaaccccatcgcgaaacccgtccacagctcctccgaatctcccgatccacctctccccgaatccaacctccttaagatcgatctccccagactcccccgatccatctccgcacgattctctcgtctcccgatggcggcgggcctagcaggcggcgccgggcgggcgtagcagtgcagggaagaagaggaaacgcgcaggtggggggcggcgtcggcggccacagccggggggaatcggagggaaccagtgggcgttggccacagccgggcagagaggtggaggcgagcaggggcggcgtggggcacagcttctgcagtcagttttcagactccttccccaacccaaggtgcaaggattgacaaaccgtgtggatcaataccgatatctcagtctttgggttggaaatctgtctgagcctcctgaagcttcatagtctttgtcttctcagtaatacattggagttcaagatgccaaaaataaagaacctttctgaggcatgtaaagtatcattttctcctggtggacccatatctgaagaagcactcgagcgggttcgtgctctgttagatgagatcagacctttagacgttggcctagataatgaagcacaaattgcacgtaattggaacagttctgcacgtcaacaaaacgggaggcgaggacgtaatgggtctaatcagtgcgcacctccaatcaaatatctgcatattcatgaatgtgaaagtttctctatgggcatattttgtatgccaccttcatcagttattccacttcacaatcatccaggaatgacagtgctgagcaagcttctttatggcaagctgcatgcagagtcttatgattggattgatgtagctgatccacctggccaattacagccaagaccagcaaagtgtgtaagagatcgtgaaatgactgcgccagagacaaccattctttatcctgatagaggtggtaacatccacactttcagagcagtcacaccttgtgctctctttgatgtcctttctccaccatattctgctgagaatgggagggactgttcatactttcggaagtctctagtgaaggaaccatctgttgtgttacccagtgaaataaatagctccgaggtagtctggttggaggaattggaggaccatcagcctccggagggctttgttgttgctagaggtctgtacaaaggccctgtgataaggagatagttaggtttaaagcacttttgtccacggaccgtggatcagctgcatgtggcttagtagagcaagcatcgtccagttgacctgcaccctgcgactcccaaagtacacaaagtcatctgcgatgatttaggggcaattttacagaagaatggagcatatttaaggccattttgatcgtgtctgctcgctacttggagcaaaatgctgtttgtgatgtagttactggctcttatcagctgaaggccgtggagtatatacttgtgttgagaagaggagagagctgtctgtcattctgtattaggtagaaggaacggcgggtgcttctcgtctgatatgattattccagaagaaaagaagatttggtgtggtgaaccgatttgtccatctcatgatgtaaacagtcttcataaatattcttttgtaccaacttttatgtctatggatgaacagtgtcatcggtgagttgccattgttgagttgtagagggcttaaaaaattacatctctttttagttcatttgcgttttagtacatcacaatttgaactaaaaccatttgaactaaaaccacgacaagaatttaggaacggaggattaacaaaactaatttgatactctctccggtcctaaattattgtcgaaatattacatgtatctagacgctttttaagaatagacacatccatatttgaa

SEQ ID NO: 4518 - DNA, 2007 bp, Oryza sativa
gactgcctcgtgttccccgtgcgagcggagcggctgcctacctagtacctccccccccccccccccctccttctcgctgcgcctcctcctcgccgccggttccgcccctctctcgcctcgcctcggccctccatccccccgcctcctccgcgggtcgcagggtgtcgcgcttggacgaagggcagcttttcacagcatgacttaaaagtggaaatgagtgcacatcccaaaaacgattgcttgatttgcagttcttggagctgtgcactactattttgtccaatttcactacatctgcctcttgtttgagaggtgctaaaattgacagcctgtgctttatcgccacaactgtggggatccgttgagcaattatcacgttccaaattcactcagtcttttgaaggtttgacaattccgatattctcaatagcacatcgaagtgcaagatgccaaaaataaagagcctgtctaatgcttgtaaagtatcattttctccggatgggcccatatccgatgaagcacttgagagagttcgtgcattgttagatgagataagacctatagatgttggcctagacaatgaagcacagattgctcgtaattggaataattcaacgcgtcaaccaaatggaagaagaggacgtaatggggctaaccagttcacatctccaatcaaatatttacacattcatgaaagtgaaagtttctctatgggtatattttgtatgccgccgtcatcagttattccacttcacaatcacccaggaatgacagttctgagcaagcttctctatggcacactgcatgctgaatcttatgattggattgatgtaactgatccaaccgatcaattacaggaactttcagtgagaccagcaaggcttgtcagagaccgtgaaatgtctgctccagagaccaccattctttatcccaatagaggtggtaacatccacactttcagagcgatcacaccttgtgctctctttgatgtcctttctcctccttattctgctgagaaggggagggactgttcatacttccggaagtcttcagtaagggaaacaccacctgttgttttgcctggtgaaataaatagcgcagaagtaatttggttggaggaattggaggaccatcaacctccagagggctttgttgtcgcgagaggtttgtataaaggccctgtaataaggagatagttaggttcgaagcacgtctgtccacgaatcacgaaccagttgacgatgcagctaggttcctagctagtatctgtgtcatgtgggttagtatagagcaatgcatcgttgagtcactcatctgcaacctgcgatttactctgtacatgtcaatgcaaagtgatctggtgaagatttaactgccaggttacaaaacaagaacgaaaaacttttatggttgacagccagatgttgttctataacatagttgagtggccccccctatcagctggaggttgttacttttttttgtgtcgacttgcagagcgccttgtcatgctgtattaggtaacctcaacggcagaaccttttcacctattgatgatttcagaaattgagttggtgtgtgatatttgtcttatcacatgatgtgacttttgtacgcaccgtttattactggacgtggtatcagtttatgaaaaaaaaaaagaaagcatgccgggaccttgaaattcaaattatttcgatgattttaccaactactacacctgtctgggcctgcaaactgaagttcagaatggttcaatcaaattgctagggcttgctaatggaccatgattttcccaaactgccaaaggctggtaacccaatctgaatctccaagcccaagtccaccaataatgtacagtactacctagtagaccagcaccacttgtcctgatttgtagtggatgtgtcacgtcacgtctccatgttatttatgggatggatggagtaagtagcatattcagttgactaactaaaggtggcatctacagcaaatactcccttcgcc

SEQ ID NO: 4519 - DNA, 1679 bp, Oryza sativa
gactgcctcgtgttccccgtgcgagcggagcggctgcctacctagtacctcccccccccccccccccccccctccttctctgcgcctcctcctcgccgccggttccgcccctctctcgcctcgcctcggccctccatccccccgcctcctccgcgggtcgcagggtgtcgcgcttggacgaagggcagcttttcacagcatgacttaaaagtggaaatgagtgcacatcccaaaaacgattgcttgatttgcagttcttggagctgtgcactactattttgtccaatttcactacatctgcctcttgtttgagaggtgctaaaattgacagcctgtgctttatcgccacaactgtggggatccgttgagcaattatcacgttccaaattcactcagtcttttgaaggtttgacaattccgatattctcaatagcacatcgaagtgcaagatgccaaaaataaagagcctgtctaatgcttgtaaagtatcattttctccggatgggcccatatccgatgaagcacttgagagagttcgtgcattgttagatgagataagacctatagatgttggcctagacaatgaagcacagattgctcgtaattggaataattcaacgcgtcaaccaaatggaagaagaggacgtaatggggctaaccagttcacatctccaatcaaatatttacacattcatgaaagtgaaagtttctctatgggtatattttgtatgccgccgtcatcagttattccacttcacaatcacccaggaatgacagttctgagcaagcttctctatggcacactgcatgctgaatcttatgattggattgatgtaactgatccaaccgatcaattacaggaactttcagtgagaccagcaaggcttgtcagagaccgtgaaatgtctgctccagagaccaccattctttatcccaatagaggtggtaacatccacactttcagagcgatcacaccttgtgctctctttgatgtcctttctcctccttattctgctgagaaggggagggactgttcatacttccggaagtcttcagtaagggaaacaccacctgttgttttgcctggtgaaataaatagcgcagaagtaatttggttggaggaattggaggaccatcaacctccagagggctttgttgtcgcgagaggtttgtataaaggccctgtaataaggagatagttaggttcgaagcacgtctgtccacgaatcacgaaccagttgacgatgcagctaggttcctagctagtatctgtgtcatgtgggttagtatagagcaatgcatcgttgagtcactcatctgcaacctgcgatttactctgtacatgtcaatgcaaagtgatctggtgaagatttaactgccaggttacaaaacaagaacgaaaaacttttatggttgacagccagatgttgttctataacatagttgagtggccccccctatcagctggaggttgttacttttttttgtgtcgacttgcagagcgccttgtcatgctgtattaggtaacctcaacggcagaaccttttcacctattgatgatttcagaaattgagttggtgtgtgatatttgtcttatcacatgatgtgacttttgtacgcaccgtttattactggacgtggtatcagtttatgaaaaaaaaaaagaaagcatgccggga

SEQ ID NO: 4520 - DNA, 1619 bp, Secale cereale
tctttctctctcttcttccctcccctccccgtaaccctatcttccttaccagtcacccccttccctctcgccctcctggcgtcggcgtcggcggcgcgtgtctgattgggagctttggcggcagctcgtgcagccgccgatttggacgacgccggcgaccaggacctcaccggcagcagcacatcttatccaaagtttgcagatttcgcctacaaagtccgaggtgggaattctctgctccatcatcacaaccctgtgtatcaattgccgccagtctttgtgttgcaaaatctggacatagccttctgaagtttggcagtcatatcttctcaactgtacattgccgtgcaagatgcccaaaataaagaacctgtctgatgcatgtaaagtatcattttctccagatggacctatatctgaagaaacactcgagagagttcgtgcactgttagatgagatcagacctttagatctcggcctagataacgaagcgcaaattgcacgtacttggaatagttctacacgtcaacagaatgggaggcgaggacgcggtgggcctaatcagtacgcgcccccaatcaaatatctgcacattcatgaatgtgaaagcttctctatgggtatattttgtatgccaccgtcatcagtaattccacttcacaaccatccaggaatgactgtgctgagcaagcttctttatggcaagctgcacgccgaatcatatgattggattgatgtagctgatccaactgacccattaaagccaagaccagcaaggtgtgtaagagaccgtgaaatgactgcgcccgagacaaccattctttatcctgatagaggtggtaacatccacactttcagagccatcacaccttgtgcgctctttgacgtcctttctccaccttattctgctgagaatgggagagactgttcatacttccggaagtcttcagtgaaggagccatctgttgttttgccgagtgaaatagatagctctgaggtagtatggttggaggaattggaggaccaccagcctccagagggctttgttgttgctagaggtttgtacaaaggccctgtgataaggagatagttagttttttacaccacttttgccaatggattgaggatgcagagggctcctagtatcagttgtatgtggcttagtagagcaagtatcatccaggcaacctgcaagcagcctgcggtttacgttgtacacacatgacctgatgtggttgaatgaagagcgtttgagaccattttcattgtgcctgctcggtactggagcaatgctgatggtctatgatgtacccacacgtggctcttttatcagatgaaggccttggagtatatacttcttttgagaagaggagagttcttgccatgctgtattaggtagaacaagtggcacgagcttctcacctgatgattgtttcagaaaaaaaggatttggtgtggtgaaccgattattccgtgtcattatgtaaacaatcgcataaacattctttgggatcaaactcgctgtcttcgcaaaaattgacaacgcggtgtatgctgagtctagtaaccattcctttcccttccagtgaagtctgtcgtcagttttcaacattatgatt

SEQ ID NO: 4521 - DNA, 1797 bp, Hordeum vulgare
ggcgagcgtcgctcggtcgcgcgtgtccctccctcgcctcccggaggtcccatctctctctctctctctctctctctccatctcccccctccccctccccctccccgtaaccctatctttctcaccagtcagccccctttctttcgccctcctggcggcggcgtcggcggcgcgtgtctgacggggagctttggcggcagctagctcagccgccgatttggacgacaccggcgagcaggacctcaccggcagcagcgcatattatccaactttgcagattccccctacaaagtccgaggtgggaagactgctccattatcacaaccctgtggatcagttgacactagtctttgggttgcaaaatctggacagtgccttctgaagtttgacagtcattatcttgtcaacagtacattgccctgcaagatgccaaaaataaagaacctgtctgatgcatgtaaagtatcattttctccagatggacccatatctgaagaaacactcgagagagttcgtgcactgttagatgagatcagacctttagatcttggcctagataacgaagcacaaattgcacgtaattggaatagttctacgcgtcaacagaatgggaggcgcggacgcggcgggcctaaccagtacgcgccctcaatcaaatatctccacattcatgaatgcgaaagtttctctatgggtatattttgtatgccaccgtcatcagttattccacttcacaatcatccaggaatgactgtgctgagcaagcttctttatggcaagctgcacgccgaatcatatgattggatcgatgtagctgatccaactgacccgttaaagccaagaccagcaaggtgtgtaagagaccgtgaaatgactgcgcccgagacaaccattctttatcctgatagaggtggtaacatccacactttcagagccatcacaccttgtgcactctttgacgtcctttctccaccttattccgctgagaatgggagagactgttcatacttccggaagtcaccagtgaaggagccatctgttgttttgccgagtgaaatagatagctctgaggtagtctggttggaggaattggaggaccatcagcctccagagggctttgttgttgctagaggtttgtacaaaggccctgtgataaggagatagttaggttttgataccacttttgccaatggattgaggacccagagggcgcctcgtatcagttgtatgtggcttagtagagcaagtatcatccaggcaacccgcaagcagcctgtggtttacattgtacacacaccacctgttgtgggtgaatgaagaaacgattgagaccattttcattgttcctgctcggtactggagcaatgctgctggtctgtgatgtacccacgtggctcttttatcagatgaaggccttggagtatatacttcttttgagattggagagttcttgccatgctgtattaggtagaacaagtggcatgggcttctcacctaatgattgtttcagaaaaatggatttggtgtggtgaactgattattcggtgtcattatgtaaacaatcgcataaacattctttgggataaaactttcgtcttcgcaaaaactgacaatgcggtgtatgctgtcagagtctagttaccattcctttcctcttccagtgatgcccgtcaacatttttcaacattatggttgtttcggataaactattttgtatcttttcactagtcactcagtactctattcaaacatatgcggcaatatatttattaataaatggtggagctttacctggcc

SEQ ID NO: 4522 - DNA, 1580 bp, Triticum aestivum
ctggcggcggcgtcggcggcgcgtgtctgactgggagctttagcggcagcttgcgcagtcggccgtgccctctccctccctcacctctctcctatctgcagcgagcggtggcggcgggaaacgctcgcggagccgccgatttgaacgacgccggcgaccaggacctcaccggcagcagcgcatcttatccaagtttgcagatttcccctacaaagtccgaggtgggaagactctgctccatcatcaaaaccctgtggatcaattgccaccagtctttgggttgcaaaatctggacagagccttctgaagtttgacagtcatatcttgtcaactgtacattgccgtgcaagatgccaaaaataaagaacctgtctgatgcatgtaaagtatcattttctccagatggacctatatctgaagaaacactcgagagagttcgtgcactgttagatgagatcagacctttagatctcggtttagataacgaagcacaaattgcacgtacttggaatagttctacgcgtcaacagaatgggaggcgaggacgcggtgggcctaatcagtacgcgcccacaatcaaatatctgcacattcatgaatgcgaaagtttctctatgggtatattttgtatgccaccgtcatcagttattccacttcacaatcatccaggaatgactgtgctgagcaagcttctttatggcaagctgcacgccgaatcgtatgattggattgatgtagctgatccaactgacccgttaaagccaagaccagcaaggtgtgtgagagaccgtgaaatgactgcgccagagacaaccattctttatcctgataggggtggtaacatccacactttcagagccatcacaccttgtgcgctctttgacgtcctttctccaccatattctgctgagaatgggagagactgttcatacttccagaagtcttcagtcaaggagccatctgttgttttgccgagtgaaatagatagctcagaggtagtctggttggaggaattggaggaccatcagcctccggagggctttgttgttgctagaggtttgtataaaggccctgtgataaggagatagttaggtttttataccacttttgccaatggattgaggatgcagagggctcctagtatcagctgtatgtggcttagtagagcaagtatcatccaggcaacctgcaagcagcctgcggtttacgttgtacacacacgacctgatgtggatgaatgaagagcgtttgagaccgttttcatcgtgccttgctctgtactggagcaatgctgctggtctgtgatgtacccacgtggctcttttatcagatggaggccttggagtatatacttcttttgagaagatgagagttcttgccacgctgtattaggtagaacaagtggcatgggcttctcacctaatgattgtttcagaaaaaagatttggtgtggtgaaccgattattccgtgtcattatgtaaacaatcgcataaacattctttgggataaaactgtctttgcaaaaactgacaatgcggtgtatgctgttaagagtctagtaaccactcctttcccttcc

SEQ ID NO: 4523 - DNA, 1321 bp, Avena sativa
gtctggtgggttgccaatctggacagagccttctgaactttgacagtcattgtccttctcaacaatacattgccggacaatatgcctaaaataaagaacctgtctgatgcatgtaaagtatcattttcacctgatggacccatatctgaagaagcactcgagagagttcgtgcactgttagatgagatcagacctttagatcttggcctagataacgaagcacaaattgcacgtacttggaatagttctacgcgtcaacagaacgggagacgaggacgtggtgggcctaatcagtatgttcccccaatcaagtatctgcacattcttgaatccgaaagtttctctatgggtatattttgtatgccgccgtcatcagttattcctcttcataatcatccagccatgactgtgctgagcaagcttctatatggaaagctgcaggctgaatcttatgattggattgatgcagctgatccaactgacccgttgaagccaagaccagcaaggtgtgtaagagaccgtgaaatgactgcgccagagacaaccattctttatcctgatagagggggtaacatccacactttcagagccatcacaccttgtgcgctctttgacgtccttactccaccatattctgctgagaagggaagagactgttcatacttccggaagtcttcagtgaaggaaccacctgttgttttgccgagcgaagtagatagctccgaggtagtctggttggaggaattggaggaccatcagcctccagagggattcgttgttgctagaggtctgtacaaaggccctgtgataaggagatagttaggtttataccacttttgcatatggatcaccaatcagttgaggatgcaggctcctagcatcagttgtatgtggcttagtagagcaagcatcatccagtcaagctgcatcatgtgatttacgatgtacacgaccgatgtggatgaatgaagagttataagaccatttttagtgtgcctggagcaatgatgctggtctgtgacggagtagctacgtgtgtatcagatgaaggcctttggagtacatacttctttcgagaagaggggggttctagccatgctgtattaggtagaacaagtggcttgagcatctcacccgatgattattccaggaaaagaacatttggtgtggcgaactgattggtccatctcattgtgtaaacagtcgcaatattctttgggatacgaactttctgtgtctctgcaaaaagtgacaatgtggtgtcgtcttccaaactccaataactctttgtttattattactagaataactttgtctttcc

SEQ ID NO: 4524 - DNA, 1282 bp, Avena sativa
ccaatctggacagagccttctgaactttgacagtcattgtccttctcaacaatacattgccggacaatatgcctaaaataaagaacctgtctgatgcatgtaaagtatcattttcacctgatggacccatatctgaagaagcactcgagagagttcgtgcactgttagatgagatcagacctttagatcttggcctagataacgaagcacaaattgcacgtacttggaatagttctacgcgtcaacagaacgggagacgaggacgtggtgggcctaatcagtatgttcccccaatcaagtatctgcacattcttgaatccgaaagtttctctatgggtatattttgtatgccccgtcatcagttattcctcttcataatcatccagccatgactgtgctgagcaagcttctatatggaaagctgcaggctgaatcttatgattggattgatgcagctgatccaactgacccgttgaagccaagaccagcaaggtgtgtaagagaccgtgaaatgactgcgccagagacaaccattctttatcctgatagagggggtaacatccacactttcagagccatcacaccttgtgcgctctttgacgtccttactccaccatattctgctgagaagggaagagactgttcatacttccggaagtcttcagtgaaggaaccacctgttgttttgccgagtgaagtagatagctctgaggtagtctggttggaggaattggaggaccatcagcctccagagggattcgttgttgctagaggtctgtacaaaggccctgtgataaggagatagttaggtttataccacttttgcatatggatcaccaatcagttgaggatgcaggctcctagcatcagttgtatgtggcttagtagagcaagcatcatccagtcaagctgcatcatgtgatttacgatgtacacgaccgatgtggatgaatgaagagttataagaccatttttagtgtgcctggagcagtgatgctggtctgtgacggagtagctacgtgtgtatcagatgaaggcctttggagtacatacttctttcgagaagaggggggttctagccatgctgtattaggtagaacaagtggcttgagcatctcacccgatgattattccaggaaaagaacatttggtgtggcgaactgattggtccatctcattgtgtaaacagtcgcaatattctttgggatacgaactttctgtgtctttgcaaaaagtgacaatgtggtgtcgtcttccaaactccaataactctttgtttatt

SEQ ID NO: 4525 - DNA, 1644 bp, Zea mays
aactaaccagctccggcccaaacacagccacgagcacctacacccccccgctgtcacctctccttccatcgccacaggcggcccttctccgcggaagccggcgggccgccgcctcccttacccctctcgctgtgctcctccgcaccgtcattccctagcattccccacgggcgagtggcggcttggtcgagatgggcgatgcggttgatgacatcatctgtgcaacggatgcggcggtcgccgtcgaggatgcggccagtgggaagcccgcaatgctctctagcttaggggggcagggtgaggaagagcatgaggagaaggacaatgaggacaagtcaggcgagagcgaggtgatcaacccgccagaagacgctggcggggaggccacctcacccctggaagggttgaagcctcgcctttccaaggggaatcaaagccatggacctaatgctgtcaaatcaaagagcccaacgagtggagacgaaggtcagacgaggaaaaaggctcccaattcttctcttcctaaggcacccattgtccaggtgtcccatggtgacgctggtgtcggcagtaataaagatggcaagaatgagtctcgctcatcttccgtggatgcaacattgctggatgactccaaggagaaaaggaaaactcaaaagccattagcacagctcttttccatcaaaagtgacgaagaacagtcaaatggtgagagtgcaaagcctcgaaaagttggcagcattccatcatatggtttcaccttcaagtgtgatgagagatctgaaaaaagaagagagttctattcgaagcttgaggagaagattcatgcaagagagttagaaataagcaatttgcaagcgaaatcaaaggaaactgaagaagcagaactcaaaatgctgagaaagagtttgaacttcaaggcaacaccaatgccaagcttctataaggaaccaactcctgtcaaggttgaattgaaaaagatccccccaacaagagccaaatcgccaaagtttggtcgttctaaaaacaagtccacaccagagactgaagaaaatgctaccgcggaccagcctgcccacctgagcctcgaggagaatgtttctcaaaccggtgtgaaaaaaccaaccccgttgaatccagcaaagaagccccagaggaagtcactccccagactgccatctgaagaaaccggtccgcttgatgccacctcaaggcaacttataaagagcgccaagctggatgcagttagtgctccggagacaggatcagctacaggacaggcacaactacaaggaagtcagacggaaacagattctggtcaggggccagttgaagctggagctaatcctgatgaacaagacgccagcgaacagagtgttgtttagtgaagatcacgatgaccaaaccagctgatttgtgatgtgcatggtgttcctcggctttgtataatatattgtgcttgcctgctagagtaacctgtagtctgtattatgttatgtgatatatactactactcctggtttattttcctggaattgagccgtatgttgcttatcaatctagatagcttttgttcatattctacagatatatatatatccaaattgtcccgagtcatttgcagttggtggcaagtgcgttcat

SEQ ID NO: 4526 - DNA, 1730 bp, Zea mays
aaacacagtcaccaccacctacacccccgttgtctcctctccttccattgccacagtcggccttctccgtggaagccggcgggccgccgcctcctttgtccctgtcgtcgtgctcttccgtaccgccattccctagcactgtccacgggcgagatctcgcgtgtacggtgtacctcgtttccctcggcgggtggatcagtgacggcttggtcgagatggacgatgtggttgatgacatcatctgtggaacggatgcggcggttgccgtcgaggatggggccagtgggacgcccgcaatgcctagcttagggtgccagggtgaggaagagcataggaagggcaatgaggacaactcaggtgagagcgaggtgattaacccgccagaagaggctggcggggaggccacctcgcccctggaaggcaggaagcctcgcctttccaaggggaatcaaagccatgtacctaaggctgtcaaatctaagagtccaaggagtggagatgaaaatcagacaaggagaaaagctcccaactcttcttttcctaaggcacccattgtccaggagtcccatggtgactctggtgtcggcagtaataaagctggcaagaatgagtctcactcatccccaattgatgcagcattgcccgatgagtccaaggagaaaaggaaaactcaaaagccaccagcacagctctcttccatcaaaagagatgaagaacagtcaaatggtgagagtgcaaagcctcgaaaagttggaagcacgccatcatatggtttcaccttcaagtgtgatgagagatctgaaaaaagacgagagttctattcgaagcttgaggagaagattcatgcaagagagttagaaataagcaatttgcaagccaagtcaaaggaaactgaagaagcagaactcaaaatgctgagaaagagtttgaatttcaaggcaacaccaatgccaagcttttataaggaaccaacccctgccaaggttgaattgaaaaagatccccccaaccagagctaaatcaccaaagcttggtcggtctaaaaacaagtccatatcagagactgaagaaaatactactacggaccaacctgcccgtctgagccttgacgaaaaggtttctcaaaacggtgtgaaaaaaccaaccccgtcgagttcagcaaagaagccccagagaaagtcactccccaggctgccatctgaagaaacttgtccgcttgatgccacctcaaggcagctgaagaacaacaaactggatgaagttaatgctcaggagacaggatcagctacagggcaggtacaaggaagtgagacggaaacagattctgttcagagcgcaactcaagctggagctaaccctgatgaacagagtgtcgctcagtgaacagagtgtcgctcagtgaagatctcggtggccaagccaagtgatttgtgatggatggtgtgccttatctttgtgtgatgttgtgcttgtctactagagtgacttgtggcctgtatcatgctgtgttatactcctgtttttgttttcctgcgattgagcctgtatgttgcttatcaatctagatagcttttgttcataatctacagatatatccaaattgtcctaagtcatttgcagctggtcgcaagtgcagtcaccgtaaaatcccttaacgcctgtatggttgggttttgaggttgcttttgcttcccaaaagcctaaccaaaacggctgtttttttttaaaaaa

SEQ ID NO: 4527 - DNA, 1886 bp, Setaria italica
acagctgagacgctctcgacgacttcacccccgagcccatggcgacgggcacccgccggccctggtgggcgccgccgccgtccacggtgacggcacccccctcggccccgcctttcccctcaccgccgtcgtcgttcacggccgacccgccggaggagttcctctgcccgatctccggctcgctgatggcggacccggtcgtcgtcccgccgggccagacttttgagcgcgcctgcatccaggtctgcgccgcgctcgccttctccccgcccgccgtcgccgccgacctcgccgcgtcagtctcctcctcgtccccgctcgtgctcgtccccaacgtcgcgctccgcaccgccatcctcaactggtgcgaccggctcgggctgccgcacccggccccgctgtcgccggacaccgcccacgacatcgtctgccgcctcatgccgcctcagcgcgaggaccagagctcgaagccgcagcagcggccacaggtcgcctcctcggtccggtttaggaggcagagcgtcgacggcttcgcgcaggagcccagccccaggcagaggggcgacgctctggaggaggagatcatggccgtgctcggggcggagggcgccacccccgcggagcaggcgtcggcgatggcgtcgctgcggcaggcgacgcgggagaacagggaggtcaggaggcagctctgcacgccgcgcctcctcgcggcgctgcgcccgatgctgctctcggccgacgccggcgtgcagtccaacgcggcggccgcgatggtcaacctgtcgctggagcccgagaacaaggtgcggatcgtgcgatccggggcggtgtcgcccctcgtcgacgtgctccgcggcggccacccggaggcgcgcgaccacgccgcgggcgccatgtacagccttgccgtggaggacgagaaccgcgcggccatcggcgtgctcggcgccatcccgccgctgctggagctcttcgcgggcgcggccggcgccgccgccgccggctaccgcgcgcggcgcgaggccgggatggcgctgtaccacgtctccctctccgggatgaaccggtccaagatcgcgcgcgcgccgggcgccgtgcggacgctgctcgcggcggcggaggcgcgggaccgcagcaacgaggccgacgccgccgcgctgcggaggctggccgtcatgatcctggcgaacctggccggctgccccgacgggcgcgccgcactgatggacggcggcgcggtggccgcggtcgtcgggctgatgcgcaacggctccgccgcgccggggagcgcggaggaggagtactgcatatcaacgctgtacgggatgagccggggcagcatgaggttccggggcctcgcgcgcgcggcgggcgtcgaggccgcactgcagccggtggccgagggcggtggcggcgtggggcgggacatggcgcggcgcacgctccgggccatgcgcggggaggacgacgaggcgccggtcacggccaccgggctgctcggccggcagtgggacgacgggagcgtcgtgtcggaggggctcgtgtccatccggcggccgccgcaccggagcaattacgccgggccgtccgggtcaaacacgacccagttctgaaaagtcaaagtcttcgtttctgcactctgtcttgctccttgttgcgtgaagtctttggaagtctatttggcattttggctaccataacagaaaaatatggtatggtccttgtgttgtataaactgtaaggttgattcttttgtttgaactgaaatgtaactttatttgatttgtgcagtttttgggattatgtcaaagtgtaattgagaatagagaaaagattttattatggtcctgtgattctaatatggaattgaccttatgcaaatttaa

SEQ ID NO: 4528 - DNA, 1857 bp, Zea mays
cacgcaccagcagcagagaccgcggagacgctctctcgccatcgccagtcgcccatggccacgggcaccggccgtccgtggtgggcgccggcgccgcccgcggcggctcgctccgccccgctgttcccctccccgccgtcgtcgttcacggccgacccgccggcggagttcctctgcccgatctccggcacgctgatggcggaccccgtcgtcgcgccgccgggccagaccttcgagcgcgcctgcatccaggcctgcgccgcgctcgccttctccccgcccactgtcgccgttgacctctctgagtcccactcctgctcctccgccccgctcgtgctcatccccaacgttgcgctccgcaacgccatcctcaactggtgcgaccgcctcgccctgccacacccgtcaccgatgtcgccggacaccgcccacgacatcgtgcgccgcctcatgccgcaggaccggcagcggagctcgctggcgcagcgcccgcagccgcaggtgcagcagcagccgagctccaggcagcggggcgacgctctggaggaggagatcatggccgcgctcggcacggagggcgccacccccgcggagcaggcgtccgcgatggccttgctgcggcaggccacgcgggagaaccgggaggtacggaggcagctctgcacgccgcgcctcctcgccgcgctgcgccccatgctgctgtcggccgacgccgacgtccaggtcaacgcggccgcagcggtggtcaacctgtcgctggagcccgagaacaaggtgcggatcgtgcggtccggcgcggtgtcgccgctcgtggacgtgctccgcggcggccacacggaggcgcgcgaccacgccgcgggcgccatgtacagcctcgccgtggaagacgagaaccgcgccgccatcggcgtgctcggcgccatcccgccgctgctggacctgttcgcgggcgccgccgcccaccgcgcgcggcgcgaggccgggatggcgctctaccacatctccctctccgggatgaaccgccccaagatcgcgcgcgcgccgggcgctgtccggacgctgctggcagtggcagccgcggaggcgcggcgggaccgcgcgagcgacgccgacgccgccgcgctccggaggctggccgccatgatcctggccaacctcgcgggctgccccgacgggcgcgccgcgctgatggacggcggcgcggtggccgcggtcgtcaggctgatgcgctgcggctccgcggctcccgggagcacggaggaggaatactgcatatccacgctgtacgggatgagccggggcagcatgaggttccgcgggctcgcgcgcgccgcgggggtcgaggccgcgctgcagccggtggccgagggcggcggcggcgtgcggcgagacctggcgcggcgcacgctgcgggctatgcgcggcgaggatgacgaggcgccggccatggacagcgggctactcggacggcagtgggacgacggcagcgtcgtgtcggaggggctcgtgtccatccggcggccgccgccgcaccgtagcaatcacgccgggccgtccgggtcaaacacaacccagttctgaaaagaatagcaaagtcaaagtcttcgttttctgtacgctgttctgccgtctcggttcaagtcttgaactgtacaataccagaaaaatactgcaaggtacttcttgtcttgtataaactgtaaagttgattcttttgtttcaattgaaatggaactttattggatttgtgcaaggctttttggctgaatttctgaaactgtaattgagatcagggaaagggaagggtgctgggtctgtaatattattgatatcaagttgaccatatgcaaatttaac

SEQ ID NO: 4529 - DNA, 1556 bp, Sorghum bicolor
tgtctgttgtttatacttccgtcagccccaccgcaaccggcgcctccgcggctccgcccacccagctgctgcttccggagagctcgcgtcgcgcgtgcgtgggtgccgtgcgtgctggcggcgaagcagcaccgcaccggcaccacccttccccccccacgcgttgcgcgcgcgtctcctcgatggccgacggcgagccttccctcacccgctggaccttcgaggatttcgtggtgtactacgagacgcgcctcggcatccggcgcgaggccaacggcgatgatggcgacgagggcccaacgccgcgcggatccgatcatgcggccggccaccgccccgccgctgcccgcgccaacggcggcggcgcggacctcgccgtcttcgagcagttcgagcggatggagaggaaggtggagatacgcaatggggctatagaggatggtccaccgcagaaacctctacttccttcatttgaatctgcagaaatgcgcaacttagctgagacattgttgagggatataattcgtgggagtccagatgttaaatgggaaagcataaaaggtctggagaatgcaaagcgtcttctcaaagaagcagttgtcatgcccattaaatatcccaaatacttcactggtctgttatcaccttggaaaggcatattactatttggtccacctggaacaggaaagacaatgctagccaaagctgttgctaccgagtgcaaaacaacctttttcaatatttctgcctcatcgattgtgagcaagtggcgtggtgactcggagaaactagtgaaagtattattcgagcttgcaaggcatcatgcaccatctaccattttccttgatgagattgatgctatcattagtcaacgtggtgaagctcgtagcgaacatgaagctagccggcgattgaaaacggagctattaatacagatggatgggttgactaagacagatgagcttgtttttgttctagcagcaacaaatttaccatgggagttggatgcagcaatgctgcgtcggctggagaagcgtattcttgttccattgccagagccagatgctagacaagctatgtttgaagagctcctgccatctacacctggcaaaatggagattccctataatgttcttgtggagaaaactgaaggatattctggctctgatattcgccttgtatgcaaggaagcagcaatgcagcccctaagacggttaatgacagttcttgagcgcaggcaagaagaggtccctgaggatgagttgcctgaagttggcccagtaactacagaagatattgaacttgctttgaggaatacaagaccgtctgctcatcttcatgcacatagatacgaaaagtttaaccaagattatggcagtcatgtccatggctaaagggtagaagcttgctgtaaaaggtttaatttgtatgctcatgcttgggccaatagatcaatactgaattcatcaacgtgctgaggtatccttgtaaacactatgcttatccttggatgctgtacattatcattcatttgatgagtaataagctctttggta

SEQ ID NO: 4530 - DNA, 1952 bp, Sorghum bicolor
gacgccccgctgtcccggccgcttgtctgttgtttatacttccgtcagccccaccgcaaccggcgcctccgcggctccgcccacccagctgctgcttccggagagctcgcgtcgcgcgtgcgtgggtgccgtgcgtgctggcggcgaagcagcaccgcaccggcaccacccttccccccccacgcgttgcgcgcgcgtctcctcgatggccgacggcgagccttccctcacccgctggaccttcgaggatttcgtggtgtactacgagacgcgcctcggcatccggcgcgaggccaacggcgatgatggcgacgagggcccaacgccgcgcggatccgatcatgcggccggccaccgccccgccgctgcccgcgccaacggcggcggcgcggacctcgccgtcttcgagcagttcgagcggatggagaggaaggtggagatacgcaatggggctatagaggatggtccaccgcagaaacctctacttccttcatttgaatctgcagaaatgcgcaacttagctgagacattgttgagggatataattcgtgggagtccagatgttaaatgggaaagcataaaaggtctggagaatgcaaagcgtcttctcaaagaagcagttgtcatgcccattaaatatcccaaatacttcactggtctgttatcaccttggaaaggcatattactatttggtccacctggaacaggaaagacaatgctagccaaagctgttgctaccgagtgcaaaacaacctttttcaatatttctgcctcatcgattgtgagcaagtggcgtggtgactcggagaaactagtgaaagtattattcgagcttgcaaggcatcatgcaccatctaccattttccttgatgagattgatgctatcattagtcaacgtggtgaagctcgtagcgaacatgaagctagccggcgattgaaaacggagctattaatacagatggatgggttgactaagacagatgagcttgtttttgttctagcagcaacaaatttaccatgggagttggatgcagcaatgctgcgtcggctggagaagcgtattcttgttccattgccagagccagatgctagacaagctatgtttgaagagctcctgccatctacacctggcaaaatggagattccctataatgttcttgtggagaaaactgaaggatattctggctctgatattcgccttgtatgcaaggaagcagcaatgcagcccctaagacggttaatgacagttcttgagcgcaggcaagaagaggtccctgaggatgagttgcctgaagttggcccagtaactacagaagatattgaacttgctttgaggaatacaagaccgtctgctcatcttcatgcacatagatacgaaaagtttaaccaagattatggcagtcatgtccatggctaaagggtagaagcttgctgtaaaaggtttaatttgtatgctcatgcttgggccaatagatcaatactgaattcatcaacgtgctgaggtatccttgtaaacactatgcttatccttggatgctgtacattatcattcatttgatgagtaataagctctttggtaactcagtctcacctggataaggagaaaccaggattttccctacatttggcttgatttatctattcctctgatgtctctcttatgctttgttatccagctttttagtttcttccagtgaacagcgtgaacctctgtgtacttagaagagtcaatccaatttgtctttgcaacattgatgtatgtttagtaacactatcagaaacccagaatattgaggtcagagctgtagttgtttaccactttctgttcagtacaccagaaacccagtatacttgacctagtagtatagaaaaatgggctaatgcatggtatattatggtttatttgctttccagtctggattgattagcatataatggctcacaaccttctt

SEQ ID NO: 4531 - DNA, 1352 bp, Saccharum officinarum
cgtgccgttccggaatgaccgacgcgtccggctggtgcttccggagagctcgcgtcgcgcgtgcgtgggtgcgcgcggcggcaaagcagcaccgcaccacccttcccccacgcgttgcgcgggcgtctcgatggccgacggcgagccttccctcacccgctggaccttcgaggatttcgtggtctactacgagacgcgcctcggcatccggcgcgagcccaacggcgatgatggcgacgaccgcgacgagggcccaacgccgcgcggcggatccgaccatgcggccagccaccaccccgccgctgctgtccgcgccaacggcggcgcggacctcgccgtcttcgagcagttcgagcgtatggagaggaaggtggaggtccgcaatggggctatagaggatggaccaccgcagaaacctcaacttccttcatttgaatctgcagaaatgcgcaacttagctgagacattgttgagggatataattcgtgggagtccggatgttaaatgggaaagcataaaaggtctggagaatgcaaagcgtcttctcaaagaagcagttgtcatgcccattaaatatcccaaatacttcactggtctattatcaccttggaaaggcatattactatttggtccacctggaacaggaaagacaatgctagccaaagctgtggctaccgagtgcaaaacaacctttttcaatatttctgcctcatcgattggtgagcaagtggcgtggtgactcggagaaactagtgaaagtgttattcgagcttgcaaggcatcatgcaccatctaacattttccttgatgagattgatgctatcattagtcaacgtggtgaagctcgtagtgaacatgaagctagccggcgattgaaaactgagctattaatacagatggatgggttgactaagacagatgagcttgtttttgttctagcagcaacaaatttaccatgggagttggatgcagcaatgctgcgtcggctggagaagcgtattcttgttccattgccagagccagatgctagacacgctatgtttgaagagctcctgccatctacacctggcacaatggagattccctatgatgttcttgtggaaaaaactgaaggatattctggctctgatattcgccttgtatgcaaggaagcagcaatgcagcccctaagacggttaatgtcagttctagaacgcaggcaagaagaggtccctgaggatgagttgcctgaagttggcccagtaactacagaagatattgaacttgcgttgaggaatacaagaccgtctgctcatcttcatgcacatagataccaaaagttcaaccaagaatatggcagtcatgttcatggc

SEQ ID NO: 4532 - DNA, 1959 bp, Panicum virgatum
  misc_feature (1380)..(1380): n is a, c, g, or t
  misc_feature (1395)..(1395): n is a, c, g, or t
  misc_feature (1422)..(1422): n is a, c, g, or t
  misc_feature (1434)..(1434): n is a, c, g, or t
  misc_feature (1465)..(1465): n is a, c, g, or t
  misc_feature (1482)..(1482): n is a, c, g, or t
  misc_feature (1488)..(1488): n is a, c, g, or t
  misc_feature (1495)..(1496): n is a, c, g, or t
  misc_feature (1501)..(1501): n is a, c, g, or t
  misc_feature (1507)..(1507): n is a, c, g, or t
  misc_feature (1935)..(1935): n is a, c, g, or t
cccgctcgctgcttccggagagctcgcgtcgcgtggcgcttgcgcgtgcgggggcggagcagcacagcgccgcactaccctcgcgcgtcgctcgcgcgcgcgcgttctcgatggccgacggcgagccttccctcacgcgctggaccttcgaggacttcgaggcctactacgaggcgcgcctcggcgtccgccgcgagcccgcggaagacggcgacgatggtccccagccgcacggatccgaccacctggccggcagcccctccatgccacgcgccaacggcggcgcggacctcgccgtcttcgagcagttcgagcggatggtgctggagaggaaggtggaggcgcgcaatggggctatagaggatgggccgccgctgaaacctctacttccttcatttgaatctgcagaaatgcgtaacttagctgagacattgttgagggatataattcgtgggagcccagatgtcaagtgggaaagcataaaaggtctggagaatgcaaagcggctcctcaaagaagcagttgtcatgcccattaaatatcccaagtacttcacaggcctattatcaccttggaaaggtatattattatttggtccacccggaacaggaaagacgatgcttgcaaaagctgtggctactgaatgcaaaactacctttttcaatatttctgcctcgtcaattgtgagcaagtggcgtggtgactcggagaaactagtcaaagtattatttgagcttgcaaggcatcatgcaccatctaccattttccttgatgagattgatgctattattagtcaacgtggtgaagctcgtagtgaacatgaagctagccggagattgaaaactgagctattaatacagatggacgggttgactaagacagatgagcttgtctttgttctagcggctacaaatttaccatgggagttggatgcagcaatgctgcgccggctggagaagcgtattcttgtaccattgccagagccagatgctagacatgctatgtttgaagagctcctgccatctggtccttgcagaatggagattccctatgatgttcttgtggagaaaactgaaggatattctggctctgatattcgccttgtgtgcaaggaggcagcaatgcagcccctaagacggttaatgacagttctggaacgcaaccaagaagaggtccctgaggatgagttgcctgaagtcggtccgataacgtcagaagatattgaacttgctttaaggaatacaaggccgtctgctcatcttcatgcacacagatatgaaaagttcaaccaagattatggcagccatgtccatggctgaaggagtctgttgtaagatatttgtactcagtatggaactcgtgcatgggctgttagatcantgttgagtttccatngatgagatgaaggtatccttgtaaacncactgcttatgnttgtatcctgtacattatcattcatttgacnagtaataagctcttggntaatantttagcnncaccnggaatnagcagaaactagggtggtacctacatttggctcgttttacctatttttctggcactattcttaattcctgttttatgatccatttcttgagtttcttccactgagcagcttgaacacctgctattcagaaagccaagcccttagtctctttgacggcctaatatttctagcgacgtgccagaaaccaggaattgtggaggcaacgttgcctttggttcatcacctgtatgtaattcatgttacagtccacaacgcttagcacttttcggaacaagcaggccgcaggccaccaagtaaccaactcgacgttgcttgttacacaatctaggtgcatatatgtgtttgtaataaggtggctcagcaggtcatcatggctcgtcgtcggggtcgggcgacccctgggcgtcgagctggaagccatccagccngcggtcggcgagcctgctcctgta

SEQ ID NO: 4533 - DNA, 1577 bp, Zea mays
gacgccccgctgtcccgggctcccggccgcttgtttgttgtttacttctattttttttgcccgtcagccccaccgcaaccgacgcctccagtcctactcctccacccagctcgccgcttcaggaatccggagagctcgcgtcgcgcgtgcgtgggcgtgggtgcgtgcggcggcgaagcaccagcaccaccctctcgcgtcgcgcgcgcgcgcgcgtctcgatggccgacggcgagccttccctcacgcgctggaccttcgaggatttcgtggtccactacgaggcgcgcttcggcctccggcgcgaggccgacggcgacgacgcacccccgccgcgcggatccgatcatggggccagccgccccgccactgcccgcgccaacggcggcgcggacctcgccgtcttcgagcagttcgagcggatggagaggaaggtggagataagcaatggagcaatagaggatggtccactgcagaaatctctacttccttcatttgaatctgcagaaatgcgcaacttagctgagacattgttaagggatataattcgtggaagtccagatgttaaatgggaaagcataaaaggtctggagaatgcaaagcgtcttctcaaagaagcagttgtaatgccaattaaatatcccaaatacttcacaggtctattatcaccttggaaaggcatattactgtttggtccacctggaacaggaaagacaatgctagctaaagctgtggctactgagtgcaaaacaacttttttcaatatttctgcctcgtcgattgtaagcaagtggcgcggtgactcggagaaactagtgaaagtgttattcgaacttgcaaggcatcatgcaccatctactattttccttgatgagattgatgctatcattagtcaacgtggtgaagctcgtagtgaacatgaagctagccggcgattgaaaactgagctattaatacagatggatgggttgactaagacagatgagcttgtttttgttctagcagcaacaaatttaccatgggaattggatgcagcaatgctgcgtcggctggagaagcgtattcttgttccattgccagagccggatgctagacatgctatgtttgaagagctcctgccatatacacctggcacaatggagattccctatgatgttcttgtggagaaaactgaagggtattctggctctgatattcgcctggtatgcaaggaagcagcaatgcagcccctaagacgggtaatggcagttcttgaaggcaggaaagaagaggtccctgagggtgagttgcctgaagttggcccagtaactacagaagatattgaacttgctttgaggaatacaagaccgtctgcacatcttcatgcacatagatacgaaaagttcaaccaagattatggcagtcatgtacatggctaaaggggagaagcttgttgtagggtttaatttgtatgctcatgcgtgggccaataggtgactactgaattcatcgacatgctgaggtatccttgtaaacactatgcttatccttgtatgctgtacactatcattcatttgatgagcaataagctgtttggt

SEQ ID NO: 4534 - DNA, 1803 bp, Oryza sativa
ccggtagcgactacccccctctcctcctagcagttgtagcaagtccaactccaactcagcgcctccgctcctcctcacatcgccagctcgtccgcttgccccgcaccgcaaccgcggcgcggaggaggagagctctcgcgccgcgcgtgcgcgcgcgcgtgcgggcgtgcgcgggcgatcgaatccgatcgccatgaccggcgccgacgagccgtccatcacccgctggaccttcgaggacttcgaggtctactacgaggtgcgcctcggcatccgccgcgagcccgggggagatgaagacggcgacggcgacggcggcggaggtcgcggctacgcgccgcttggatccggctccgcgggcagcacccgcccctccgcggcgcacgccaacggcggcgccgacctggccgtcttcgagcagttcgagcggctggagaggaaggtggagctgcggaatggagcaattgaagctgggcctccgcagaaatccctacttccttcttttgaatctgcagaaatgcgcaatttagctgagacattgttgagggatatcattcgtgggagtccagatgtcaaatgggaaagcattaaaggtttggagaatgcaaagcgtcttctgaaagaagcagttgtgatgcctataaaataccccaagtacttcaaaggtctgctatcaccttggaaaggtatattgctttttggtccaccaggaacaggaaagacaatgctagcaaaagctgtggctactgagtgcaaaacaaccttcttcaatatttcagcctcatcaattgtcagtaaatggcgtggtgattcggagaaactagtgaaagtcttatttgagcttgcaaggcatcatgcaccatccaccatttttctcgatgagattgatgctattattagccaacgtggtgaagctcgtagtgaacatgaagccagtcggcgattgaagactgagctattaatacagatggatgggttaactaagacagatgatctcgtttttgttctagccgccacaaatttgccatgggaactggatgcagcaatgttgcgccgtttggagaaacgtattcttgttcccttaccagagcaagaagctagacatgccatgtttgaagagctcttgccatctgttcctggcacaatgaatatcccatatgatgttcttgtggagaaaactgaaggatattcaggctctgatatacgccttgtgtgcaaggaggcggcaatgcaaccccttagaaggttaatgtcggttcttgaaggaaggcaagaagaagtgcctgaggatgagttgcctgaagttggtccagtaacgacagaagacattgagcttgcactaaggaatacacggccatctgctcatcttcatgtacatagatacgaaaaattcaatcaagactatggcagtcatgtcctcagctaaaggtgagttgcaaaagcaaaggttatttgcacaacatagattgctgaatttcctccttgaagcttgaactgttccctagtattgtggaaatcctcctgacggaatcttgccgataagacttttcatttgcacctagtatggttgatagaatgctgaattaccgctgatgtatttacaactaatgagcattctctttacacaatatttgttcctgtaccatgtatattatcatttgtttgacgaataataagctatttgggtaatccttgccctttcggaatatgagagaaacattgtacatttgtactgggtaccaccaacccctgtcctcttgtccctgtttcttctatttgtggcaattaattatgctaatggac

SEQ ID NO: 4535 - DNA, 1667 bp, Oryza sativa
aagtccaactccaactcagcgcctccgctcctcctcacatcgccagctcgtccgcttgccccgcaccgcaaccgcggcgcggaggaggagagctctcgcgccgcgcgtgcgcgcgcgcgtgcgggcgtgcgcgggcgatcgaatccgatcgccatgaccggcgccgacgagccgtccatcacccgctggaccttcgaggacttcgaggtctactacgaggtgcgcctcggcatccgccgcgagcccgggggagatgaagacggcgacggcgacggcggcggaggtcgcggctacgcgccgcttggatccggctccgcgggcagcacccgcccctccgcggcgcacgccaacggcggcgccgacctggccgtcttcgagcagttcgagcggctggagaggaaggtggagctgcggaatggagcaattgaagctgggcctccgcagaaatccctacttccttcttttgaatctgcagaaatgcgcaatttagctgagacattgttgagggatatcattcgtgggagtccagatgtcaaatgggaaagcattaaaggtttggagaatgcaaagcgtcttctgaaagaagcagttgtgatgcctataaaataccccaagtacttcaaaggtctgctatcaccttggaaaggtatattgctttttggtccaccaggaacaggaaagacaatgctagcaaaagctgtggctactgagtgcaaaacaaccttcttcaatatttcagcctcatcaattgtcagtaaatggcgtggtgattcggagaaactagtgaaagtcttatttgagcttgcaaggcatcatgcaccatccaccatttttctcgatgagattgatgctattattagccaacgtggtgaagctcgtagtgaacatgaagccagtcggcgattgaagactgagctattaatacagatggatgggttaactaagacagatgatctcgtttttgttctagccgccacaaatttgccatgggaactggatgcagcaatgttgcgccgtttggagaaacgtattcttgttcccttaccagagcaagaagctagacatgccatgtttgaagagctcttgccatctgttcctggcacaatgaatatcccatatgatgttcttgtggagaaaactgaaggatattcaggctctgatatacgccttgtgtgcaaggaggcggcaatgcaaccccttagaaggttaatgtcggttcttgaaggaaggcaagaagaagtgcctgaggatgagttgcctgaagttggtccagtaacgacagaagacattgagcttgcactaaggaatacacggccatctgctcatcttcatgtacatagatacgaaaaattcaatcaagactatggcagtcatgtcctcagctaaaggtgagttgcaaaagcaaaggttatttgcacaacatagattgctgaatttcctccttgaagcttgaactgttccctagtattgtggaaatcctcctgacggaatcttgccgataagacttttcatttgcacctagtatggttgatagaatgctgaattaccgctgatgtatttacaactaatgagcattctctttacacaatatttgttcctgtaccatgtatattatcatttgtttgacgaataataagctatttgggtaatccttgccctttcggaat

SEQ ID NO: 4536 - DNA, 1497 bp, Brachypodium distachyon
ccgtcgccgccatggccgccggcgacgagccctccattacccgctggtccttcgaggacttcgagcgctactacgacgcgcgtctcgggatccgcggcgaacccaagggcgacggaaacgacgtcgatgacgaacggccgcttgggtcaggctccgccgggagtagccccgcggcgttccacgccaacggcggtgccgacctggccgtcttcgagcagttcgagcgtctgaatagaaaggtcggattgcacaacggggcaatggaggctcggccactgcagaagtccctacttcctccttttgaatctgcagaaacacgcaatttggctgagacgttgttgagggatatcattcatgggagtccagatgtcaaatgggaaagcattaaaggtttggaaactgcgaagcgtcttctcaaagaagctgttgtcatgcctataaaatatcctaagtacttcacaggtctgttatcaccttggaaaggtatattgctttttggtccaccaggaacaggaaagacaatgctagcaaaagctgtggctactgagtgcaaaacaacctttttcaatatttcagcctcatcaattgtcagtaaatggcgtggtgactcagagaaactagtaaaagtcttatttgagcttgcaaggcatcatgcaccgtctaccattttccttgatgagattgatgccatcattagtcaacgcggtgaagctcgtagcgaacatgaagccagtcggcgattgaagactgaactattaatacagatggatgggttaaccaagacccgtgagcttgtttttgttctagcggccacaaatttaccatgggaattggatgcagcaatgttacgccgattggaaaaacgtattcttgtgcccttaccagagccagaagctagacatgctatgtttgaagagttcttaccatccactcctgtaacgatggggattccctatgatgttcttgtggagaacactgaaggatattcaggctctgatatacgccttgtgtgcaaggaagcagcaatgcagccccttagacggttaatggcagttctagaaggtacacaagaagaagttcctgaggatgagttgcctgaagtaggcccaatagcggcagaagatattgaacttgctttgaggaatacacggccatctgctcatctccatacacataaatacgaaaaattcaatcaagattatggcagccatgtcatcagctaaagttgagctgcaaaagcaacagcattaccctccctagatttctgaggtgcactctgaactgttccctaagcatgtctagaactcatttctgctggagcttgttgataaaactttgtttgcacgtgatatgcaacttctgtgttccttcgcagaatgctcaattaccatccatgtatttccagctcctacgcattcctcgagtgcaatatatgtcccaccatgtacattaccatttgtttgatgagtaataagtgttgaattttgggcctgccct

SEQ ID NO: 4537 - DNA, 1515 bp, Brachypodium distachyon
cgtcgccgccatggccgccggcgacgagccctccattacccgctggtccttcgaggacttcgagcgctactacgacgcgcgtctcgggatccgcggcgaacccaagggcgacggaaacgacgtcgatgacgaacggccgcttgggtcaggctccgccgggagtagccccgcggcgttccacgccaacggcggtgccgacctggccgtcttcgagcagttcgagcgtctgaatagaaaggtcggattgcacaacggggcaatggaggctcggccactgcagaagtccctacttcctccttttgaatctgcagaaacacgcaatttggctgagacgttgttgagggatatcattcatgggagtccagatgtcaaatgggaaagcattaaaggtttggaaactgcgaagcgtcttctcaaagaagctgttgtcatgcctataaaatatcctaagtacttcacaggtctgttatcaccttggaaaggtatattgctttttggtccaccaggaacaggaaagacaatgctagcaaaagctgtggctactgagtgcaaaacaacctttttcaatatttcagcctcatcaattgtcagtaaatggcgtggtgactcagagaaactagtaaaagtcttatttgagcttgcaaggcatcatgcaccgtctaccattttccttgatgagattgatgccatcattagtcaacgcggtgaagctcgtagcgaacatgaagccagtcggcgattgaagactgaactattaatacagatggatgggttaaccaagacccgtgagcttgtttttgttctagcggccacaaatttaccatgggaattggatgcagcaatgttacgccgattggaaaaacgtattcttgtgcccttaccagagccagaagctagacatgctatgtttgaagagttcttaccatccactcctgtaacgatggggattccctatgatgttcttgtggagaacactgaaggatattcaggctctgatatacgccttgtgtgcaaggaagcagcaatgcagccccttagacggttaatggcagttctagaaggtacacaagaagaagttcctgaggatgagttgcctgaagtaggcccaatagcggcagaagatattgaacttgctttgaggaatacacggccatctgctcatctccatacacataaatacgaaaaattcaatcaagattatggcagccatgtcatcagctaaagttgagctgcaaaagcaacagcattaccctccctagatttctgaggtgcactctgaactgttccctaagcatgtctagaactcatttctgctggagcttgttgataaaactttgtttgcacgtgatatgcaacttctgtgttccttcgcagaatgctcaattaccatccatgtatttccagctcctacgcattcctcgagtgcaatatatgtcccaccatgtacattaccatttgtttgatgagtaataagtgttgaattttgggcctgcccttatataatttctgaaaaat

SEQ ID NO: 4538 - DNA, 1663 bp, Triticum aestivum
ccacgcgtccgttcactccattcactcacagcacaacgccaatccaacgctaacgcctcgcctcagctatacatcgggagctgccgcgtcgtccgtgcgtggggggaccggccgcgcacatcggagccccgccgcctcggcgagccggtccgccagacgccatggctgccggcgacgagccctccgtcacccgctggtccttccaggacttcgagcgctactacgacgcgggcctcggcatctgccgccagccccagggcgacggcgacgacgcgccgcccggatcgggctccgccgacaccgcccacgccaatggcggcgccgacctgtccgtcttcgagcaattcgagcggctggatagaaatgtcgagttgcgcaatggttcaatggatgccggaccaccgcagaaatccctgcttccttcttttgaatctgcagaaacacgcaacttagctgagacattgttgagggatatcattcgtgggagtccagatgtcaaatgggaaagcattaaaggtttggaaactgcgaagcgacttcttaaggaggcagttgtcatgcctataaagtatcccaagtacttcacaggtctgttatcaccctggaaaggtatattgctatttggtccaccaggaacaggaaagacaatgctggcaaaagctgtggctaccgagtgcaaaacaacttttttcaacatttcagcctcatcaattgtcagcaaatggcgtggtgactcggagaaactagtaaaagtcttatttgagcttgcaaggcatcatgcaccatctaccattttccttgatgagattgatgctatcattagccaacgtggtgaagctcgtagtgaacatgaagccagtcggcgactgaagactgaactattaatacagatggatgggttgactaagacagatgagcttgtttttgttctggcggccacaaatttaccatgggaactagatgcagcaatgttacgccgattggaaaaacgtattcttgtgcccttaccagaggcagaagctaggcatgctatgtttgaagagttccttccatcgactccagacacaatggagattccatatgatgttcttgtggagaacaccgaaggatattccggctctgatatacgccttgtttgtaaggaggcagcaatgcaaccacttagacggttaatggcagttctagaaggcagacaagaagaaatgccagaggatgagttgcctgaagttggcccaatagcggcagaagatatcgaacttgccttgaggaatacacggccgtctgctcatctccatgcacatagatatgagaaattcaatcaagattatggcagccatgtcattggctaaaggagcatgttgatatgacctcgtttgcaccctgtatggagctttagtattcgtcggcagaaaggataattaccatccatgtatttccagctcgtaagcattgcttgtgcataatatttattccatcatcatgtatattaccatttatatcacaagcaataagccctttgggcattcaagctctactgacttttggcttgccatccccaaacctgtggcgtcattcgttggcgtgtattttatggtgggcagcttgaagctttggtcctccgtttgttttcaagcaatgtgctcactccgattcaaaaaaaaaa

SEQ ID NO: 4539 - DNA, 1567 bp, Secale cereale
ctaaaaccaggagcgcaggttcgctcgcctgcccgccccagtgttccgtgttcctgtttgtttattcactcattcattcacaacacaacgccaacgccaacgccaacgcacctcagctacttcgggagctgccgcgtcgtccgtgcgtgggggaccggccgcgcaccgccgcctcggtgagccggcccaccggacgccatggctgccggcgacgaaccctccgtcacccgctggtccttccaggacttcgagcgctactacgacgcgggcctcggcatctgccgccagccccagggcgacggcgacaacgacggcgacgacgcgccgcccggatcgggctccgccgacaccacccacgccaacggcggcgccgacctatccgtcttcgagcacttccagcagatggatagaaatgttgagttgcgcaatggggcaatggatgccgggccaccgcagaaatccctgcttccttcttttgaatctgccgaaacacgcaacttagctgagacattgttgagggatatcattcacgggagtccagatgtcaaatgggaaagcattaaaggtttggaaactgcgaagcgacttcttaaggaggcagttgtcatgcctataaagtatcccaagtacttcacaggtctgttatcaccctggaaaggtatattgctatttggtccaccaggaacaggaaagacaatgctggcaaaagctgtggctaccgagtgcaaaacaacttttttcaacatttcagcctcctcaattgtcagcaaatggcgtggtgactcggagaaactagtaaaagtcttatttgagcttgcaaggcaccatgcaccatctaccattttccttgatgagattgatgctatcattagccaacgcggtgaagctcgtagtgaacatgaagccagtcggcgattgaagactgaactattaatacagatggatgggttgactaagacagatgagcttgtttttgttctggcggccacaaatttaccttgggaactagacgcagcaatgttgcgccgattggaaaaacgtattcttgtgcccttaccagagccagaagctaggcatgctatgtttgaagagttccttccatcgactccagacacaatggagattccgtatgatgttcttgtggagaacactgaaggatattctggctctgatatacgccttgtttgtaaggaggcagcaatgcaaccacttagacggttaatggcagttctagaaggcagacaagaagaaatcccagaggatgagttgcctgaagttggcccaatagcggcagaagatatcgaacttgccttgaggaatacacggccgtctgctcatctccatgcacatagatatgagaaattcaatcaagattacggcagccatgtcatcggctaaaggagcatgttgatatgacctcgtttgcaccctgtatggagctttagtattcgtcggcagaaaggatcattaccatccatgtatttccagctcgtaagcattgcttgtgcataatatttattccatcatcatgtatattaccatttatatcacaagcaataaacccttt

SEQ ID NO: 4540 - DNA, 1503 bp, Avena sativa
gtcgcgtgcgcgggggcccgtcgacctgcccgcgtgaccccgctcgccgccatggccgccgccgacgagccctccattacccgctggtccttcgaggacttcgagcgctactacgacgcgggcctcggcatccgccacgcgcccaagggcgacggagacgacgatgacgacgaggcgccgctaggatcaggcttcgccgacgtcgcccgcgccaacggcggcgctgacctggcagtcttcgagcagtacggccggctggatagaaatatcgagttccgtaatggggcaatggacgctgggccgccgcagaaatctctacttccttcttttgaatctgcagaaacacgcaacttagctgagacattgttgagggatattattcgcgggagtccagatgttaaatgggaaagcattaaaggtttggaaactgcgaagcgccttcttaaagaagcagttgtcatgcctataaagtatcccaagtacttcacaggtctgttatcaccttggaaaggcatattgctttttggtccaccaggaacaggaaagacaatgctagcaaaagctgtggctactgagtgcaacacaacctttttcaacatttcagcctcatcaattgttagcaaatggcgtggtgactcggagaaactagtgaaagtgttatttgagcttgcgaggcatcatgcgccatctaccatttttcttgatgagattgatgcaattattagccaacgtggtgaagctcgaagcgaacatgaagccagtcggcgattgaagactgaactattaatacagatggatgggctgactaagacagatgaacttgtttttgttcttgcggccacaaatttaccatgggaactggacgcagcaatgttacgccgattggaaaaacgtattcttgtgcccttaccagaatcagaagctagacaagctatgtttgaagagttcctaccatcttctcctaacacaatggaggttccgtatgatattcttgtggagaacactgaaggatattcaggctctgatatacgccttgtgtgcaaggaggctgcaatgcaaccccttagacggataatggcagctctagaaggcgcacaagaattagtgcctgaggatgatttgcctgaagttggcccagtaacggcagaagatattgaacttgctttgaggaatacacggccatctgctcatctccatgcacatagatacgagaaattcaatcaagattatggcagccacgtcctcagctaaaggtagcaaatgggagtatatacccgccttagatatttctaaggtgctctttggactgttccctaagcatgtctagaagcctgttgatacgatttcaattgcaccgtatatggaacctaagtgttagttgggtactgtacttaccatccatgtatttccagctcataagcattcactgtgtacgatgtttgctccatcatgtacattaccatttgtttgagaagtaataagctctccgggtatttaaatagg

SEQ ID NO: 4541 - DNA, 1509 bp, Avena sativa
gtcgcgtgcgcgggggcccgtcgacctgcccgcgtgaccccgctcgccgccatggccgccgccgacgagccctccattacccgctggtccttcgaggacttcgagcgctactacgacgcgggcctcggcatccgccacgcgcccaagggcgacggagacgacgatgacgacgaggcgccgctaggatcaggcttcgccgacgtcgcccgcgccaacggcggcgctgacctggcagtcttcgagcagtacggccggctggatagaaatatcgagttccgtaatggggcaatggacgctgggccgccgcagaaatctctacttccttcttttgaatctgcagaaacacgcaacttagctgagacattgttgagggatattattcgcgggagtccagatgttaaatgggaaagcattaaaggtttggaaactgcgaagcgccttcttaaagaagcagttgtcatgcctataaagtatcccaagtacttcacaggtctgttatcaccttggaaaggcatattgctttttggtccaccaggaacaggaaagacaatgctagcaaaagctgtggctactgagtgcaacacaacctttttcaacatttcagcctcatcaattgttagcaaatggcgtggtgactcggagaaactagtgaaagtgttatttgagcttgcgaggcatcatgcgccatctaccatttttcttgatgagattgatgcaattattagccaacgtggtgaagctcgaagcgaacatgaagccagtcggcgattgaagactgaactattaatacagatggatgggctgactaagacagatgaacttgtttttgttcttgcggccacaaatttaccatgggaactggacgcagcaatgttacgccgattggaaaaacgtattcttgtgcccttaccagaatcagaagctagacaagctatgtttgaagagttcctaccatcttctcctaacacaatggaggttccgtatgatattcttgtggagaacactgaaggatattcaggctctgatatacgccttgtgtgcaaggaggctgcaatgcaaccccttagacggataatggcagctctagaaggcgcacaagaattagtgcctgaggatgatttgcctgaagttggcccagtaacggcagaagatattgaacttgctttgaggaatacacggccatctgctcatctccatgcacatagatacgagaaattcaatcaagattatggcagccacgtcctcagctaaaggtagcaaatgcgagtatatacccgccttagatatttctaaggtgctctttggactgttccctaagcatgtctagaagcctgttgatacgatttcaattgcaccgtatatggaacctaagtgttagttgggtactgtacttaccatccatgtatttccagctcataagcattcactgtgtacgatgtttgctccatcatgtacattaccatttgtttgagaagtaataagctctccgggtatttaaataggaaaaaa

SEQ ID NO: 4542 - DNA, 1800 bp, Hordeum vulgare
ctcactcctctcctccccgtcggactccgacggtttggtgaaaaaacaagagcgcagattcgcttgcctgcccgctcccgtgctccgtgctcttgtttgtttattcacaacacaacaccaacgccatcgcctccgtctcgcctcagctacttcgggagctgtcgcgtccctgcgtgctgcgtggggaccggccgcatacgccatggctgccggcgacgagccctccgtcacccgctggtccttccaggacttcgagcgctactacgacgcgggcctcggcatctgccgccagcccaagggcgacggcgacggcgacagcaacgacgacgcgccgcccggatcgggcgccgccgatgccgcccacgccaacggcggcgccgacctctccgtcttcgagcactacgagcggatggatagaaatgttgagttgcgcaatggggcaatggatgccgggccaccgcagaaatccctacttccttcttttgaatctgcagaaacacgcaacttagctgagacattgttgagggatatcattcgtgggagtccagacgtcaaatgggaaagtattaaaggtttggaaactgcgaagcgacttcttaaggaggcagttgtcatgcctataaaatatcccaagtacttcacaggtctgttatcaccctggaaaggtatattgctatttggtccaccaggaactggaaagacaatgctggcaaaagctgtggctaccgagtgcaaaacaacctttttcaacatttcagcctcatcaattgtcagcaaatggcgtggtgactcggagaaactagtaaaagtcttatttgagcttgcaaggcatcatgcaccatctaccattttccttgatgagattgatgctattattagccaacgcggtgaagctcgtagtgaacatgaagccagtcggcggttgaagactgaactattaatacagatggatgggttgactaaaacagatgagcttgtttttgttcttgcggccacaaatttaccatgggaactagacgcagcaatgttacgccgattggaaaaacgtattcttgtgcccttaccagaggcggaagctaggcatgctatgtttgaagagttccttccattgactcgagacacaatggagattccatatgatgctcttgtggagaacaccgaaggatattccggctctgatatacgccttgtttgtaaggaggcagcaatgcaaccacttagacggttaatggcagttctagaaggcagacaagaagaaatcccagaggatgagttgcctgaagttggcccaatagcgacagaggatatcgaacttgctctgaggaatacacggccgtctgctcatctccatgcacatagatatgagaagttcaatcaagattatggcagccatgtcctcagctaagctaaaggtgggcagcaaaatcagtaccgccttagatatctctaaagcatgtctagaacgtctttttttgcaggagcatgttgatatgacctcgtttgcaccctgtagtgttcgtcggcagaaagcataattatcatttatgtatttccagctcgtacgcattgctcacgcacaatatttgttccatcatcatgtatattaccgtaccatttatatctcaagcaataagccctttgggtattcaagctttagcgactcttggtttactagtgtcttaatgataggtttttatctgcaaattcaggataattattttatcccggtttgtcttttagtttccacgagtgttgcttattgtaacttgtttttcgattaatgaagcatgtggttctctc

SEQ ID NO: 4543 - DNA, 1196 bp, Zea mays
ccacgcgtccggtcctactcctccacccagctcgctgcttccggaatccggagagctcgcgtcgcgcgtgcgcgggcgtgggtgcgtgcggcggcgaagcaccagcaccaccctctcgcgtcgcgcgcgcgtctcgatggccgacggcgagccttccctcacgcgctggaccttcgaggatttcgtggtccactacgaagcgcgcttcggcctccggcgcgaggccgacggcgacggcgacggcgatggcggcgacgccccctgccgtgtggatccgatcatggggcagccgccccgccactgcccgcgccaacggcggcgcggacctcgccgtcttcgagcagttcgagcggatggagaggaaggtggagataagcaatggagctatagaggatggtccactgcagaaatctctacttccttcatttgaatctgcagaaatgcgcaacttagctgagacattgttaagggatataattcgtggaagtccagatgttaaatgggaaagcataaaaggtctggagaatgcaaagcgtcttctcaaagaagcagttgtaatgccaattaaatatcccaaatacttcacaggtctattatcaccttggaaaggcatattactgtttggtccacctggaacaggaaagacaatgctagctaaagctgtggctactgagtgcaaaacaacttttttcaatatttctgcctcgtcgattgtaagcaagtggcgcggtgactcggagaaactagtgaaagtgttattcgaacttgcaaggcatcatgcaccatctactattttccttgatgagattgatgctatcattagtcaacgtggtgaagctcgtagtgaacatgaagctagccggcgattgaaaactgagctattaatacagatggatgggttgactaagacagatgagcttgtttttgttctagcagcaacaaatttaccatgggagttggatgcagcaatgctgcgtcggctggagaagcgtattcttgttccattgccagagccggatgctagacatgctatgtttgaagagctcctgccatatacacctggcacaatggagattccctatgatgttcttgtggagaaaactgaagggtattctggctctgatattcgcctggtatgcaaggaagcagcaatgcagcccctaagacgggtaatggcagttcttgaaggcaggaaa

SEQ ID NO: 4544 - DNA, 570 bp, Amorphophallus konjac
cggtgatcgtagcacgtgaagaaacacatcgagcagggaagatctgagagagcgggggaggggcctcgatcgccaaatctagggtttctccgagggccgaccgccatgggattctgggtgacgaccctcatcttcgtcctagccggcttcatcgcctccctctgcgccctgatctgctgcagccggggcccctccaccaatctatttcacctgacattgattattacggcagcggtttgttgttggatgatgtgggcaattgtctacctcgctcagatgaagccattaattgttcctatcctcagcgaaggagaatgaggagctcgtcagggatgaacttgcttttcaccttttatcataaacgagaattatgcagtgtggatcagcttatatgtactccaagctgtacccatccccgtatagtatgtattttttgctgtctgatgttcatattcctgggacaaactagagtacgctgctgcttcagggactctctgtgccagagactcgtcgttgattcattttgtatcacgctgatatcttattttctggagacctatctcattattt

SEQ ID NO: 4545 - DNA, 3388 bp, Oryza sativa
ctgcaccctctctcaataaatgcgattgcatccgctcaacactcgccccccctctcgcaataactcctcctccccatctccacattcctcccccaaatcccctcttcttcttcttcttcttcttcctcctcctcccatggcgatcggcgtctgcttctagctggagagatctcgcttcgtttcgagctgtccaccggtggttttctcgcatgcgatatcacacgcttcttggaagcacatcagagttcttggtgctgaccttgccctagatctgcttctgactgttgctgttacgtggcgtgcaagctagctatagccatttctgtgtgtgtagctgtactggtggtgaagaagaagatgcaagcgaatgggtggaggagctagaggcttggctggaggaagaagaagaaggggttggtggtggctagctagctagggtgcgtgcttaattacctggcttcgttcatgacgccggcgaggcgcatgccgccggtgatcggccggaacggcgtggcgtacgaatcgccgtcggcgcagctgcccctcacccaggctgatatgctggacagccatcatctgcagcaagcactccagcagcaatacttcgatcagatcccggtgacgacgacggcggcggcggacagcggcgacaacatgctgcacggccgcgccgacgccggcgggctggttgacgagttcgagagcaagtcgtgcagcgagaacgtcgacggcgccggcgacggcctctccggcgacgaccaggaccccaaccagcggccgcgcaagaagcgttaccaccgccatacccagcaccagatccaagagatggaagctttcttcaaggagtgcccgcacccagacgacaagcagcgcaaggagctgagcagggagctgggtcttgaacctctgcaggttaaattctggtttcagaacaagcgcacacagatgaagaaccagcacgagaggcacgagaacgcgcagctgcgggcggagaacgacaagctgcgcgcggagaacatgcgatacaaggaggccctgagcagcgcgtcgtgccccaactgcggcggccccgccgccctcggcgagatgtccttcgacgagcaccacctccgcgtcgagaacgcccgcctccgcgacgagatcgaccgcatctccggcatcgccgccaagcacgtcggcaagccccccatcgtctccttccccgtcctctcctccccgctcgccgtcgccgccgcccgctcccctctcgacctcgccggcgcctacggcgtcgtcacccccggcctcgacatgttcggcggcgccggcgacctcctccgcggcgtgcacccgctcgacgccgacaagcccatgatcgtggagctcgccgtcgccgccatggacgagctcgtccagatggcccagctcgacgagccgctctggtcgtcgtcgtcggagccggcggcggcgttgctcgatgaggaggagtacgcgcgcatgttcccgcgcggcctcggccccaagcagtacggcctcaagtcggaggcgtcccgccatggcgccgtcgtcatcatgacgcacagcaacctcgtcgagatcctcatggatgtgaatcaattcgcgacggtgttctcgagcatcgtgtcgagagcgtccacgcacgaggtgttgtccacaggcgtggcaggcaactacaatggtgcactgcaagtgatgtcaatggagtttcaagtgccgtcgccgctggtgccgacgagggagagctatttcgtcaggtactgcaagaacaactccgacgggacatgggccgtcgtcgatgtctctctcgacagcctccgccccagccctgtccagaaatgccggcgcaggccgtctggctgcctcatccaagaaatgcccaatggctactccaaggtgacatgggtggagcatgtggaggtggacgacagctcggtgcacaacatctacaagccattggtgaactccggcctcgcattcggcgcgaaacggtgggtcggcacgctggaccggcaatgcgagcgcctcgccagcgccatggccagcaacatccccaatggcgaccttggagtgattacaagcgtggaggggaggaagagcatgttgaagctggcggagaggatggtggcgagcttctgcggcggcgtgacggcgtcggtggcgcaccagtggacgacgctgtcgggcagcggggcggaggacgtgcgcgtcatgacgaggaagagcgtcgacgaccccggcaggccaccgggcatcgtgctcaacgccgccacctccttctggctccccgtccctcccgccgccgtcttcgacttcctccgcgacgagacctctcgcagcgagtgggacattctgtccaacggcggcgccgtccaagaaatggctcacattgccaacggccgtgaccatggcaactctgtctcgcttcttcgtgtcaatagtgcaaattcaaaccagagcaacatgctgatcctgcaagagagctgcacggacgcgtcgggctcctacgtggtgtacgcgccggtggacatcgtggcgatgaacgtggtgctcaacggcggcgacccggactacgtggcgctgctgccgtcggggttcgccatccttcccgacgggccgtcggggaacgcgcaggccgccgtcggggagaacggctccggctccggcggggggtccctcctgacggtggcgttccagatcctcgtcgactccgtgccgacggcgaagctctcgctgggctccgtcgcgacggtgaacagcctcatcgcctgcacggtggagcgcatcaaggccgccgtctgcagggacagcaaccctcagtagtagcaccggcttcaaccaaatatgatcacgaacaatgttccaaggagcagcaaaattttggagtttgattcagcagtagggagtcaagaacgcacctcaaactctccttgccatgtggtgcccttgctagtgaagaatttgcgaggaaaccgacgcgtttgcgagaaaattttcgcgaagatacatagtgtcaccactatgcaaggggggatggttcgggcattgacttccaccttttgattttcatcaaatgcatcgaagagtggatgctgctaccttgttgtttttctgaatctctatgttagggcttcttttaccatgtttaaaaagggctatgaagcctcatttttatctgtactgttgtgatgtgttgtctgtttgttcagacttcaggttcctgtcccttagctaggagttgagaatagagagattcatgtccccccttttggattttatcacatttccgatgatttgtagacttgtggttgttgcttgttggtcattaccattcttgtctcaaatgtgcctgcttttgtgtgtgtgtgtgtgtgtgtgtgtgtgtgtgtgt

SEQ ID NO: 4546 - DNA, 3327 bp, Oryza sativa
aataaatgcgattgcatccgctcaacactcgccccccctctcgcaataactcctcctccccatctccacattcctcccccaaatcccctcttcttcttcttcttcttcttcctcctcctcccatggcgatcggcgtctgcttctagctggagagatctcgcttcgtttcgagctgtccaccggtggttttctcgcatgcgatatcacacgcttcttggaagcacatcagagttcttggtgctgaccttgccctagatctgcttctgactgttgctgttacgtggcgtgcaagctagctatagccatttctgtgtgtgtagctgtactggtggtgaagaagaagatgcaagcgaatgggtggaggagctagaggcttggctggaggaagaagaagaaggggttggtggtggctagctagctagggtgcgtgcttaattacctggcttcgttcatgacgccggcgaggcgcatgccgccggtgatcggccggaacggcgtggcgtacgaatcgccgtcggcgcagctgcccctcacccaggctgatatgctggacagccatcatctgcagcaagcactccagcagcaatacttcgatcagatcccggtgacgacgacggcggcggcggacagcggcgacaacatgctgcacggccgcgccgacgccggcgggctggttgacgagttcgagagcaagtcgtgcagcgagaacgtcgacggcgccggcgacggcctctccggcgacgaccaggaccccaaccagcggccgcgcaagaagcgttaccaccgccatacccagcaccagatccaagagatggaagctttcttcaaggagtgcccgcacccagacgacaagcagcgcaaggagctgagcagggagctgggtcttgaacctctgcaggttaaattctggtttcagaacaagcgcacacagatgaagaaccagcacgagaggcacgagaacgcgcagctgcgggcggagaacgacaagctgcgcgcggagaacatgcgatacaaggaggccctgagcagcgcgtcgtgccccaactgcggcggccccgccgccctcggcgagatgtccttcgacgagcaccacctccgcgtcgagaacgcccgcctccgcgacgagatcgaccgcatctccggcatcgccgccaagcacgtcggcaagccccccatcgtctccttccccgtcctctcctccccgctcgccgtcgccgccgcccgctcccctctcgacctcgccggcgcctacggcgtcgtcacccccggcctcgacatgttcggcggcgccggcgacctcctccgcggcgtgcacccgctcgacgccgacaagcccatgatcgtggagctcgccgtcgccgccatggacgagctcgtccagatggcccagctcgacgagccgctctggtcgtcgtcgtcggagccggcggcggcgttgctcgatgaggaggagtacgcgcgcatgttcccgcgcggcctcggccccaagcagtacggcctcaagtcggaggcgtcccgccatggcgccgtcgtcatcatgacgcacagcaacctcgtcgagatcctcatggatgtgaatcaattcgcgacggtgttctcgagcatcgtgtcgagagcgtccacgcacgaggtgttgtccacaggcgtggcaggcaactacaatggtgcactgcaagtgatgtcaatggagtttcaagtgccgtcgccgctggtgccgacgagggagagctatttcgtcaggtactgcaagaacaactccgacgggacatgggccgtcgtcgatgtctctctcgacagcctccgccccagccctgtccagaaatgccggcgcaggccgtctggctgcctcatccaagaaatgcccaatggctactccaaggtgacatgggtggagcatgtggaggtggacgacagctcggtgcacaacatctacaagccattggtgaactccggcctcgcattcggcgcgaaacggtgggtcggcacgctggaccggcaatgcgagcgcctcgccagcgccatggccagcaacatccccaatggcgaccttggagtgattacaagcgtggaggggaggaagagcatgttgaagctggcggagaggatggtggcgagcttctgcggcggcgtgacggcgtcggtggcgcaccagtggacgacgctgtcgggcagcggggcggaggacgtgcgcgtcatgacgaggaagagcgtcgacgaccccggcaggccaccgggcatcgtgctcaacgccgccacctccttctggctccccgtccctcccgccgccgtcttcgacttcctccgcgacgagacctctcgcagcgagtgggacattctgtccaacggcggcgccgtccaagaaatggctcacattgccaacggccgtgaccatggcaactctgtctcgcttcttcgtgtcaatagtgcaaattcaaaccagagcaacatgctgatcctgcaagagagctgcacggacgcgtcgggctcctacgtggtgtacgcgccggtggacatcgtggcgatgaacgtggtgctcaacggcggcgacccggactacgtggcgctgctgccgtcggggttcgccatccttcccgacgggccgtcggggaacgcgcaggccgccgtcggggagaacggctccggctccggcggggggtccctcctgacggtggcgttccagatcctcgtcgactccgtgccgacggcgaagctctcgctgggctccgtcgcgacggtgaacagcctcatcgcctgcacggtggagcgcatcaaggccgccgtctgcagggacagcaaccctcagtagtagcaccggcttcaaccaaatatgatcacgaacaatgttccaaggagcagcaaaattttggagtttgattcagcagtagggagtcaagaacgcacctcaaactctccttgccatgtggtgcccttgctagtgaagaatttgcgaggaaaccgacgcgtttgcgagaaaattttcgcgaagatacatagtgtcaccactatgcaaggggggatggttcgggcattgacttccaccttttgattttcatcaaatgcatcgaagagtggatgctgctaccttgttgtttttctgaatctctatgttagggcttcttttaccatgtttaaaaagggctatgaagcctcatttttatctgtactgttgtgatgtgttgtctgtttgttcagacttcaggttcctgtcccttagctaggagttgagaatagagagattcatgtccccccttttggattttatcacatttccgatgatttgtagacttgtggttgttgcttgttggtcattaccattcttgtctcaaa

SEQ ID NO: 4547 - DNA, 3166 bp, Sorghum bicolor
cttcccccctccaaaccatggcgtcttcttcttcctcctccccgagatctcgccgtgctccttctcccgccttctgctagctgcgtgcgagcacggccggaccgctggtttccgcggcttcctgcatgcgatatcgccgacaatctttggaagaagggcatcatcacaggccgggatcgaagaatatgaaagctgatgatagagagcacgagctagggtttgggaggcactagctaggaccgtgtgctgccattgttcatgacgccggcgaggcgcatgccggcgatgatcggtcggaatggcatggcgtttgggtcctcgtcggcgctgtctttaagccaggctgacctcctagacagccatcacctgcagcaagcgttccaacagcaactctttgatcagatcccagccaccgcagtggatagcagcgacaacatcatccatggtcgctccgacacgctggtagatgaatttgagagcaagtcctgcagtgagaatcctgatggcacctctggcgatgatggccaggaagaccccaaccagcggccaaacaagaagaagcggtatcaccgccacacccagcaccagatccaagagatggaggcgttcttcaaggagtgcccacacccggatgacaagcagagaaaggagctcagccgggagctcggcctcgagccactgcaggtcaagttttggttccagaacaagcgcacacagatgaagaaccagcatgagcggcaggagaacgcgcagctgcgcgcagagaatgacaagctgcgagctgagaatatgcggtacaaggaagcactcggcacagcctcctgccccagctgtggcggccctgccgccctcggtgagatgtcctttgacgagcaccacctccgtctcgagaacgctcgcctccgtgatgagattgaccggatttcgggcatcgctgccaagcacgtcggcaagcccatggtctccttcccggtgctctccagcccacttgctgctgctgccgcccgatccccacttgaccttgctggtgcctacggcgtccagcctggtggcctcggtgccgaccacctattcggtgttggagctggtgccggtgatctgctgagaagcgtgtcaaccggccagctcgacgctgacaagcccatgattgtagagctggccgttgctgccatggatgagctcctccgaatggcgcggcttgatgcgccgctgtggggtgggggcgtggcaggcgtgcagctggacgaggaggagtatggccggatgttcccgggtgggctcgggccgaggcagtacgggcttcgtccggaggcatctcgagacaatgccgtcgtgatcatgacacgcgatagccttgttgagatactcatggacgcgaaccgattcgctgcagtgttctcaagcattgtgtcgagggcttctacacacgaggtgttgtcaactggtgtggcagggagctataatggtgcattacaagtgatgtcaatggagttccaggtgccatcaccactggtgccgacgagggagagctactttgtgaggtactgcaagaacaatcccgatggaacgtgggctgttgttgatgtctcgctcgacagcctccgtcctagccctgttatgaagtgccggcgcaggccatcaggatgccttatccaagaaatgcccaatggctactcaaaggtgacctgggtggagcacgttgaggttgatgacagatcagtgcacaatctctacaggcctttggtcaattcaggcctcgcatttggtgcaaaaaggtgggttggcacactggaccgacaatgcgagcgccttgccagtgccatggccagcaacatccccaacggcgacctcggtgtgatcacaagcatagaggggaggaagagcatgctgaagctagctgagaggatggtggcgagcttctgcggcggcgtgacagcatctgccgcacatcagtggacaacattgtcagggagtggtgcagaggacgtccgtgttatgaccaggaagagcgtggacgacccgggcaggccgccgggcatcgtcctcaatgccgccacctccttctggctacccgtcccacccaagagggtctttgatttcctccgcgatgagacctctcgcagcgagtgggacatcctatccaacggtggtgctgtccaagaaatggctcatattgccaacggccgggaccatggcaactgtgtctcccttcttcgtgtcaatagtgcaaactcgaaccagagcaacatgctgatcctccaggagagctgcaccgacgcatctggctcgtatgtggtgtacgcaccagtggacgtggtggcaatgaacgtggtgctcaatggcggggacccagactacgtggccctactgccatcgggcttcgctatcctccccgatggaccacccggcatggctccccatggagagggtgccgccttggagactggcggtggttccctcttgacggtggcgttccagatcctggtggactccgtgcctactgcaaagctctccctgggctctgtagcaactgtgaacagcctcatcgcctgcaccgtggagcgcatcaaggctgccgtctgcgtggaaggcaacccacagtagccttccatccatatgatctcgaggaggggggcagcaaggttttggggaaatattagtggggagtcaagaacgcacctcagactctccttgccatgtggtgctcatactgcaagcgaaaattcagttcgttaggaaaaagaaggcgtcaccactatgcaaggggggatggttcgggtattgacttccccgttgatcaagtctactacagaaaggatgctgcggagaagatgctgtttctggatctctttcaatatttttagggtttccatttgctgctgtgtacttcgtcatgttcgtggtgtcgccgttgttcaggctaaggtgcctgtgcctgctcgtagctagagaacagagatttgttgcgtctttttttttttggatttgcaaagatttgtagaatctaggatcaatcatttcataaccaatgcttggctaaaacgtgcccgttgttgtttgtagctttttgctatttaaaacgatgcaatttcaatctctgagttgctagcttcttgttttcagagaaatttcaaaacgaaaagagcaagggtttccatccactgga

SEQ ID NO: 4548 - DNA, 3326 bp, Sorghum bicolor
ctctgactctctctcctctcgctgctgcctgagcaataacgctgcaccctctctcaataaatgcgtttgcatccatccgctctccactcccccagctcgcaataactccttcctccccatctccacattctcccatctgccgttccccttcccccctccaaaccatggcgtcttcttcttcctcctccccgagatctcgccgtgctccttctcccgccttctgctagctgcgtgcgagcacggccggaccgctggtttccgcggcttcctgcatgcgatatcgccgacaatctttggaagaagggcatcatcacaggccgggatcgaagaatatgaaagctgatgatagagagcacgagctagggtttgggaggcactagctaggaccgtgtgctgccattgttcatgacgccggcgaggcgcatgccggcgatgatcggtcggaatggcatggcgtttgggtcctcgtcggcgctgtctttaagccaggctgacctcctagacagccatcacctgcagcaagcgttccaacagcaactctttgatcagatcccagccaccgcagtggatagcagcgacaacatcatccatggtcgctccgacacgctggtagatgaatttgagagcaagtcctgcagtgagaatcctgatggcacctctggcgatgatggccaggaagaccccaaccagcggccaaacaagaagaagcggtatcaccgccacacccagcaccagatccaagagatggaggcgttcttcaaggagtgcccacacccggatgacaagcagagaaaggagctcagccgggagctcggcctcgagccactgcaggtcaagttttggttccagaacaagcgcacacagatgaagaaccagcatgagcggcaggagaacgcgcagctgcgcgcagagaatgacaagctgcgagctgagaatatgcggtacaaggaagcactcggcacagcctcctgccccagctgtggcggccctgccgccctcggtgagatgtcctttgacgagcaccacctccgtctcgagaacgctcgcctccgtgatgagattgaccggatttcgggcatcgctgccaagcacgtcggcaagcccatggtctccttcccggtgctctccagcccacttgctgctgctgccgcccgatccccacttgaccttgctggtgcctacggcgtccagcctggtggcctcggtgccgaccacctattcggtgttggagctggtgccggtgatctgctgagaagcgtgtcaaccggccagctcgacgctgacaagcccatgattgtagagctggccgttgctgccatggatgagctcctccgaatggcgcggcttgatgcgccgctgtggggtgggggcgtggcaggcgtgcagctggacgaggaggagtatggccggatgttcccgggtgggctcgggccgaggcagtacgggcttcgtccggaggcatctcgagacaatgccgtcgtgatcatgacacgcgatagccttgttgagatactcatggacgcgaaccgattcgctgcagtgttctcaagcattgtgtcgagggcttctacacacgaggtgttgtcaactggtgtggcagggagctataatggtgcattacaagtgatgtcaatggagttccaggtgccatcaccactggtgccgacgagggagagctactttgtgaggtactgcaagaacaatcccgatggaacgtgggctgttgttgatgtctcgctcgacagcctccgtcctagccctgttatgaagtgccggcgcaggccatcaggatgccttatccaagaaatgcccaatggctactcaaaggtgacctgggtggagcacgttgaggttgatgacagatcagtgcacaatctctacaggcctttggtcaattcaggcctcgcatttggtgcaaaaaggtgggttggcacactggaccgacaatgcgagcgccttgccagtgccatggccagcaacatccccaacggcgacctcggtgtgatcacaagcatagaggggaggaagagcatgctgaagctagctgagaggatggtggcgagcttctgcggcggcgtgacagcatctgccgcacatcagtggacaacattgtcagggagtggtgcagaggacgtccgtgttatgaccaggaagagcgtggacgacccgggcaggccgccgggcatcgtcctcaatgccgccacctccttctggctacccgtcccacccaagagggtctttgatttcctccgcgatgagacctctcgcagcgagtgggacatcctatccaacggtggtgctgtccaagaaatggctcatattgccaacggccgggaccatggcaactgtgtctcccttcttcgtgtcaatagtgcaaactcgaaccagagcaacatgctgatcctccaggagagctgcaccgacgcatctggctcgtatgtggtgtacgcaccagtggacgtggtggcaatgaacgtggtgctcaatggcggggacccagactacgtggccctactgccatcgggcttcgctatcctccccgatggaccacccggcatggctccccatggagagggtgccgccttggagactggcggtggttccctcttgacggtggcgttccagatcctggtggactccgtgcctactgcaaagctctccctgggctctgtagcaactgtgaacagcctcatcgcctgcaccgtggagcgcatcaaggctgccgtctgcgtggaaggcaacccacagtagccttccatccatatgatctcgaggaggggggcagcaaggttttggggaaatattagtggggagtcaagaacgcacctcagactctccttgccatgtggtgctcatactgcaagcgaaaattcagttcgttaggaaaaagaaggcgtcaccactatgcaaggggggatggttcgggtattgacttccccgttgatcaagtctactacagaaaggatgctgcggagaagatgctgtttctggatctctttcaatatttttagggtttccatttgctgctgtgtacttcgtcatgttcgtggtgtcgccgttgttcaggctaaggtgcctgtgcctgctcgtagctagagaacagagatttgttgcgtctttttttttttggatttgcaaagatttgtagaatctaggatcaatcatttcataaccaatgcttggctaaaacgtgcccgttgttgtttgtagctttttgctatttaaaacgatgcaatttcaatctctgagttgctagcttcttgttttcagagaaatttcaaaacgaaaagagcaagggtttccatccactggagaccggatcggag

SEQ ID NO: 4549 - DNA, 2427 bp, Panicum virgatum
gaacaagcgcacacagatgaagaaccagcatgagcgacaggagaacgcgcagctgcgcgcggagaacgacaagctgcgtgccgagaacatgcggtacaaggaggcgctcagcacggcctcctgccccagctgcggtggccctgctgccctcggcgagatgtcctttgatgagcaccacctccggctcgagaatgcccgcctccgcgacgagattgaccggatctctggcatcgctgccaagcatgttggcaagcccatggtctctttcccagtgctctccagcccgcttgccgccgccgcagcccgctccccactggacgttgttggtgcgttcgggtcggccggccttggccccgtcgaccccttgttcggtgttggcaccggtgcaggagagctgttgaggagcgtgtcaaccggccagctcgatgctgacaagcccatgatcgtggagctggccgtcgccgcaatggatgagctcctacggatggcccggctggacgcaccgctgtggagcaccggcgcggcaggggcacagctcgacgaggaggagtacggccggatgttcccaggcgggctcgggccaaggcagtacgggctacggccggaggcatcacgcgatggcgctgtggtgatcatgacgcgtgacagcctcgttgagatactcatggacgtgaaccgatttgctgctgtgttctcgagcattgtgtcgagggcttcgacgcacgaggtgctgtcaactggtgtggcagggagctataatggtgcattgcaagtgatgtcaatggagtttcaggtaccgtcgccgctggtgccaacacgagagagctactttgcaaggtactgcaagaacaacccagacgggacgtgggctgttgttgatgtctcgcttgacagcctccgccctaaccctgtcttgaagtgccggcgcaggccgtccggctgccttatccaagaaatgcccaatggctactcaaaggtgacctgggtggagcatgttgaggtcgatgacaggtcagtgcacaatctctacaggcctttggtgaattcagggcttgcgtttggtgcaaaacggtgggttggcaccctggaccgacaatgtgagcgccttgccagcgccatggccagcaacatccccaacggtgaccttggtgtgatcacaagcatagaagggaggaagagcatgcttaagctggcagagaggatggtggcgagcttctgcggtggcgtgacagcgtccgctgcacaccagtggacgacgctctcgggcagtggtgctgaagatgtgcgtgtcatgaccaggaagagcgtggatgaccctggcaggcccccaggcatcgtgctcaacgctgctacctccttctggctcccagtcccgcccaagagggtctttgacttcctccgtgatgagacctctcgcagcgagtgggacattctctcaaatggtggtgctgtccaagaaatggctcacattgccaatggccgggaccatggcaactgcgtctcccttcttcgtgtcaatagtgcaaactcgaaccagagcaacatgctgatcctgcaggagagctgcactgacgcgtcggggtcctacgtcgtgtacgcgccggtggatgtggtggcgatgaacgtggtgctgaacggcggtgacccggattacgtggccctgctgccgtcgggcttcgcaatcctccccgacggaccacctggtgcttctccccatggagagataagtgccggcttggaggccggcggtggatccctcctgactgtggcgtttcagatcttggtggactcagtccccacagccaagctctcactgggctctgtcgccaccgtgaacagcctcatcgcctgcaccgtggagcgcatcaaggccgccgtctgcgcggaaggcccacagtagccatccatatgatttcaaggaagggagcagctagatttttggagaattcatcatttgggagtcaagaacgcacctcagactctccttgccatgtggtgctcatactgctagtgttcaagaaaccttgcgaaaacgtcgcggaaagggaggcggtcaccactatgcaaggggggatggttcgggtattgacttccccgtcgattctactacagaatggatgctgctgagatgatgctagctatgtcgtctgggtctctttccataatgttagggttttcgattcgccgctgtgtaccgtgtcatgtttgtgctgttgctgttgttcaggctaaggtgcctgcctgcatgctgctggtagctagagaacagagatttgttgtctctctttttttggatttgcaaagatttgtagaatctaggtgttcggtcataaccaatcctgagctaaaacctgcctgtcgttgcttgtagctttttcgctattgaaacattgcaatttcgatttctttgtgtttcttgttggtcct

SEQ ID NO: 4550 - DNA, 3467 bp, Zea mays
cctcccttctccacattctcttccacctccgcccgttcccctttcctctcctcctcttcctcctcctcctcgcctccccttccatggccgcctatagcttctcaagctagtctcctcccggcttatctcgccacctcctgctagctacccttctgagcttgcaaagtttttgctgcacgcacgccttgagagctgcatgcagccagagatcgatcggagttctatttttgcataggcacacgaacatatgtagctcttctgctagatctcactgccagtcgtcagctcgcagcgaaggttgtctgggctaccttgtcgatcgctagatctgttgttggtcgtgttgttacttggcaggcaaggtatacatctccatataggaataggattggcgccgcctgttctttgtccgtgaggcgggagatagatactacgcatgtgccagtgaacaaatggaaagaagctactgaggcggcaggaattagggttcgagaggttctgagagggagaaatgatgatcccggcgaggcacatgccgccgatgatcgtccggaacagcgccgcggcgtatgggtcctcgtcggcgctttcgctcggccagccaaacctcctgctggacaaccagcagctccagctactgcagcagcaacacctgctggaccagatcccggcgacgacggcggagagcggcgacaacatggggcgcggcggcggcggggtgtccgacccgctgctgggcgacgagttcgagagcaagtccggcagcgagaacgtggacggcggcgtctccgtggacgagctgcaggaccccaaccagcggcccagcaagaagaagcgctaccaccgccacacccagcaccagatccaggagttggaagctttcttcaaggagtgcccgcacccggacgacaagcagcgcaaggagctgagccgggagctggggctggagcccctccaggtcaagttctggttccagaacaagcgcacgcaaatgaagaaccatcacgagcggcaggagaactcgcagctgaggtccgagaacgagaagctgcgcgccgagaacatgcggtacaaggaggccctgagcagcgcgtcgtgccccagctgcggcgggccggccgcgctcggcgagatgtccttcgacgagcaccacctccgcgtggagaacgcgcggctgcgggaggaggtcgacaggatctcctccatcgccgccaagtacgtgggcaggcccatggtgcccttccccgtgctgtccagcccgctggccggggccggggcacgcgcccccgcgttgccgccgctggacatggcgccgccgtatggcgctgccgctgacatgttcggcggcggcggtgtcgtcgctgctgctggtgctgccggtgccggggacctgctgctgaggggcgccgccgtgcagtcggacgccgacaagcctatgatcgtggagctggccgtggcggccatggaggagctggttcggatggcgcagctggacgagccgctgtggaacgcgcccgcggggctcgatgggtccgctgaggaggagacgcttaacgaggaggagtacgcgcgcttgttccccggcgggctcgggcccaagccgtacgggctcaactcggaggcgtcgcgtgacagcgccgtcgtcatcatgacccatgccaacctcgtcgaaatcctcatggacgtgaaccagtatgcggccgtgttctcgagtatcgtgtcgagagccgcgacgctggaggtgctatcaaccggcgtggctgggaactacaatggtgcattgcaagtgatgtcggtggagtttcaggtgccttccccactggtgccgaccagggaaagctacttcgtgaggtactgcaagcagaacgccgacggaacatgggccgtcgtcgacgtctcgctggacggcctgcgccccggcgcagtcctcaagtgccggcgccggccgtcgggatgcctgatccaggaaatgcccaatggctactcgaaggtgacctgggtggagcacgtcgaggtggacgacaggtcggtgcacagcatctacaagctgctggtgagctcggggctggccttcggtgcacgccgatgggttgggacgctggaccgccagtgcgagcgccttgccagtgtcatggccagcaacatcccgaccagcgacatcggtgtgatcactagcgcggaggggaggaagagcatgctgaagctggcggagaggatggtgatgagcttctgcggcggcgtgacggcctctgcggcgcaccagtggacaacgctgtccggcagcggcgctgaggacgtccgcgtcatgaccaggaagagcgtcgacgaccctggcaggccgcccggcatagtcctcaacgctgccacctcgttctggctccccgtcccgcccaagcgtgtcttcgacttcctccgtgacgaaagctctcgcagcgagtgggacatcctctccaatggcggcgttgttcaagagatggctcacatcgccaacggccgcgaccatggaaactgcgtctcgcttcttcgtgtcaatagcacgaactcgaaccaaagcagcatgctgatcctccaggagagctgcaccgacatgtcgggctcgtacgtcatctacgccccggtggatgtggtcgccatgaacgtggtcctcaacggcggcgaccctgactacgtggcgctcctgccctctggcttcgcgatcctgcccgacggcccatcgtcagggagcagcagcatgctgcaaggcgacggcggcgtcggctcaggtgggtcgctcctgacggtggccttccagatactcgtcgactctgtccccaccgccaagatctcgctggggtcggtggccacggtgaacagcctcatcgcctgcaccgtggagcgcatcaaggcggcggtgatctccggccagagcaatccccagcagcagtagcttcgttgaatccaacagtgttcttatcctttgcattgaaggagcagcaaaattttagagctttcgtcagtgggaagtcaagaacgcacctcagactctcctgcttgccatgtggtgctcatagttccctttactttttcgcctagtttcccccaaaatttctggggttatttcaagaaacacttcagtcgccgaaggaaacgagtcaccacgacgcaagggtagttggttcgggtattgacttcctcttcatgttggcctctcggatgctgcttcctctgaatttaggcttcttctcttgtggtgtacaaaaccgttatttagcatgtaatttgtgctgctgctgctgctgcacctgttcagacttgttcagtatccaggattcccccaatagagatttgtgtcccttaatacctctgcacagtgcttgtgtctagccgccatttcagtcccaaaaatgtgcctgtgtaacgcggttgcatgcttgcattattgttcaatgtcttcgttgctattttgcagctttaagttcacaattaat

SEQ ID NO: 4551 - DNA, 2269 bp, Secale cereale
gactcatccatccatcccccctcgcccctcctcgttcctccctactactactcactaggtgagcgacagcgagagacgacacaggagggacgagacgaggcacaccacctatcccgtccaggacatccatccctcccaacccagctttgaccgggctgctcccttccctttccctccgccgtcagtccagtccaccgtcacctcccccgcttccgcgtgcgtgcgtgcgcctatcatcaccctcctcgccccctttcccgtcgcttccttcctttcctgcccggatcggacccacggctgccgccgccgctgctgctcgggtttcccctcgtcgccggcggccggccgtcgccagcaccgcacccaagttgcagcagcgatgaggtgcctgccgttcctgcacggggacgccaaggaggaggaccggcgcacgggccccagcgccgccatgtcggcctcggtgcgctccttcagcaccgagtccacggagcgcggcgaccgctccgacctcaactccatcaacgtctccgacatgagcgccgagtccatccgccggacgcactaccccagcttcaccgaccgccccgccaacctccgggtcttcaccttccccgagctcaaggccgccaccgcaacttcagccgctccctcatggtcggcgagggcggcttcggctgcgtctaccggggcgtcatcaagggctccgacgacgaccccaacgagcgcgtcgagatcgccgtcaagcagctcaaccgcaagggaggtccagggggcagaaggaatggttaacagagatgaacgtgcttgggattgttgagcaccccaacctgggtcaaactaataggttactgcgctgacgacgatgagcgggggatgcagcggcttctggtgtacgaatacatgcccaacggaagcgtggatgaccacttggcaagtaggtcaacctcaactctgtcatggccaatgagactgaaagtggctctcgatgctgcccgcgggctcaagtatctgcatgaggagatggactttcaggttattttccgagacctgaaaacatctaacattctactagatgagaactggaatgcgaaactgtcggacttcggattggctaggcatggaccacaggaagggctatcccatgtctccacagcggttgttggaactctaggatacgccgcgccggaatacatgcaaacggggcgcctgacagcaaaaagcgacatatggggctacggcgtgctcctctacgagctcatcaccggccgccgtcccatcgaccggaaccgcccgaagggcgagcagaagctcctggactgggtgaaaccgtacatctccgacgtcaaacggttccccatcatcgtcgacccgcggctcgagggccactacaacctcaagtccatgacgaagctggccggcgtggcaaaccgctgcctactccggctacccaagtcgcgcccgaagatgagcgaggtgtatgaaatggtgcagaagatcgtcgacagcgtcgagatcggcccgccggagccacccctgcactaccacggctcggtgtccgggccgggcgcgaagcggaccaagaaagggtcgctgaagaggaggctccaggagttcaaattcggctgccgccagatcgtgtggcggggctggaaacctgagatcattaagacctgctgaaatggatgccaccaccctcctgcctgccttcctgtgactggaaatgattcagaatcaggcaagatgtgacctgaaccagtggattgcgggttgcggccgaccgaccaatcggaggatgcgccttatctcgagttgggctgccgaatgatccgaatatctgatgctgggtggcacaggtacattcctgccggccatcctttttgctcagataagacccagacccagatgctcacatcagaaagagacccctttgtacaactgggagaatttcctggtgctagcacatacataggggaggctacaagtcagctcgatgtttcgatcagactgtctacatgattgttcatttgtttccagtaaatagatgatgataaaatctccaccgcaaataatctagcaaaggtcaatccggtaccgaattttcgccggagaaaaagagttcctggtgccggtctaattctgctgtccccctgtagctgtagcctgtagtattttactgctggctggaagcaaaggggccttgttgtttcggacaaaaacaaaaaaaaaaaaaaaagaaaactagagactcgacagacacagaggaggaggg

SEQ ID NO: 4552 - DNA, 1881 bp, Secale cereale
tgagcgacagcgagagacgacacaggagggacgagacgagacgcacaagccgtcccgtccaggacatccatcccaagtcccaacccagctttgaccgggctgctcccttccctttccctccgccgtcagtccagtccaccgtcacctcccccgcttccgcgtgcgtgcgtgcgcctatcatcaccctcctcgccccctttccccgtcgcttccttcctttcctgcccggatcggaccccgacgcctcctccgccccctgctcccgctgctgccgggattccccctcgtcgcaggcggcccgccgtcgcgacccaccgcgcccaagttgcagcagcagcgatgaggtgcctgcccttcctgcacggggacgccaaggaggaggaccggcgcacgggccccagcgccgccatgtccgcctcggtgcgctccttcagcaccgagtccacggagcgcggcgaccgctccgacctcaactccatcaacgtctccgacatgagcgccgagtccatccgccggacgcactaccccagcttcaccgaccgccccgccaacctccgggtcttcaccttccccgagctcaaggccgccacccgcaacttcagccgctccctcatggtcggcgagggcggcttcggctgcgtctaccggggcgtcatcaagggctccgacgacgaccccaacgagcgcgtcgagatcgccgtcaagcagctcaccgcaagggagtccaggggcagaaggaatggttaacagaaatgaacgtgcttgggattgtagagcacccaaacctggtcaaactaataggttactgcgcggacgacgatgagcgggggatgcagcggcttctggtgtacgaatacatgcccaacggaagcgtggatgaccacttggcaagtaggtcaacctcaactctgtcatggccaatgagactgaaagtggctctcgatgctgcccgtgggctgaagtatctgcatgaggagatggactttcaggttattttccgagacctgaaaacgtctaacattctactagatgagaactggaatgcgaaattgtcggacttcggattggctaggcatggacctcaggaggggctatcccatgtctccacagcggttgttggaactctaggatatgccgcgccggagtacatgcaaaccgggcgcctcaccgcgaaaagcgacatatggggctacggcgttctcctctacgagctcatcaccggccggcgtcccatcgaccggaaccgcccaaagggcgagcagaagctcctggactgggtgaaaccgtacatctccgacgtcaagcggttccccatcatcgtcgacccgcggctcgagggccactacaacctcaagtccatgacgaagctggccggcgtggcgaaccgctgcctcctccggctacccaagtcgcgaccgaagatgagcgaggtgtatgaaatggtgcagaagatcgtcgacagcgtcgaggtcggcccgcctgagccgcccctgcactatcacggctcggtgtccgggccgggcgcgaagcggaccaagaaagggtcgctgaagaggaggctccaggagttcaagttcggctgccgccaaatcgtgtggcggggctggaaacctgagatcataaagacctgctgaaatggatgccaccaccctcctgcctgccttcctgtgactgtaagtatagttgttcatatagagatataaagttggtaaccggtgcgcggtttgcgctgcagcgtgtaacttttttggtcctgtagatttctgctgtttgtgtgctactctggtctgagctgcaagattgtgaatcagtaggtcgtttgtgtttttggtccagttccagctcttccatcttgtgaactctactaaccttgtttgtgca

SEQ ID NO: 4553 - DNA, 1594 bp, Brachypodium distachyon
agagatggggtgcttggctttcttgcatggggagagcaaagaggagcgtcctgccccaaaatcggcctccgtgcgctccttcagcacgacatccacggaacgcgaagtcccatctggctctgacctcacctccatgaacatctctgacatgagtgcggagtcaataaggaggacgcagtaccccagcttcactgaccggcccagcaacctcagggtgttcaccttttctgagctcaagaatgccacccgcaacttcagccggtcgctcatggttggtgagggtgggtttgggtgcgtgtacaggggaatcatcaagaattctgatgaaccgaatgagcggattgagatcgctgtgaagcagttgaatcgcaaaggagttcaggcaagttttttcaccatcttgtactgctcaacagtagtttggcagtattgttttcagggcttgcttttaaaattgggcagaaggaatggttaacagaaatgaatgtgcttgggattgtcgagcatccaaacctcgtcaaactaataggttactgcgctgacgatgatgagcggggaatgcaacggcttctagtatacgagtacatgcctaatggaagcgtggatgaccacttggcaagtaggtcaacttcaactctatcatggccaatgagactaaaggtagctctcgatgctgctcgggggctgaagtatctgcacgaagagatggattttcaggttattttccgagacctgaaaacatctaacattctattagatgagaactgggatgcaaaattgtcagactttggattggctaggcatggaccacaggaaggtctaagccatgtctccacagcggtcgttggaacgctaggatatgcagcgccggagtacatgcagactggacgcctcactgcaaaaagcgacatgtggagctatggcgtactcctctatgagctcatcactggccgccgtcctatcgacaagaaccgcccaaagggcgagcagaagctcctggattgggtgaaaccatacatctctgatgtcaaaaggtttcccatcattgtagacccacggcttgagggacactacaacctcaagtccgtgacaaagttggccgctgtggcgaaccgctgcctcgtccggctaccaaagtcacggccaaagatgagcgaggtgtacgagatggttcagaagatcgttgacagcattgagactggcccaccacaacctcctctgcactaccatggctctgtttctgaacctggcgcgaagcgaacaaagaaaggatctctgaagagaaggttccaagaattcaaatttggttgccgccagattgtatggcgtggctggaagcctgagattataaagacttgctgaaaggacagtaatacctgcctgtaattatagttgtccatatgggtgcaccatttagttgcagcgtgcgactttttgtcctctagttttctgtgtaatccatcttgttttgtgtatgacaatctgagctacaagcaagatggtggtcaataggttgtttgtatttttgatgcaacatcagtcttcctgtcttacaaactcttcgatagccaaataccgactttatttatgcaaa

SEQ ID NO: 4554 - DNA, 2151 bp, Sorghum bicolor
gagagagatagagcggactgcaataaatttgtcgcgtccggcgatccatctcccacctctgccctgacctcccttccctcgtgctcctcccgtcacgctcatctctactccccgtgacgaccaggaaggaattcttcttcctccgtcctcgccccgtcgtcttctcacctgcgtgctgcgttcgcggacaaacttcttggttggtgacactgcggagcccgagcctcagcctcgcaggaggagacggagagcggaggagcgggaggagaaagccacctttcttcccgtttcagacaagctcccagctttgaccgccgttgctgctgctgctgctaccgtgtgctccctgagtccctgttgcgtcccggatcggagttcccctccgcacgggacaccgccgggccgggcgtctccactcccctcggatcgatcagccccccccaccgccgccgcaagataggcaagcaatgaagtgcctgcctttcttgcatggagatgccaaagagaaggatcctgtcactaagtcggcctctgtacggtccatgagcacaacatcaacggagcgcgatgtccgctccggttctgacttcacctccttgaatgtttccgacatgagtgccgagtcaataaggaggacacagtaccccagcttcactgaccgcccgcctaatctgagggtgttctcctttgctgaactgaagagtgccacccgcaacttcagccggtctctcatggttggcgagggtggctttggctgtgtgtacaggggtgtcatcaagaactctgacgaaccgagtgaacgaattgagattgctgttaagcagttgaatcgtaaaggacttcaggcaagtgttttcaccatcttatgttttcttttttttttccctagaatatgtatgagaactgcatatctttgtatcaggggcagaaggagtggttaacagagatgaatgtgcttggaattgtggaccatccaaacctagttaaactaataggctactgtgctgatgatgatgagagaggagtacaacggcttctagtgtatgaatatatgcctaatggaagtgtggatgatcacttgtcgagtaggtcaacttctactctgtcatggccaatgagactaaaagtagctcttgattctgcccggggactgaagtatctgcatgaagaaatggaattccaggttattttccgagatctgaaaacatctaacattttgttggatgaaaactgggatgctaaattatcagactttggtttggctaggcatggaccggcagaaggtctgacccatgtctccacagcggtagttgggactctaggctacgcagctccagagtacatgcagactggacgcctcaccgcgaagagcgacatatggagctacggcgtccttctgtacgagctcatcacaggccgccgccccatcgacaagaaccgtccaaagagcgagcagaagcttctggactgggtgaaaccatacatatctgacgtgaaacggttccccatcatcgtcgacccacggttggaagggcactacaacctcaagtccatgacgaagctgtctagcgtggcgaaccggtgcctggtccggatgcccaagtcccgcccaaagatgagcgaggtgtacgacatggtccagaagatcgtggacagcatcgggaccgggccgccgcagcccccgctgctgcactaccgtggctcggcctctgacccggccaccaagcgcgccaagaaagggtctctgaggacgaggctccgggagtttgggctcggctgccggaacatcgtgcagcggggctggaaagcctgagatcgtgaagaacctctgagtgagtctgaggaggcgcggcgtggctccggtggtgctgtaagtacagtagctgttcatagagacggtggtaacagttccaccgtgtagtgcttggttggtatagagtgagttgatgcagatgcatgcataccagttgagaaagacaaggtgcacagttgagtggtggcgttcgtgtagagtagtgctgtgtctgtgtaattcacctggttttgactcctgtggttaacacaatgtgtgagctgcgatatggtgagctatagggggggcccttgtgttttcagtgcaattttttctgctgcctcttcgtcttcttgaga

SEQ ID NO: 4555 - DNA, 1052 bp, Pennisetum glaucum
gctgaattgaagagtgccacacgcaacttcagccggtcactcatggttggcgagggtggctttggctgtgtttacaggggcgtcatcaagacctctgacgaacctaatgaacgtattgagatcgctgttaagcagttgaatcgtaaaggacttcaggggcagaaggagtggttaacagagatgaatgtgcttggaattgttgaccatccaaacctggttaaactaataggctactgtgctgaagatgatgagcgcggagtacaacggcttctagtctatgaatatatgcctaacggaagtgtggatgatcacctgtcgagcaggtcagcttcaactctatcatggccaatgagactaaaagtagctcttgattctgcccggggactgaagtatctgcatgaagaaatggaattccaggttattttccgagatctgaaaacatccaacatcctgctggatgagaactggaatgctaaattatcggactttggtttggctaggcatggaccaacggaaggtctgacccatgtctccacagcggtcgtaggaactctaggctatgcagcgccagagtacatgcaaaccgggcgcctcactgcaaagagcgacatatggagctacggcgttctcctgtacgagctcatcacggggcggcggcccatcgaccggaaccgcccgaagagcgagcagaagctgctggagtgggtgaagccgtacgtcggggacaagaagcggttccccatcatcatcgacccgcggctggaggggcactacaacctcaagtccatgctgaagctgtcgagcgtggcgaaccggtgcctcgtccggatgcccaagacgcggccgaagatgagcgaggtgtacgagatgatccagaaggtcgtggacagcgtcgagacggggccgccgcagccgcccctgcactaccacggcagctcggcggcggcgtcgggcgcgggtggtggtaagcggaccaagaaagggccgctgaagaggaggctccaggagttgaagttgtggtggcggggggtggaagccttgaggtggtgaag

SEQ ID NO: 4556 - DNA, 1826 bp, Brachypodium distachyon
gttcccgttcgcgtgcatccagcaggaattgaacccgcaaatttaccaattatgagttgggcgctttaaccattcagccatggatgcttaacagggatcatcctacatcgtaaataaccaattttcatatagaaagacatatcatagaaaaatgaaatcgaaaatattcggagatggcaaatattcggagatgactatgaaaacacctctctggatcctcgaattgaaagagagattgagagggatcaagaatcctaattctctctatttggaatggatccaattctattgagtctgactcatagtgatcatttctctttagcaaagaatgaccttggttatcaaaggattgaacaaccgggatccatttacttatgatacctagttggcattgataacaaggatctaatgaattatgagtttaatagatcctctttagcagaaagacgtatattccttgctcattatcagacaatcacttattcccaaacctcgtgtggggctaatcgttttcatttaccatctcatggaaaacccttttcgttccgcttagccctatcgggtattttagtgataggttctataagaactggacgatcctatttggtcaaatacctaacgaaaaattacgattttcctttcattaaggtacgagggcttcttattccacaagaacgaaagcaccttttcattctttcatatactaggggtttttacttagaaaagacaatgttccatactaaaagattcgggtgcataaccacgagttccagtgcactagatcttgtagcacttagcaacgaggccctatccattagtattccacataagaaatccattatagaaaaaaatacaattagattaactcttcatagacaaacttgtggtttgcgagccaaggtaagatcggctcgggatcatgggacctttttctatcagataggaggggctcttgtacaaaatagacttataagtaataaccccatagaatcaatctatctatataaagaggcgatcgtgtcaggaagcgggtttttctttggccaaaaggtacttcgaacttggaacgagcatgaagagattaacgagacttctttctcttttgcgtttttatggcggacctgccgcgcaagatctttggtcttcccctggaaccgatgaaaaaaagtggatcgcttcttatggactcgctcagaatgattcttctctatctatagttcatggcctattagaagtagaaggtgctctggtgcaatccttaccgacagaaaaagattgcagtcaggttgataataatcgagtgccattacttcgtcggtccgaaccaaggaatccgttagaaatgttttgaaatggatattgttctctctttgatcagggattgctatatgaaaagaagtggagtttgaaaaggggaacggaatggtcaaaccggaactgctagaggaacgaattttcaatagcataacttgggctcctagaatatggcgcccttgggacaatccatttgattgcagggttttgttccgaagcaaagatatccgcggaggccagttcgttcgtcctattctgatattcaggaccaagaggtactggattctctttcggataggccctgaaaggagaagaaaggctgaaatgccaacggacctctgtctattctctaattcacccgagccgatagtacccgtttttggaacgtccagtgccaaagtcactgaatgggtaagtcaccaatccaacccctttgacaaatcgggtgtcatattagatatcatattctatatatatagaaatatcatagaatagacatacataatttttgg

SEQ ID NO: 4557 - DNA, 5224 bp, Brachypodium distachyon
ccgcaattgcaaaggtaataactactatgccagcccaaatcatgatcttcaccaacttggatttggttctctcgctaaaatcgcgagttgcagagatgagaatcatgaaaagcaagatcccgaataagaaaacagaaaccgaggaaaccacaagagtgaagactagtagagtctcgtcttttgtcattctttgctcctttttcactcaatgattctttctaatttccagaccaaaaattctatatgtctattctatgatatttctatatatatagaatatgatatctaatatgacacccgatttgtcaaaggggttggattggtgacttacccattcagtgactttggcactggacgttccaaaaacgggtactatcggctcgggtgaattagagaatagacagaggtccgttggcatttcagcctttcttctcctttcagggcctatccgaaagagaatccagtacctcttggtcctgaatatcagaataggacgaacgaactggcctccgcggatatctttgcttcggaacaaaaccctgcaatcaaatggattgtcccaagggcgccatattctaggagcccaagttatgctattgaaaattcgttcctctagcagttccggtttgaccattccgttccctttttcaaactccacttcttttcatatagcaatccctgatcaaagagagaacaatatccatttcaaaacatttctaacggattccttggttcggaccgacgaagtaatggcactcgattattatcaacctgactgcaatctttttctgtcggtaaggattgcaccagagcaccttctacttctaataggccatgaactatagatagagaagaatcattctgagcgagtccataagaagcgatccactttttttcatcggttccaggggaagaccaaagatcttgcgcggcaggtccgccataaaaacgcaaaagagaaagaagtctcgttaatctcttcatgctcgttccaagttcgaagtaccttttggccaaagaaaaacccgcttcctgacacgatcgcctctttatatagatagattgattctatggggttattacttataagtctattttgtacaagagcccctcctatctgatagaaaaaggtcccatgatcccgagccgatcttaccttggctcgcaaaccacaagtttgtctatgaagagttaatctaattgtatttttttctataatggatttcttatgtggaatactaatggatagggcctcgttgctaagtgctacaagatctagtgcactggaactcgtggttatgcacccgaatcttttagtatggaacattgtcttttctaagtaaaaacccctagtatatgaaagaatgaaaaggtgctttcgttcttgtggaataagaagccctcgtaccttaatgaaaggaaaatcgtaatttttcgttaggtatttgaccaaataggatcgtccagttcttatagaacctatcactaaaatacccgatagggctaagcggaacgaaaagggtttccatgagatggtaaatgaaaacgattagccccacacgaggtttgggaataagtgattgtctgataatgagcaaggaatatacgtctttctgctaaagaggatctattaaactcataattcattagatccttgttatcaatgccaactaggtatcataagtaaatggatcccggttgttcaatcctttgataaccaaggtcattctttgctaaagagaaatgatcactatgagtcagactcaatagaattggatccattccaaatagagagaattaggattcttgatccctctcaatctctctttcaattcgaggatccagagaggtgttttcatagtcatctccgaatatttgccatctccgaatattttcgatttcatttttctatgatatgtctttctatatgaaaattggttatttacgatgtaggatgatccctgttaagcatccatggctgaatggttaaagcgcccaactcataattggtaaatttgcgggttcaattcctgctggatgcacgcgaacgggaacgttccataagtttattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcaggattcactaagacagaaataaagcattgggtcgaactcttctttggtgttaaggtagtagctgtgaatagccatcgactacccggaaagggtagaagaataggacctattctgggacatacaatgcattacagacgtatgatcattacccttcaaccgggttattctattccacttctagatagagaaaaaaactaaaggagaatacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactactgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagaccttaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagagtaggacgggttattcacatttaatttgatggtcagaggcgaattgaaagctaagcagtggtaattaagacccccggggaaaaaagggatgtctcctacgttacccataatatgtggaagtatcaacgtaatttcatagagtcattcgatctgaatgctacatgaagaacataagccagatgacggaacgcggagacctaggatgtagaagatcctaacatgagcgattcggcagatttggattcctttcctatatatccactcatgtggtacttcatcatatgatttatataagatccatctgtctagagatcgtcatatacatctagaaagccgtatgctttggaagaagcttgtacagtttgggaaggggttttttgagagaaaagaagaatctacttcaaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcattttttgcatttgcaataatgcgatgggcgaacgacgggaattgaacccgcgcatggtggattcacaatccactgccttgatccacttggctacatccgccccttatccagctacaggatttttctcttttttccattcatcattattctatttattctgacctccatacttcgatcgagatattggacatagattgccgctctttaaaaaggaaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccccaatggttggccatacaatcgcgattcataatggaaaggaacatatacctatttacataacaaatcctatggtaggtcgcaaattgggggaattcgtacctactcggcatttcacgagttatgaaaatgcaagaaaggatactaaatctcgtcgttaactgaattcagaatagaaagattcagaataaaaaaaagatgcaaagtaaagaaatacccaatatcttggtagaacaagatattgggtatttctcgctttcttttcttcaaaaattcttatatgttagcggaaaaaccttatccattaatagcgggaacttcaagagcagctagatctagagggaagttgtgagcattacgttcgtgcattacttccataccaagattagcacggttgatgatatcagcccaagtattaataacgcgaccttgactatcaactacagattggttgaaattgaatccatttaggttgaacgccatagtactaatacctaaagcagtgaaccagattcctactacaggccaagcagccaagaagaagtgtaaagaacgagagttgttgaaactagcatattggaagattaatcggccaaaataaccatgagcagccacaatattataagtctcttcctcttgaccaaatttgtaaccctcattagcagattcattttcagtagtttccctgatcaaactagaggttaccaaggaaccatgcatagcactgaatagggaaccgccgaaaacaccagctacacctaacatgtgaaatggatgcataaggatgttgtgctctgcctggaatacaatcataaagttgaaagtaccagatattcctaa

SEQ ID NO: 4558 - DNA, 916 bp, Brachypodium distachyon
agaaaaaaatacaattagattaactcttcatagacaaacttgtggtttgcgagccaaggtaagatcggctcgggatcatgggacctttttctatcagataggaggggctcttgtacaaaatagacttataagtaataaccccatagaatcaatctatctatataaagaggcgatcgtgtcaggaagcgggtttttctttggccaaaaggtacttcgaacttggaacgagcatgaagagattacgagacttctttctcttttgcgtttttatggcggacctgccgcgcaagatctttggtcttcccctggaaccgatgaaaaaaagtggatcgcttcttatggactcgctcagaatgattcttctctatctatagttcatggcctattagaagtagaaggtgctctggtgcaatccttaccgacagaaaaagattgcagtcaggttgataataatcgagtgccattacttcgtcggtccgaaccaaggaatctgttagaaatgttttgaaatggatattgttctctctttgatcagggattgctatatgaaaagaagtggagtttgaaaaagggaacggaatggtcaaaccggaactgctagaggaacgaattttcaatagcataacttgggctcctagaatatggcgcccttgggacaatccatttgattgcagggttttgttccgaagcaaagatatccgcggaggccagttcgttcgtcctattctgatattcaggaccaagaggtactggattctctttcggataggccctgaaaggagaagaaaggctgaaatgccaacggacctctgtctattctctaattcacccgagccgatagtacccgtttttggaacgtccagtgccaaagtcactgaatgggtaagtcaccaatccaacccctttgacaaatcgg

SEQ ID NO: 4559 - DNA, 2824 bp, Secale cereale
ccaagcccggaccctccccgtccaaggccgccgccgccgccgccgcccagatggacttctccaccccgtccaagcccgcgcccacgcccacgaccacgcccaggcgcaagtccaagcccgtgccctacgcgccgccgccgcccgcgtctccggcgacgccctccgccgtccgcaggtcgagccgcctcctcgacacccccaccaaggacctctcggaggccgccctcttcgagacgcccgccaagcccaagcccgcgcccgcgcccaccctcaagcggaagcgggccgcgccgtctccgtcccccaagaccccgagccgggccgagcccaagcccaagcggcagcggcgggcgccgacgaagcgggccttctaccgcaaggtggtgtacgacggcggggagttcgccgccggggacgacgtctacgtcaagcggctggagggggccgagtcggacgccgaggacccggaggagcccgaggactgccgcgtctgcttccgcgccggcggcggggtcatggtggagtgcgacgcctgcctcggcggcttccacctgcgctgcgtgcgcccgccgctgcgccgcgtgccggagggggactgggcgtgcccctactgcgaggccgagcgtgaggggagggcgatggacaggcccaagccgcccgtcgggaagaagatcaagaggactgccaaggagaagcttctcgacagtgatttatgggctgcacgcattgagagcttaaggagggagccagatggagcattctgggcaaaggtgaggtggtatactattcctgaagagaccgcagcaggaaggcagccacataatttgcggagggagctctatcgtaccaatgctcttggagacattgagatggaaagtatcgttaggcattgttatgtcatgagccccaaagagtatagggatgccgctaatgacggagatgatgtattttattgtgaatacgagtatgatgtacattggcataattttaagcgtctggcagatattgatgatgaacctgagacaaaagaagatcccagtgacgagccttacaatgctgccaatgattataacagtgataccgatgaagattcagaatacgacgaggaggatgaaccagttgcacgttgctcagccagaaagaaccaacctaatgataaaattttggctgctaattcatggaaagggaggatatatggcctgcaaaagattggaatccgaaaaatacctgagcatgttcggtgtcatcagaagactgctctggagaaggcgaaggctaccctgttattggctactcttcccaagtcattgccttgcagggataaagaaatggaggagatctctacatttgtgaaggatgcaatttgcaatgaccattgtctaggacgctgcctttatattcatggtgtgcctggtactggcaagactatgagtgtacttgcagtcatgaggaggttgagatctgaatttgattctggagctctgaggccctattgttttatagaaatcaatggtctaaaattagcttctccagagaatatctacaaggttatatatgaacaattgagtgggcatagggtgggatggaaaaaagctcttcattatttaacagagcacttttcagatggcaagaaaattggaaagcaagcaaaccagccaattgttttgctcatcgatgagcttgatctccttttgacaagaaatcagtcggtgctgtataacattcttgattggcccaccaagccaaattcaaacctagttattataggtatagcaaacacaatggatcttccagaaaaactgttgcctcgtatctcaagtaggatgggtattcaacggctgtgttttggcccctataattatcggcaactgcaggaaatcataacaagccgtcttaagggtatcaatgcctttgaagatcaagctattgagttcgcttctagaaaggtagctgctatgtctggtgatgctaggcgggccttggaaatttgtagacgcgcagcagagtttgcagactaccgtgttaaacaatttcaacaggctgagcagactccctcttctgcaaatacaggaaatggttttgtttgcatgggtgacatagaagacgctattcaagaagtctttcaggcaccacatattcaagtaatgaagaattgcccaaaatttggaaaagttatactggctgctatggtccacgaattatacagaagtggcctaggtgaagtattgtttgataagctggcagcgactgttttctcttggtgccatgtcaacagagaactattgcccggatacgatactctcctgaaaatctgttgcaagcttggtgagagcaagatcgttctctgcgaggaaggcaccaagcataagttgcagaagctgcagctcaactacccaagcgacgatgtgacctttgccctcaaggagtccccagatcttccttggctgtccaagtacctctaaatctcatacctgcagtggccaaatttcccagcacccgcattgcattcctgcttctcttggggagcaacagccctgcctacatgtataaaacttagaaaacaagagccaaaaatcctgctgatctctggagctgattgccggcaccaattgcatattggttgtcatgtaaaccaagaactcagccatgtgttgcatcagatgcatcttagtttccatctcaggaaaaaaaaagtctcagttgtgcgtcgaagttgtaagatgtgaaaaaacttgtgtttcccgattttcgccgcatttgtggaacttgtgtgggaccgtgctgtaatgttgtcattgcactctcatttgagctcgtactactg

SEQ ID NO: 4560 - DNA, 2982 bp, Brachypodium distachyon
ctgccgaaccctaactccgttcatcccattcccatcatccccctccattcaaatccacaccgtaccgttgccccgccaccctccccgcctccggcgagccacccaaatggatctctccgccacgcctaccagatccaaatccaagcccagatccactccgtcgaagaccatcgccgcctccgccgccgcccagatggacttgtccaccccgtccaagcccacgaccagacggaagtccaaatctgtgtcctcgccgccgtcgattgccccggcgacgccttccaccgtccgcaggtcccgccgactcctagagaccccaacccgccgcctcctagagaccccaaccaaggacctcgtggagaccccggcgaagccagcgcctgcgcccacgctcaagcggaagcgggctgcgccgtcgcccaaaaccccgatccaggccgagcccaagcgccagaggcggctcccgaagaagaaggcgcattaccggaaggtggtgtatgacggaggggagttcgctgctggagacgatgtgtacgtcaagcggcgggagggggcggagtcggacgaggaagaacctgaagaggaggagtgccgtgtgtgcttccacgccggtggtgaggtgatggtggagtgtgacgcgtgcctgggggggttccacctgcgatgtgtgcggccgccgctgcgccgtgtaccggagggggattgggcgtgcccgtactgtgaggctgagcgggcggggagggcgatcgagaggcccaagcagcccgtggggaagagtatcaggaggacagcgaaagagaagcttctctccagcgatttatgggctgcacgcattgagagtttatggagggaaccagatggaacattctgggcaaaggtaaggtggtatactattcctgaagagactgcagcaggacggcagccacataatttacggagagagctttaccgtaccaatgatcttgcagacattgagatggaaactatccttagacattgttacgtcatgagccccaaagagttcagggatgctagtaatgaaggagatgatgtattttattgtgaatatgagtatgatgtacattggcataactttaagcgtctggcagatattgatgatgaacctgagacacaagaagatcccagtgacgagccgtacaatgctggtaatgattataatagtgataccgatgaagattcagaatttgaggaagaggatggaccggctaaacgttgctctgccagaaaaaatcagtcccatcaatttgctgctaattcacggaaagggaggatatatggcctacaaaagattgggatccgaaagatacctgaacatgttcggtgtcatcaaaagactgatctggagaaggcaaaagctaccctgttactcgctactcttcccaagtcgttgccttgcagggataaagaaatggaggagatatcgacatttgtcaaagatgcaatttgcaatgaccaatgtctaggacgctgcctttatattcatggtgtgcctggtactggcaagactatgagtgtacttgcagtcatgaggaggctgagatctgaacttgattctggagctctgaggccctattgttttatagaaattaatggtcttaaattagcctctccagagaatatctacaaggttatatatgaacagttgagtgggcatagggtgggatggaaaaaggctcttcattatttaactgagcacttttcagatggcactaaaattggaaagcaaacaagccagccaattattttgctcattgatgagcttgatcttcttttgacaagaaatcagtcggtgctgtataacgttcttgattggcccaccaagccaaattcgaacctagtcgttataggcatagcaaacacaatggatcttccggaaaaactattgcctcgtatttcaagtaggatgggtattcaacgattgtgttttggcccttataattatcggcaactgcaggaaatcataacaagccgtcttaagggtattgacgcctttgaagatcaagctattgaatttgcttctagaaaggtagctgctatgtcaggcgatgctaggcgggctttagaaatttgtagacgtgcagcagagtttgcagactaccgaattaaacagtttcaacagtctggacaggcaccctcgtctgcaaatagaggaaatggtgttgtttgcatgggtgatgtagaagacgctattcaggaagtcttccaggcaccacatattcaagtaatgaagaattgcccgaaatttggaaaaattatattggctgcaatggttcatgaattatacagaagtggcctaggcgaagtattatttgataagttggcagcaactgttctctcttggtgccacgtcaatcgagaactattgcctggatatgatactctcctgaaaatctgttgcaagcttggtgagagcaagatcgttctctgtgaggaaggcactaagcataagtttcagaaggtgcagcttaactacccaagcgacgatgtaacctttgccctcaaggagtccccagatcttccttggttgtccaagtatctctgaagcttctaattcattgtctgcatacgtcccagcattgcaccttgttctcttgggggcccaacaggttctgcactatctgcaaatcctggaaacacgcatattccatggagctgattcggagggtgccgctgcaccaaatgcatctcagttgcgaacagaagttatatataagcctgaagaaaattgtatgtctggaattatttttttcaccacatttctggaactcgtttggtagttattgttttagtgttggactgaagtgtctcatgtgagtggtcctcctctcacttgtaacttgataatctgtaactattttttttgaccgggtgataatctgtaactttaaactgtgtatttgttttgagaaaatgacagaatctgatggtgctgaaccctataaggttagggatttcgatgaa

SEQ ID NO: 4561 - DNA, 3650 bp, Brachypodium distachyon
ccacccaaatggatctctccgccacgcctaccagatccaaatccaagcccagatccactccgtcgaagaccatcgccgcctccgccgccgcccagatggacttgtccaccccgtccaagcccacgaccagacggaagtccaaatctgtgtcctcgccgccgtcgattgccccggcgacgccttccaccgtccgcaggtcccgccgactcctagagaccccaacccgccgcctcctagagaccccaaccaaggacctcgtggagaccccggcgaagccagcgcctgcgcccacgctcaagcggaagcgggctgcgccgtcgcccaaaaccccgatccaggccgagcccaagcgccagaggcggctcccgaagaagaaggcgcattaccggaaggtggtgtatgacggaggggagttcgctgctggagacgatgtgtacgtcaagcggcgggagggggcggagtcggacgaggaagaacctgaagaggaggagtgccgtgtgtgcttccacgccggtggtgaggtgatggtggagtgtgacgcgtgcctgggggggttccacctgcgatgtgtgcggccgccgctgcgccgtgtaccggagggggattgggcgtgcccgtactgtgaggctgagcgggcggggagggcgatcgagaggcccaagcagcccgtggggaagagtatcaggaggacagcgaaagagaagcttctctccagcgatttatgggctgcacgcattgagagtttatggagggaaccagatggaacattctgggcaaaggtaaggtggtatactattcctgaagagactgcagcaggacggcagccacataatttacggagagagctttaccgtaccaatgatcttgcagacattgagatggaaactatccttagacattgttacgtcatgagccccaaagagttcagggatgctagtaatgaaggagatgatgtattttattgtgaatatgagtatgatgtacattggcataactttaagcgtctggcagatattgatgatgaacctgagacacaagaagatcccagtgacgagccgtacaatgctggtaatgattataatagtgataccgatgaagattcagaatttgaggaagaggatggaccggctaaacgttgctctgccagaaaaaatcagtcccatcaatttgctgctaattcacggaaagggaggatatatggcctacaaaagattgggatccgaaagatacctgaacatgttcggtgtcatcaaaagactgatctggagaaggcaaaagctaccctgttactcgctactcttcccaagtcgttgccttgcagggataaagaaatggaggagatatcgacatttgtcaaagatgcaatttgcaatgaccaatgtctaggacgctgcctttatattcatggtgtgcctggtactggcaagactatgagtgtacttgcagtcatgaggaggctgagatctgaacttgattctggagctctgaggccctattgttttatagaaattaatggtcttaaattagcctctccagagaatatctacaaggttatatatgaacagttgagtgggcatagggtgggatggaaaaaggctcttcattatttaactgagcacttttcagatggcactaaaattggaaagcaaacaagccagccaattattttgctcattgatgagcttgatcttcttttgacaagaaatcagtcggtgctgtataacgttcttgattggcccaccaagccaaattcgaacctagtcgttataggcatagcaaacacaatggatcttccggaaaaactattgcctcgtatttcaagtaggatgggtattcaacgattgtgttttggcccttataattatcggcaactgcaggaaatcataacaagccgtcttaagggtattgacgcctttgaagatcaagctattgaatttgcttctagaaaggtagctgctatgtcaggcgatgctaggcgggctttagaaatttgtagacgtgcagcagagtttgcagactaccgaattaaacagtttcaacagtctggacaggcaccctcgtctgcaaatagaggaaatggtgttgtttgcatgggtgatgtagaagacgctattcaggaagtcttccaggcaccacatattcaagtaatgaagaattgcccgaaatttggaaaaattatattggctgcaatggttcatgaattatacagaagtggcctaggcgaagtattatttgataagttggcagcaactgttctctcttggtgccacgtcaatcgagaactattgcctggatatgatactctcctgaaaatctgttgcaagcttggtgagagcaagatcgttctctgtgaggaaggcactaagcataagtttcagaaggtgcagcttaactacccaagcgacgatgtaacctttgccctcaaggagtccccagatcttccttggttgtccaagtatctctgaagcttctaattcattgtctgcatacgtcccagcattgcaccttgttctcttgggggcccaacaggttctgcactatctgcatttggacacgaaccaaacatgccgagtatatttccccagacctagcacagactacaaaggggaagaccaaagaacacatggccgtctaatcgatggcgaaaataagcgccacaccacggaccgctcgccgccgacggcgggccaacgccgtctggctcctcccgaataggccccattgcttcctccgcctgctcgccaccatcccccaaatctcccgctaccgtcgaggcctcgtcgccgtccccccgtcctttcgaccaacactcccgacctccgaggagcggaaatctgcaatccaaccccaaaccccatctccgatccgcgacaatgaggtcgagacgacctcacgccaggaggcggaggagccgcaggaccccgatgccgagggggaggccgtcgcgggcaagtactgggcccaccggcacagcctcttctccctctacgaccgcggcgtgcggatggacgccgagggctggtactccgccaccccggaggccatcgccgccgcgcaggccgcccgcgccgcgcccgccggcctcgtcgtcgacgcattcgccggcgtcggcggcaactccatccaattcgccgccaggtacccgcagctagcttcccttcgtgcctttccgtttccaggtccagttaaaccccgttgcctcgccgtcggcatctcgtcctcgtgcaggggttgctacgtggtcgcggtggagatcgatccccacaaggtggagctggccaggcacaacgcgaggatctatggcgtggaggacatgatcgagttcgtggtcggcgatttcttccggctcgcaccttacctgaaggcagatttggtgttcctttcaccaccatggggaggaccatcatacaatcaaacaccaatgtacacccttgatatgctgatgccgaaagatgggtacacaacattccaagctgctcagaaaatagctccaaatgtcatcatgttcttgccatggaatgtggacagaagccaagtcgaggaactttgctggttgtcttctccgcccttagattttgagagtgaagagaactatatacaaaacagattcaaaggaattactgcttgctttggaaatttggcacgatgat

SEQ ID NO: 4562 - DNA, 1643 bp, Secale cereale
tatatggcctgcaaaagattggaatccgaaaaatacctgagcatgttcggtgtcatcagaagactgctctggagaaggcgaaggctactctgttattggctactcttcctaagtcattgccttgcagggataaagaaatggaggagatctctacatttgtgaaggatgcaatttgcaatgaccattgtctaggacgctgcctttatattcatggtgtgcctggtactggcaagactatgagtgtacttgcagtcatgaggaggttgagatctgaatttgattctggagctctgaggccctattgttttatagaaatcaatggtctcaaattagcttctccagagaatatctacaaggttatatatgaacaattgagtgggcatagggtgggatggaaaaaagctcttcattatttaacagagcacttttcagatggcaagaaaattggaaagcaagcaaaccagccaattgttttgctcatcgatgagcttgatctccttttgacaagaaatcagtcggtgctgtataacattcttgattggcccaccaagccaaattcaaacctagttattataggtatagcaaacacaatggatcttccagaaaaactgttgcctcgtatctcaagtaggatgggtattcaacggctgtgttttggcccctataattatcggcaactgcaggaaatcataacaagccgtcttaagggtatcaatgcctttgaagatcaagctattgagtttgcttctagaaaggtagctgctatgtctggtgatgctaggcgggcgttggaaatttgtagacgcgcagcagagtttgcagactaccgtgttaaacaatttcaacaggctgaacagactccctcttctgcaaatacaggaaatggttttgtttgcatgggtgacatagaagacgctattcaagaagtctttcaggcaccacatattcaagtaatgaagaattgcccaaaatttggaaaagttatactggctgctatggtccacgaattatacagaagtggcctaggtgaagtattgtttgataagctggcagcgactgttttctcttggtgccatgtcaacagagaactattgcccggatacgatactctcctgaaaatctgttgcaagcttggtgagagcaagatcgttctctgtgaggaaggcaccaagcataagttgcagaagctgcagcttaactacccaagcgatgatgtgacctttgcactcaaggagtccccagatcttccttggctgtccaagtacctctaaatctcatacctgcagtggccaaatttcccagcactcgcattgctttcctgcttctcttggggagcaacagccctgcctacatgtataaaagttagaaaaagaaaagcgaaaaaaaagtcctgatgttgatctctggagccgattgcccgcaccaattgcatatcggtggttgtcatgtaaaaccaagaactcagccatatgttgcatcagatgcatcttagtttccatctcaggaaaaaaagaaaagtcgtcgaagttgtgagatgtgaaaaaacttgtgtttctcgattttcgccgcatttgcggaacttgtgtgggaccgtgctgtaatgttgtcgttgcactctcatttgagctcgtaatactgactaa

SEQ ID NO: 4563 - DNA, 3046 bp, Zea mays
atggcaaaactgcattgccaatgggagtcagagggccgaaaccctaactcgtccacttttcaaatccacattccccccttatgcctctcacccgtcacccctcgccgtctccggcgagacccggaaatggatgtcgctgccaccccctcaaggtcaaaatctaagcccagatcctcgctggtgaatcccgtcgcagcccccgccgagtccaggatggacctctgcaccccatcgaagcccacgcccaggcggaactccaaatcgacggcctcgccggcgccaatgtctccgtcgacgccctacaccgtccggcgctcgcgccgcctcctcgaaacccccaccaaagccgccctggaggtgcaggtgaaggctacgctgacccctacctccaagggcaagcgcgccgcgccgtcacctaaaacccctgctcagcacgagcccaagaggcagaaacgacacccgaggaagagggcatactaccggaaggtggtgtatgacggcggggagttcgaggtcggtgatgacgtgtacgtgaagcggcgggaggcggcggagtctgacgcggaggaccccgaggaggaagagtgccgcgtatgcttccgcaccggtggcggggttatggtggagtgcgacgcgtgcctcggcggatttcacctgcgttgcgtgcgaccgccgcttcggagggtgcctgaaggtgactgggcatgtccatactgcgaggccgagcgcgccggaaaggtggtcgagcggcccaggccgcctgagggcaagcgcatcgtgaggactgccaaggagaaactcctttccagcgatctgtgggctgcacgcatcgagagtttatggagggagcctgatggcaccttctgggcaaaggtcaggtggtacattatccccgaagagactgcagcaggaaggcagctgcataacttgagaagagagctgtatcgtaccaatgatcttgcagacattgagatggaaacaatccttagacattgttctataatgtgccccaaagactttagggatgctaacgatggaggagatgatgtattttactgtgaatatgagtatgatattcattggcataattttaagcgtttggcagatattggtgatgaacccgagacaaaggaagatcccagtgacgagccttacaatgccagtgatgattataacagtgacactgatgaagattcagagtatgacgaggtggaagaacctacatcatctttctctgccagagggaatcaatcacatgaattggcagcgaattcaaggaagggtagaatatatggcctacaaaaaattggaatacgaaaaattcctgagcatgttcggtgccaccaaaagactgagctggagaaggctaaagcaaccctgttattggcaactctccctaagtcattaccttgcagggataaagaaatggaggagatatcgatatttgtaaaggatgcaatctgcaatgaccagtgcctaggacggtgcctttatatacatggtgtacctggtactggcaagactatgagtgtacttgctgttatgaggaggctgagatctgaatttgattctggaacactgaggccatattgttttattgaaattaatggtcttaaattagcatccccagagaatatctacaaggttgtatatgagcagttgagtgggcatagggttgggtggaaaaaggctcttcactatttaacagaacatttttcaggtggcactaaaattggaaagcaagcaaaccagccaattattttgctgatcgatgagctcgatcttcttttgacaagaaaccagtcggtgctgtataacatccttgattggcccaccaaaccatattcaaatctagttgtcataggtatagcaaacacaatggatcttccagaaaaattattgcctcgtatatcaagtcggatgggcattcaacgactgtgttttggtccatacaattatcggcaactacaggaaattataacaagccgtttaaaggggattgatgcctttgaagaacaagctattgaatttgcttctagaaaggtagctgctatgtcaggtgatgctaggcgagctttagagatttgtagacgagcagcagagtttgcagactaccgtgttaaacagtctcgacagtctgcacagaatactgtttctgcaaataaaggtgatggtgttgtttccatgggtgacatagaagctgctattcaggaagtcttccaggcaccgcatattcaagtgatgaagaattgtccaaagtttggaaaagttatcttggttgccatagttcatgagctgtacaaaagtggactaggtgaaataatgtttgataagttagcaacaacagttttctcctggtgccgtgcccacagagaactattgcctggatacgacactctcttgaaaatttgctgcaagcttggtgaaagcaagatcatcctctgtgaagagggtaccaagcacaagttgcagaaggtgcagctcaactatccaagtgatgatgtgacatttgccctcaaggaatctccagatcttccttggctatctaagtacttgtgaggctcttattgcattaaccattgattcctggcactctgttgcctttctgttctctttggaggctagacaattctacttcacccgcaaacctttcaaacacacatatcccatggtcgatctcctggtcactctagcctcgtatctgcaaaggaaccggcgaaggatgacggcatgtcgctgcacccaacggaacgcgtcacactaggaacgtaaaacgttagaaacatgtacgtctggaatttcgtccccttcatgactggatacgtatgtatccacttcaacccatgtagtttggagtggtttggtatgtattttaaactaaactctatattaaaccactctaatccatatcgattgaggtgaatatgcatgcgtccatatgttgtaactgaactgccgcgtagtgagatttagtaactatatatgaatggtttgttacaataacattgcgagttttgaataagaaacattgagatatcaatttgta

SEQ ID NO: 4564 - DNA, 2969 bp, Setaria italica
aaaccctaactccgtctgctcccgtcagtcccctccacttcggatatcctccatttcaaatccacattccccccttcttccgcctcccttccctcgccgtctccggcgaaacccggagatggatctctccgccaccccttccagatccaaatccaagcccagatcctctcctgcgaagcccatcgccgcctccgccgagcctcagatggacccctgcactccgtccaagcccacgcccaggcggaagtccaaatcggcgacctcgccggcgccgatgtctccggtgaccccatccactgttcgacgctcccgccgcctcctcgatactcccacgaaggccgccccggaggtgcccgtgaaggctacgccgacccccgccgccaggggcaagcgcgccgcgccgtcgcccaaaacccctgcccagcgcgaaccgaagcggcagaggcggcagcggagaaagagggcgtactaccggaaggtggtgtacgatggtggtgagttcgaggtcggggacgacgtttacgtcaagcgtcgggaggagtcggagtcggacgcggaggaccccgaggaggaggagtgccgcgtgtgcttccgcgccggcggcggggtgatggtggaatgcgacgcttgcctcggcgggttccacctgcggtgcgtgcgcccgccactgcgccgggtgcccgaaggggattgggcgtgcccgtactgcgaggctgagcgcgctggcaaggcagtcgagcggcccaggcctcctgagggaaagcgcatcgtgagaaccgccaaggagaaactcctctccagtgatttgtgggccgcgcgcatcgagagtttatggagggagccagatggtaccttctgggcaaaggtaaggtggtacattatccctgaagagactgcagcaggaaggcagccgcataatttgcggagagagctgtaccgtaccaatgatcttggtgacattgagatggaaacaattcttagacattgttctgtaatgtgccccaaagactttagggatgccaacgatggaggggatgatgtattttattgtgaatatgaatatgatatacactggcataattttaagcgtttggcggatattgatgatgagcctgagacaaaggaagatcccaatgatgagccttacaatgccggtaatgattataacagtggcactgatgaagattcagaatatgacgaggaggaagaacctaaatcatgtttctctgccagaaggaatcaatcacatgaattggcggcgaattcaaggaaaggaaggatatatggcctacaaaaaattgggatacgaaaaattcctgagcatgttcggtgccaccaaaagactgagctggagaaggcgaaagcaaccctgttactggctactcttcctaagtcattgccttgcagggataaagaaatggaggagatatctacatttgtgaaggatgcaatttgcaaggaccagtgtctaggacgctgcctttatatccatggtgtacctggtactggcaagactatgagtgtacttgctgttatgaggaagctgagatctgaatttgattccggaactctgaagccgtattgttttatagaaattaatggtcttaaattagcttctcccgagaatatctacaaggttatatacgaacagttgagtgggcatagggttgggtggaaaaaggctcttcactatttaacggagcatttttcaggtgtttctaaaattggaaagcaagcaaaccagccaattattttgctcattgatgagcttgatcttcttttgacaagaaaccagtcggtgctgtataacattcttgattggcccaccaaaccaaattccaacctagttgttataggcatagcaaacacaatggatctcccggaaaagttattgcctcgtatatcaagtcggatgggtatccaacgactgtgttttggcccatacaattttcgccaattgcaggaaattataacaagtcgtctaaagggtattgatgcctttgaggaacaggctattgaatttgcttctagaaaggtagctgctatgtcaggtgatgctaggcgagctttagaaatttgtagacgggcagcagagttcgcagactaccgcgtcaaacagtctcaacagtctggaaagacttctgcaaataaaggagatggtgttgtttgcatgggtgatatagaagctgctattcaggaagtatttcaggcaccacatattcaagtgatgaagaactgccctaagtttggaaaagttattttggttgctatggttcatgaattgtacaaaagtggactaggtgaagtaacttttgataagttagcgacaacagttctctcctggtgccaagtcaatagagaactcttgcctggacacgacaccctcatgaaaatctgctgcaagcttggtgaaagcaaggtcatcctctgtgaagaaggtagtaagcacaagttgcagaagctgcaacttaactacccaagtgacgacataacctttgccctcaaggaatctcccgatcttccttggttgtccaagtacttgtgaagctcatactgcagtggtcgtattcctagcattgtgttctgttccctaggagagttaacggcacttgccacataatctgcaaaccttgaagctatacagatccatggagaatcctctgatctgcaatgtaatgtaacctgttaatggttatgtgctgcgctgcgctgaaagcatcacatacatttttcctccgttgcgcaccgagaatgtataacctgttaatacgcgaagcaacctgtacgtctggaatttcgccccattcgtagtatgatgttgtttgtatggcacattgaatcgcccccatgtgtgacagtgtgagctgatccaactgatttgtagctccactatttataactatggaattctttgcttgtaagaacgttctgtgattgattcttttaaagataagaacatttgagacatc

SEQ ID NO: 4565 - DNA, 2959 bp, Sorghum bicolor
gccccctccatttcaaatccacattccccccttcctccacctctcacccctcgccgtctccggcgagacccggaaatggatctcgccgccaccccctccaggtcaaaatccaagcccagatcctcgccggcgaagcccgccgccgctgccgctaagtccaggatggacctctgcaccccgtccaagcctacgcccaggcggaagtccaaatcgacagcctcgccggcgccgatgtctccggcgacgccatccaccatccggcgctcgcgccgcctcctcgaaacccccaccaaagcagccctggaggttcaggtgaaggctacgccgacccctacctccaaggccaagcgcgccgcgccgtcacctaaaacccctgctcagcgcgagcccaagaggcagaagcgacacccgagaaagagggcatactaccggaaggtggtgtacgacggcggagagttcgaggtcggtgatgacgtgtacgtgaagcggcgggaggcggcggagtctgacggggaggaccctgaggtggaggagtgccgcgtatgcttccgcaccggtggcggggttatggtggagtgcgacgcgtgcctcggcggattccacctccgttgcgtgcgaccgccgcttcggagggtgcctgaaggtgactgggcgtgtccgtactgcgaggccgagcgcgccggaaagttggtcgagcggcccaggccgcctgaggggaagcgcatcgtgaggacctccaaggagaaactcctttccggtgatctgtgggctgcacgcatcgagagtttatggagggagcctgatggcacgttttgggcaaagatcaggtggtacattatccccgaagagactgcagcaggaaggcagccgcataatttgagaagagagctgtatcgtaccaatgatcttggagacattgagatggaaacaatccttagacattgttctgtaatgagccccaaagactttagggatgctaatgatggaggagatgatgtattttattgtgaatatgagtatgatatacattggcataattttaagcgtcttgcagatattgatgatgagctggagacaaaggaagatcccaacgacgagccttacaatgccggagatgattataacagtgacagtgatgaagattcagagtatgatgaggaggaagaacctacgtcatctttctctgccagaaggaatcaatcacatgaattggcagcgaattcaaggaaaggtagaatatatggcctacaaaaaattgggataagaaaaattcctgagcatgttcggtgccaccaaaagactgagctggagaaggcaaaagcaaccctgttattggcaactcttcctaagtcattgccttgcagggataaagaaatggaggagatatctatatttgtaaaggatgcaatctgcaatgaccaatgcctgggacgctgcctttatatacatggtgtacccggtactggcaagactatgagtgtacttgccgttatgaggaggctgagatctgaatttgattctggaactctgaggccatactgttttattgaaattaatggtcttaaattagcatctccagagaatatctacaaggttgtatatgaacagttgagtgggcatagggttgggtggaaaaaggctcttcactatttaacagaacatttttcaggtggcactaaaattggaaagcaggcaaaccagccaattattttgctcattgatgagcttgatcttcttttgacacgaaaccaatcggtgctgtataacattcttgattggcccaccaaaccaaattcaaatctagttgttataggtatagcaaacactatggatcttccagaaaagttattgcctcgtatatcaagtcggatgggtatccaacgactgtgtttcggtccatacaattataggcaactgcaggaaattataacaagccgtctaaagggtattgatgcctttgaggaacaggctattgaatttgcttctagaaaggtagctgctatgtcaggtgatgctaggcgagctttagagatttgtagacgggcagcagagtttgcagattaccgtgttaaacaatctcgacagtctgcacagagtactgtttctgcaaataaaggtgacggtgttgtttccatgggtgacatagaagctgcaattcaggaagtcttccaggcaccacatattcaagtgatgaagaattgcccaaagtttggaaaagttatattggttgccttagttcatgagctgtacaaaagtggactaggtgaaataatgtttgataagttagcaacaacagttttctcctggtgccttgccaacagagaagtagtgcctggttacgacacacttgtgaaaatttgctgcaagcttggtgaaagtaagatcatcctctgtgaagagggtagtaagcacaagttgcagaagctgcagcttaactatccaagtgacgatgtgacatttgccctcaaggaatccacagatcttccttggatatccaagtacttgtgaggttcaaactgcattaaccattaactcctggcattctgttgcatttctgttctctttggaagcaacaattctactttacccgcaaacctttcaaacacacatatcccatggtcgatctcgtggtcactctaagcctcagatctgcaaaggaaccggcgaagggctgcacctgcacccaacgaatcgcacataattaattgcacaccaggaatgtaaaacgttaaggaatctgtacgtctggaatttcgtctgcttcaaagtatgttgtttgtttatgttgtaattgaactgccgcctgtgagctgagccagttgttttttctatccccgccttttagtaactatataactgtataagaactgtttgttacaagaacattgagctgagagttttgaataagaaacattgtgatatcaaattcgtactctttgctggctccaatgcgttggcc

SEQ ID NO: 4566 - DNA, 3061 bp, Sorghum bicolor
gcaaaaaattctgaaagtaaacaagacctagatacaaattccaaaagaaaaggaccaaattacaaaagtgccaaaactcagtgcgaatgggcgccaaacggccgaaaccctaactccgccagtcccatcagccccctccatttcaaatccacattccccccttcctccacctctcacccctcgccgtctccggcgagacccggaaatggatctcgccgccaccccctccaggtcaaaatccaagcccagatcctcgccggcgaagcccgccgccgctgccgctaagtccaggatggacctctgcaccccgtccaagcctacgcccaggcggaagtccaaatcgacagcctcgccggcgccgatgtctccggcgacgccatccaccatccggcgctcgcgccgcctcctcgaaacccccaccaaagcagccctggaggttcaggtgaaggctacgccgacccctacctccaaggccaagcgcgccgcgccgtcacctaaaacccctgctcagcgcgagcccaagaggcagaagcgacacccgagaaagagggcatactaccggaaggtggtgtacgacggcggagagttcgaggtcggtgatgacgtgtacgtgaagcggcgggaggcggcggagtctgacggggaggaccctgaggtggaggagtgccgcgtatgcttccgcaccggtggcggggttatggtggagtgcgacgcgtgcctcggcggattccacctccgttgcgtgcgaccgccgcttcggagggtgcctgaaggtgactgggcgtgtccgtactgcgaggccgagcgcgccggaaagttggtcgagcggcccaggccgcctgaggggaagcgcatcgtgaggacctccaaggagaaactcctttccggtgatctgtgggctgcacgcatcgagagtttatggagggagcctgatggcacgttttgggcaaagatcaggtggtacattatccccgaagagactgcagcaggaaggcagccgcataatttgagaagagagctgtatcgtaccaatgatcttggagacattgagatggaaacaatccttagacattgttctgtaatgagccccaaagactttagggatgctaatgatggaggagatgatgtattttattgtgaatatgagtatgatatacattggcataattttaagcgtcttgcagatattgatgatgagctggagacaaaggaagatcccaacgacgagccttacaatgccggagatgattataacagtgacagtgatgaagattcagagtatgatgaggaggaagaacctacgtcatctttctctgccagaaggaatcaatcacatgaattggcagcgaattcaaggaaaggtagaatatatggcctacaaaaaattgggataagaaaaattcctgagcatgttcggtgccaccaaaagactgagctggagaaggcaaaagcaaccctgttattggcaactcttcctaagtcattgccttgcagggataaagaaatggaggagatatctatatttgtaaaggatgcaatctgcaatgaccaatgcctgggacgctgcctttatatacatggtgtacccggtactggcaagactatgagtgtacttgccgttatgaggaggctgagatctgaatttgattctggaactctgaggccatactgttttattgaaattaatggtcttaaattagcatctccagagaatatctacaaggttgtatatgaacagttgagtgggcatagggttgggtggaaaaaggctcttcactatttaacagaacatttttcaggtggcactaaaattggaaagcaggcaaaccagccaattattttgctcattgatgagcttgatcttcttttgacacgaaaccaatcggtgctgtataacattcttgattggcccaccaaaccaaattcaaatctagttgttataggtatagcaaacactatggatcttccagaaaagttattgcctcgtatatcaagtcggatgggtatccaacgactgtgtttcggtccatacaattataggcaactgcaggaaattataacaagccgtctaaagggtattgatgcctttgaggaacaggctattgaatttgcttctagaaaggtagctgctatgtcaggtgatgctaggcgagctttagagatttgtagacgggcagcagagtttgcagattaccgtgttaaacaatctcgacagtctgcacagagtactgtttctgcaaataaaggtgacggtgttgtttccatgggtgacatagaagctgcaattcaggaagtcttccaggcaccacatattcaagtgatgaagaattgcccaaagtttggaaaagttatattggttgccttagttcatgagctgtacaaaagtggactaggtgaaataatgtttgataagttagcaacaacagttttctcctggtgccttgccaacagagaagtagtgcctggttacgacacacttgtgaaaatttgctgcaagcttggtgaaagtaagatcatcctctgtgaagagggtagtaagcacaagttgcagaagctgcagcttaactatccaagtgacgatgtgacatttgccctcaaggaatccacagatcttccttggatatccaagtacttgtgaggttcaaactgcattaaccattaactcctggcattctgttgcatttctgttctctttggaagcaacaattctactttacccgcaaacctttcaaacacacatatcccatggtcgatctcgtggtcactctaagcctcagatctgcaaaggaaccggcgaagggctgcacctgcacccaacgaatcgcacataattaattgcacaccaggaatgtaaaacgttaaggaatctgtacgtctggaatttcgtctgcttcaaagtatgttgtttgtttatgttgtaattgaactgccgcctgtgagctgagccagttgttttttctatccccgccttttagtaactatataactgtataagaactgtttgttacaagaacattgagctgagagttttgaataagaaacattgtgatatcaaattcgt

SEQ ID NO: 4567 - DNA, 4269 bp, Oryza sativa
gatggaaccctaaactccaccgctcccatctcgtctcgatcccctccatttcaaatccacactccgcctcccctctccggccgccgccggcgagatggatctctccgccaccccgtccagatccaaatccggcctcagatcctccccgaggaagcccgtcgccgcccccgccgtggcccagatggacctctccaccccgtccaagccgacccccaggcggaagcccaaggcgccgccggtggcggctccgatgtcccccgtgaccccgtcctccgtccgccgctcctcccgcctcctcgagacgccgaccaaggtaacttccgagacccccgtgaagcccaccccaaccccgaagcggaagcgcgccgcgccgtcgccgtcgccgaagacgccgacccagtccgagcccaagcggcagcggcagaggcagaggcagcagccgaagaagccgaagaagagggcgtactaccggaaggtggtgtacgacggcggggagttcgccgccggggacgacgtgtacgtgaagcggcgggatggcgcggagtccgacgcggaggacccggaggcggaggagtgccgcgtgtgcttccgcgccggcgccgcggtgatggtggagtgcgacgtgtgcctcggcgggttccacctgcggtgcgtgcgcccgccgctgcggcgcgtgccggagggggactgggcgtgcccctactgcgaggccgagcgcgcggggaaggccatcgagaggcccaagccgccggaggggaagcgcatcgtgaggaccgccaaagagaagcttctctccagtgatttgtgggctgcacgaatcgagagtttatggagggagccagatggaatattctgggcaaaggtaagatggtatattatccctgaagagactgcagcaggaaggcagccacataatttgcgtagggagctgtaccgcaccaatgatcttgcagacattgagatggaaacaattcttagacattgttatgtcatgagccccaaagaatttaaggatgctagtgatcaaggagatgacgtattctactgtgaatatgaatatgacatacactggcataattttaagcgtctggcagacatcgatgatgaacctgagacaaaggaagatcctggcgacgagccatacaatgctggtaatgattatgtcagtgactcggatgaagattctgaatatgatgaggaggaagaacctactaaatgtagttctgctagaacacatcaatcacatgcgttggctgcgaatctgcggaaagggaggacatatggcctacaaaaaattgggatccgtaaaattcctgaacatgtccggtgtcatcaaaagaccaatctggagaaggcaaaagcaaccctgttattggcaactcttcctaagtcgttaccttgtagggataaagaaatggaggagatatctgcatttgtgaaggatgcaatttgcaatgatcaatgtctaggacgctgcctttatattcatggtgtaccaggcactggcaagactatgagtgtacttgcagttatgaggaggctaagatccgagcttgattctgggaatctgaggccttattctttcatagagattaatggtcttaaattagcttctccagagaatatctacaaggttatatatgaacagttgagtgggcatagggtagggtggaaaaaagcccttcattatttaaccgagcacttttcaggtggcactaaaattggcaaacaagcaaaccagccaattattttgctcatcgatgagcttgatcttcttttgacgagaaatcagtcggtgctgtataacattcttgactggcccaccaggccaaattcaaacctagttgtcataggtatagcgaacacaatggatcttcctgaaaagttattgcctcgtatttcaagtcggatgggtatccaacgactgtgttttggcccatataattatcggcaactgcaggagatcattacaagccgtctaaagggcattgatgcctttgaagaccaagctattgaatttgcttctagaaaggtagctgctatgtctggtgatgcaaggcgagccttagaaatatgtagacgtgcagcagagtttgcagattaccgcgttaaacaatctgggcacacttctgtgaatagaggaaaaaatgttgtttgcatgggtgacatagaagctgctattcaggaagtctttcaggcaccacatattcaagtaatgaagaactgcccaaaatttggaaagattatattggtcgctatggttcatgaattatacagaagtgggctaggtgaagtgatgttcgataagctggcagcaactgtcctctcttggtgccatgtcaacagagaattattgcctggctatgatactcttctgaaaatctgttgcaagcttggtgaaggtaagataattctctgcgaggaaggcactaagcacaagttgcagaagcttcagcttaactatccaagtgacgatgtaacttttgccctgaaggaatccccagatattccatggttgtccaagtacctgtgaagtttacacttgcagcggttgtactttcccagcatttcattcatctactcctggagttggagagcaacgatcgcaactacttgcccttgatcagcaaatctcggaatttatgtgggtccaattgttcatcttccaaaagatatcgactcgaaggatgccgctgcaacaaaatgtaaatgcagtgtcgcaccaggactgtaacatatgtatgattcgaaggagattgtaggtcgccattttattttcgccaatctgttgttacccaagaaactttgctctggcagtgttgttttctcttgcatccctctgttacgtactcccttcgttccaaaaaaagacaaaccctggtttccgtgtccaacgtttgaccgtccgtcttatttgaaaaaattatgaaaaaaataaaaagacaagtcacgcataaaatattaatcatgttttaccatctaacaacaatgaaaatacgaattataaaaattttcatataagacggacagtcaaagttggacacgaaaactcagggtaaaactcagggtttgtcttttttttttacggagggagtacgtgcgagctgattgtactactgcacatttgtaactggttacctacaaatcatcatcaaattatctgttgtgaaacattgacaaatgtatgatggattgatgatatctgttaaaacattgacaaattatctctttttcgcttgtgaattcccgtgggatattaatctctcgtttggaattcacgcgggctctctcttcttcgttttatagcttggacccatcgccttcctctcgccgccggcgagcccattaccaatggcgaacgcgagtgcaacgcccaagacccctcgccgccgccgccgcgtcacgttcctggctaggacttgccaccgcctcctccgcttgctcgccactcaccgcctccgccgcggtggccatggccttaactccatcagcgccggtgacgactcccctccctccggtcagccgccgcgaggccgggacgcggaggaagccgaagcgacccaggcggcggcggcggcgcaacggcggcacgaggagcgacacggcgacgacgacgccgccgccaccgaggaggcggaggcggccgtggcggggaagtactgggcgcagcggcgcagcctcttctccctctacgaccgcggcgtgcggatggacgcggagggctggtactccgccaccccggagcccatcgccgccgcgcaggccgcccgcgcgccgccgggatccctcgtcctcgacgccttcgccggcgtcggcggcaactccatccagggttgctacgtggtcgccgtggagatcgacccccggaaggtggagctcgcggcgcacaacgccaggatctacggcgtcgacgacatgatcgagttcgtcgtcgccgatttcttccacctcgcgccctccttgaaggcagatttggtgttcctttcaccgccatggggagggccatcctacagccaagctcaagtttactcccttgatatgctgaagccaagagatggatttacaattttccaagctgctcaggaaatatctccaaatatcatcatgttcctgccacggaatgtggacttaagccaagtagagcaactttcttggttgtcttctccccccttggattttgtgagcgaagagaattacatagaacatagattcaaagggataaccgcctactttggaggtttggcacaagaagttctgaagcaaggataa

SEQ ID NO: 4568 - DNA, 4416 bp, Oryza sativa
gccagattctcaaattctcatcactcgaggggttaaaatgtaaaagagcgaaaaactcccgcgcgccaaatcgtgatggaaccctaaactccaccgctcccatctcgtctcgatcccctccatttcaaatccacactccgcctcccctctccggccgccgccggcgagatggatctctccgccaccccgtccagatccaaatccggcctcagatcctccccgaggaagcccgtcgccgcccccgccgtggcccagatggacctctccaccccgtccaagccgacccccaggcggaagcccaaggcgccgccggtggcggctccgatgtcccccgtgaccccgtcctccgtccgccgctcctcccgcctcctcgagacgccgaccaaggtaacttccgagacccccgtgaagcccaccccaaccccgaagcggaagcgcgccgcgccgtcgccgtcgccgaagacgccgacccagtccgagcccaagcggcagcggcagaggcagaggcagaggcagcagccgaagaagccgaagaagagggcgtactaccggaaggtggtgtacgacggcggggagttcgccgccggggacgacgtgtacgtgaagcggcgggatggcgcggagtccgacgcggaggacccggaggcggaggagtgccgcgtgtgcttccgcgccggcgccgcggtgatggtggagtgcgacgtgtgcctcggcgggttccacctgcggtgcgtgcgcccgccgctgcggcgcgtgccggagggggactgggcgtgcccctactgcgaggccgagcgcgcggggaaggccatcgagaggcccaagccgccggaggggaagcgcatcgtgaggaccgccaaagagaagcttctctccagtgatttgtgggctgcacgaatcgagagtttatggagggagccagatggaatattctgggcaaaggtaagatggtatattatccctgaagagactgcagcaggaaggcagccacataatttgcgtagggagctgtaccgcaccaatgatcttgcagacattgagatggaaacaattcttagacattgttatgtcatgagccccaaagaatttaaggatgctagtgatcaaggagatgacgtattctactgtgaatatgaatatgacatacactggcataattttaagcgtctggcagacatcgatgatgaacctgagacaaaggaagatcctggcgacgagccatacaatgctggtaatgattatgtcagtgactcggatgaagattctgaatatgatgaggaggaagaacctactaaatgtagttctgctagaacacatcaatcacatgcgttggctgcgaatctgcggaaagggaggacatatggcctacaaaaaattgggatccgtaaaattcctgaacatgtccggtgtcatcaaaagaccaatctggagaaggcaaaagcaaccctgttattggcaactcttcctaagtcgttaccttgtagggataaagaaatggaggagatatctgcatttgtgaaggatgcaatttgcaatgatcaatgtctaggacgctgcctttatattcatggtgtaccaggcactggcaagactatgagtgtacttgcagttatgaggaggctaagatccgagcttgattctgggaatctgaggccttattctttcatagagattaatggtcttaaattagcttctccagagaatatctacaaggttatatatgaacagttgagtgggcatagggtagggtggaaaaaagcccttcattatttaaccgagcacttttcaggtggcactaaaattggcaaacaagcaaaccagccaattattttgctcatcgatgagcttgatcttcttttgacgagaaatcagtcggtgctgtataacattcttgactggcccaccaggccaaattcaaacctagttgtcataggtatagcgaacacaatggatcttcctgaaaagttattgcctcgtatttcaagtcggatgggtatccaacgactgtgttttggcccatataattatcggcaactgcaggagatcattacaagccgtctaaagggcattgatgcctttgaagaccaagctattgaatttgcttctagaaaggtagctgctatgtctggtgatgcaaggcgagccttagaaatatgtagacgtgcagcagagtttgcagattaccgcgttaaacaatctgggcacacttctgtgaatagaggaaaaaatgttgtttgcatgggtgacatagaagctgctattcaggaagtctttcaggcaccacatattcaagtaatgaagaactgcccaaaatttggaaagattatattggtcgctatggttcatgaattatacagaagtgggctaggtgaagtgatgttcgataagctggcagcaactgtcctctcttggtgccatgtcaacagagaattattgcctggctatgatactcttctgaaaatctgttgcaagcttggtgaaggtaagataattctctgcgaggaaggcactaagcacaagttgcagaagcttcagcttaactatccaagtgacgatgtaacttttgccctgaaggaatccccagatattccatggttgtccaagtacctgtgaagtttacacttgcagcggttgtactttcccagcatttcattcatctactcctggagttggagagcaacgatcgcaactacttgcccttgatcagcaaatctcggaatttatgtgggtccaattgttcatcttccaaaagatatcgactcgaaggatgccgctgcaacaaaatgtaaatgcagtgtcgcaccaggactgtaacatatgtatgattcgaaggagattgtaggtcgccattttattttcgccaatctgttgttacccaagaaactttgctctggcagtgttgttttctcttgcatccctctgttacgtactcccttcgttccaaaaaaagacaaaccctggtttccgtgtcccacgtttggccgtccgtcttagttgaaaaaattatgaaaaaagtaaaaagaccagtcacgcataaaatattaatcatggtttaccatctaaccacaatgaaaatacgaattataaaaattttcatataagacggacagtcaaagttggacacgaaaactcagggtaaaactcagggtttgtcttttttttttacggagggagtacgtgcgagctgattgtactactgcacatttgtaactggttacctacaaatcatcatcaaattatctgttgtgaaacattgacaaatgtatgatggattgatgatatctgttaaaacattgacaaattatctctttttcgcttgtgaattcccgtgggatattaatctctcgtttggaattcacgcgggctctctcttcttcgttttatagcttggacccatcgccttcctctcgccgccggcgagcccattaccaatggcgaacgcgagtgcaacgcccaagacccctcgccgccgccgccgcgtcacgttcctggctaggacttgccaccgcctcctccgcttgctcgccactcaccgcctccgccgcggtggccatggccttaactccatcagcgccggtgacgactcccctccctccggtcagccgccgcgaggccgggacgcggaggaagccgaagcgacccaggcggcggcggcggcgcaacggcggcacgaggagcgacacggcgacgacgacgccgccgccaccgaggaggcggaggcggccgtggcggggaagtactgggcgcagcggcgcagcctcttctccctctacgaccgcggcgtgcggatggacgcggagggctggtactccgccaccccggagcccatcgccgccgcgcaggccgcccgcgcgccgccgggatccctcgtcctcgacgccttcgccggcgtcggcggcaactccatccagggttgctacgtggtcgccgtggagatcgacccccggaaggtggagctcgcggcgcacaacgccaggatctacggcgtcgacgacatgatcgagttcgtcgtcgccgatttcttccacctcgcgccctccttgaaggcagatttggtgttcctttcaccgccatggggagggccatcctacagccaagctcaagtttactcccttgatatgctgaagccaagagatggatttacaattttccaagctgctcaggaaatatctccaaatatcatcatgttcctgccacggaatgtggacttaagccaagtagagcaactttcttggttgtcttctccccccttggattttgtgagcgaagagaattacatagaacatagattcaaagggataaccgcctactttggaggtttggcacaagaagttctgaagcaaggataaatttctttctaaggtttcaatgtctagcttcccctgaaattctggtctaatatcttgcaaatgcccc

SEQ ID NO: 4569 - DNA, 1862 bp, Panicum virgatum
cattgctggtaacgattataacagtgatacagatgaagattcagaatatgatgaggaggaagaacctaaatcatgtttctctgccagaaggaatcaatcacatgagttggcggcgaattcaaggaagggtaggacatatggcctacaaaaaattgggatacgtaaaattcctgagcatgttcggtgccaccaaaagactgagctggagaaggcgaaagcaaccctgttactggcaactcttcctaagtcattgccttgcagggataaagaaatggaggagatatctacatttgtgaaggatgcaatttgtaatgaccaatgtctaggacgctgcctttatatccatggtgtacctggtactggcaagacaatgagtgtacttgctgttatgaggaggctgagatctgaatttaattccggaactctgaatccatattgttttatagaaattaatggccttaaattagcttctcctgagaatatctacaaggttatatatgaacagttgagtgggcatagggttgggtggaaaaaggctcttcactatttaacagagcatttttcaggtgtttcgaaaattggaaagcaagcaaaccagccaattattttactcattgatgagcttgatcttcttttgacaagaaaccagtcggttctctataacattcttgattggcccaccaaaccaaattccaacctagttgttataggtatagcaaacacaatggatctccctgaaaagttattgcctcgtatatctagtcggatgggtatccaacgactgtgttttggcccatacaattttcggcagttgcaggaaattataactagtcgtctgaagggtattgatgcctttgaggaacaggctattgaatttgcttctagaaaggtagctgccatgtcagtgatgctaggcgagctttagaaatttgcagacgggcagcagagttcgcagactaccgtatcaaacagtctggacagacttctgcaaataaaggagatggtgttgtttgcatgcgtgatatagaagctgctattcaggaagtctttcaggcaccacatattcaagtgatgaagaactgcccaaagtttggaaaagttattttggttgctatggtccatgaattgtacaaaagtggactaggtgaagtaacttttgataagttagcaacaacagttctctcctggtgccacgctaatagagaattcttgcctggatatgacactctcatgaaaatctgctgcaagtttggtgaaagcaagatcatcctctgtgaagaaggtagtaagcacaagttgcagaaggtgcagctaaactacccaagtgatgatgtaacctttgccctcaaggaatcccccgatcttccttggttgtccaagtacttgtgaagctcatactgcagtggtcgtattcctagcattctattctgttctctaggggagttaacggcacttgccacttcatccctcaaaccttgaagctatacagatacatggagaatcctctgatctgcaatataatgtaaccgattatggacgagctgcaccgcgccgaaagcgtcacaaacatttttcctccgttgcacaccaggattgtaacctgcaatgcgcgaagcagctagtacgtctggattttcgtcgcactcaaagtatgatgttgtttccttggcacactgaatcgcctcatgtgtggctccactgcttagaactatggaattcgttgcttgtaagatcgtttctgcgattcataattttaagaaaagaacatttgagacatcaggtatttaccctccctgttgaatacaaacaatgtgattttcataactctagtatggaactgtacactttgtgagactggcttt

SEQ ID NO: 4570 - DNA, 757 bp, Panicum virgatum
  misc_feature (51)..(51): n is a, c, g, or t
  misc_feature (581)..(581): n is a, c, g, or t
  misc_feature (596)..(596): n is a, c, g, or t
tctaccagcttctcctccgccaccgactgcagaatacaattgatcgctacntctaccacacaaaaggcacactacaaatgagagagttgatgaaccaggcgtagagaagtggaaatatgaggctacaaccttgggacagaagattgacgcgattgaggcatccaagaggaatcttcttggggagagcctgggatcttgttcaattcaggagctacaagagctggagctgcagctggagaagagcctaagcagcatcaggcaaaggaagcaaaagaagctgatggatcagattttggagttgagggagaaggagcagaaactcgcaaaggagaacgcgatgctccgcgatcagtgtaaggccctacctcttctagagctgaatgataagggccatatggatgctgctgctgccggcggcgaagaagaagaagcggcggatgatgggcgcatggaggacgtggagacggagttggccatcggaatcggaacaagatggccgccgcgcagcatcatggatcgcatgactagcaagcatcaagacagctagctcttggatgatcaagtatatgtaagttgttgtntccataaaaaaaaanagagacatgcatgcatggtcgatgtggtcgcgatgaataataacttgcgattcatgttgacggcaaatagtactcgttcaagaagatgttaaggtagtgggccggcctatctcattctcaacagagaggaaagtatttaatttagtcatgcggatgcggtc

SEQ ID NO: 4571 - DNA, 897 bp, Panicum virgatum
  misc_feature (783)..(783): n is a, c, g, or t
accaacgcgagcaagagcgtcttgattgacaccgatcgagcaaacacaccactgcttctctgctcaaagccggatcgctcttcggcttcgttccacccatcaagccgactcgagacgatgtatccggccaagcccagcgagccggcggcggcgccggtgaccggggtccccgtgggcgtccccggcggcggccagggccagtggtcgtcgggtctcttggactgcttcgacgactgcgggctgtgctgcctgacgtgctggtgcccgtgcatcacgttcgggcgcgtggcggagatcgtggaccgcggcgcgacgtcgtgcgggacgagcggggcgctgtacgcgctgctggcctacctcaccggctgccagtggatctactcctgcacctaccgcgccaagatgcgcgcccagttcggcctcccggagaacccctgctgcgactgctgcgtccacttctgctgcgagccctgcgcgctctgccagcagtacaaggagctcaaggcacgcggcttcgacccggacctcggctgggagctcaacgcccagagggccaacgccgccgccatgcccatgtacccgcccgccgcacagggcatgggccgctgagctactcatacatggatcgtctcgtctcatccgtgctgatgatgctcctcatcagtcgacgagtttatttgcttctgattcgtgcatggtgaattgtacgtactgctgcactagctatgtgtttatttttgtgtgtgtgtttcatctcttgcatcagccaaaaggaaatgtgcntgtaaacatcatcagtacggagtgtacgtttcctttttcttttgttactgtatacatgcatgcatatttcttggttcttccatggtttcgaataaaaagaaaagagtgtcgatt

SEQ ID NO: 4572 - DNA, 1089 bp, Sorghum bicolor
attcattcccggcaacgaacggcggcgagcaggcgaacccaaacgcaaccgcagcgagcgaagacagctacagcgctagtagattagccaagaaaccgaggagtcgatcgatagcactgtcaatcgtgcgagtgcgagcgcagcgatcggagaaagccggccagctcgacgtcgacgacatgtatccgtccaagcctagcgagcaggccggggcggcgccggtgaccggcatccccgtcggcggccctgccgccgccgcatcccagtggtcctccggcctcttcgactgcttcgacgactgcggcctctgctgcctgacgtgctggtgcccgtgcatcacgttcggtcgcatggcggagatcgtggaccgcggcgcgacgtcgtgcggcacggcgggggcgctctacacgctgctggcctacttcacggggtgccagtggatctactcctgcacgtaccgcgccaagatgcgcgcccagttcggcctcccggacaccccctgctgcgactgctgcgtccacttctgctgcgagccgtgcgcgctctgccagcagtacaaggagctcaaggcccgcggctacgaccccgtcctcggctgggaccagcagggcgccgccgccatgcacccgccggcagcgcaagggatggggcgctgagctaccacttcaatgcccggccggccggcaccgccgccgctccatgcatggattggatgcatggtaaaatttaattacgtgggcaactgcacttgttctttgtttgtggtgacgtgcgtggattgtgatcgatgtggtgatgtcaggactgcaaagcatgcatgtgttctttcagacatgaggaaatgtgcatgtagatttctactccatcagtacggactgtaaatttgatctttactgtatttcttgggtgcgtgcatgcatcatatgcatggtttcgaataaaattttttaaaaaagggagatatgtcctcttctgtttttttttatggtgacgacgtggattgtgatatggcaatgtcaggattaattggtacaacaaagaatgtttctttctttcagaccaggatcgggccgtacctttgacttttcc

SEQ ID NO: 4573 - DNA, 1086 bp, Sorghum bicolor
atgtatccggccaagcccaccgccgccgcagccagcgcgcctgtggtcgggatggcgccgccggtgaccggcgtccccatctccagccccggccccgtcgcggccaccgagtggtcctccggcctctgcgcctgcttcgacgactgcggcctctgctgcctgacgtgctggtgcccgtgcatcacgttcggtcggatcgcggagatcgtggaccgcggcgcgacgtcgtgcggcgccgcgggcgccatctacacggtgctggcctgcttcacggggtgccagtggatctactcctgcacgtaccgctccaagatgcgcgcgcagctcggcctccccgacgtcggctgctgcgactgctgcgtccacttctgctgcgagccctgcgcgctctgccagcagtacagggagctcaaggcccgcggcttccaccccgacctcggctgggacgtcaacgcccagaaggcggcggccaacgccgctgccggcatcgctagtagattagccaagaaaccgaggagtcgatcgatagcactgtcaatcgtgcgagtgcgagcgcagcgatcggagaaagccggccagctcgacgtcgacgacatgtatccgtccaagcctagcgagcaggccggggcggcgccggtgaccggcatccccgtcggcggccctgccgccgccgcatcccagtggtcctccggcctcttcgactgcttcgacgactgcggcctctgctgcctgacgtgctggtgcccgtgcatcacgttcggtcgcatggcggagatcgtggaccgcggcgcgacgtcgtgcggcacggcgggggcgctctacacgctgctggcctacttcacggggtgccagtggatctactcctgcacgtaccgcgccaagatgcgcgcccagttcggcctcccggacaccccctgctgcgactgctgcgtccacttctgctgcgagccgtgcgcgctctgccagcagtacaaggagctcaaggcccgcggctacgaccccgtcctcggctgggaccagcagggcgccgccgccatgcacccgccggcagcgcaagggatggggcgctgagctaccacttcaatg

SEQ ID NO: 4574 - DNA, 1486 bp, Sorghum bicolor
gttcccggcaaggcgagagaacgcgtacgtacgatcgacaccaagaaacccaaggcacgtaccacaacgacagcctgctctgctcctctgtgccattgtcagaatgtatccggccaagcccaccgccgccgcagccagcgcgcctgtggtcgggatggcgccgccggtgaccggcgtccccatctccagccccggccccgtcgcggccaccgagtggtcctccggcctctgcgcctgcttcgacgactgcggcctctgctgcctgacgtgctggtgcccgtgcatcacgttcggtcggatcgcggagatcgtggaccgcggcgcgacgtcgtgcggcgccgcgggcgccatctacacggtgctggcctgcttcacggggtgccagtggatctactcctgcacgtaccgctccaagatgcgcgcgcagctcggcctccccgacgtcggctgctgcgactgctgcgtccacttctgctgcgagccctgcgcgctctgccagcagtacagggagctcaaggcccgcggcttccaccccgacctcggctgggacgtcaacgcccagaaggcggcggccaacgccgctgccggcatcgctagtagattagccaagaaaccgaggagtcgatcgatagcactgtcaatcgtgcgagtgcgagcgcagcgatcggagaaagccggccagctcgacgtcgacgacatgtatccgtccaagcctagcgagcaggccggggcggcgccggtgaccggcatccccgtcggcggccctgccgccgccgcatcccagtggtcctccggcctcttcgactgcttcgacgactgcggcctctgctgcctgacgtgctggtgcccgtgcatcacgttcggtcgcatggcggagatcgtggaccgcggcgcgacgtcgtgcggcacggcgggggcgctctacacgctgctggcctacttcacggggtgccagtggatctactcctgcacgtaccgcgccaagatgcgcgcccagttcggcctcccggacaccccctgctgcgactgctgcgtccacttctgctgcgagccgtgcgcgctctgccagcagtacaaggagctcaaggcccgcggctacgaccccgtcctcggctgggaccagcagggcgccgccgccatgcacccgccggcagcgcaagggatggggcgctgagctaccacttcaatgcccggccggccggcaccgccgccgctccatgcatggattggatgcatggtaaaatttaattacgtgggcaactgcacttgttctttgtttgtggtgacgtgcgtggattgtgatcgatgtggtgatgtcaggactgcaaagcatgcatgtgttctttcagacatgaggaaatgtgcatgtagatttctactccatcagtacggactgtaaatttgatctttactgtatttcttgggtgcgtgcatgcatcatatgcatggtttcgaataaaattttttaaaaaagggagatatgtcc

SEQ ID NO: 4575 - DNA, 545 bp, Setaria italica
ccggaatcgacagtggtgacgtggaatgaataggctctcgagttcctggggatccatggcgaggacagcagcccagtttctgttcatgcggatcagctggaggtcgcggtgaacctgataatcacagactactgcatgcctggcatcacaggatatgatctgacaggatatgatctgctcaagaaggtcaaggaatcatcgtctctaagagatatcccagtgctgatcatgtcatccgagaacattccttcaaggatcaatagatgcctggaagaaggagcggatgagttttacctaaaaccagtgaggctatcagacatgagcaagctgaagccccacatactgaaaagcagatgcaaggagcactaccaggaacagcaccagcaaagcgacagcaacagcaacgaatgcagtaaccccacaaacgacagcagcagcagcagcagcgataacagcaacagccgcaagagagaggcagaagacaacgaagaaattttgccccagagaaacagatcaaggcacagttagctgcaaactgattatag

SEQ ID NO: 4576 - DNA, 793 bp, Setaria italica
attccgggagcaaggctctcgagttcctggggatccatggcgaggacagcagcccagtttctgttcatgcggatcagctggaggtcgcggtgaacctgataatcacagactactgcatgcctggcatcacaggatatgatcttgacaggatatgatctgctcaagaaggtcaaggtaactaccatattctctctagtgtttcttggtatgatccgctgaagaagaaagatgtacatgcttgttttgttcaagcaggaatcatcgtctctaagagatatcccagtgctgatcatgtcatccgagaacattccttcaaggatcaatagatgcctggaagaaggagcggatgagttttacctaaaaccagtgaggctatcagacatgagcaagctgaagccccacatactgaaaagcagatgcaaggagcactaccaggaacagcaccagcaaagcgacagcaacagcaacgaatgcagtaaccccacaaacgacagcagcagcagcagcagcgataacagcaacagccgcaagagagaggcagaagacaacgaagaaattttgccccagagaaacagatcaaggcacagttagctgcaaactgattataggagaattagcccccttttttctccctttattctttgttttacttagcttttggcaaactaatttgtaacacaggagaattaacccccttgtgtatcgagttcatttttaacatttccttgtgtatctgtgacctatatgctggaggtttgttataaaaaaagcttgtgtatctgttgaaataaat

SEQ ID NO: 4577 - DNA, 635 bp, Pennisetum glaucum
tccacgacgagagccccccgccgccaccacctgcagcagtttccgtccttcatccggcggcggcggcggaccacctggaggctgcggcggcggtgaatctgataatcacggactactgcatgcctggcatgacagggtatgatctcctcaagaagatcaaggaatcgtcgtccctaagagatatccctgtggtgatcatgtcgtccgagaacatcccttcaaggatcaatagatgcctggaagaaggagcggacgagtttttcctaaaaccagtgaggctatcagacatgagcaagctgaagccccacatactgaaaagcagatgcaaggagcactaccacgaggagcagcaccagcaaagcgacagcaacagcaacgaatgcagtaaccccacaaacgacagcagcagcagcgataacagcagccgcaagagaaaggcacaagacaacgaagaaattttgccccagagaaacagatcaaggcataattagttagctgcaaactctataggagaactgaccccctttattctttgttttccttagcttttggcaaactaatttgtaatgcagatgttcgttagcccttgatttgcaaaatataatggaacccgtgaacggatactgacaatatca

SEQ ID NO: 4578 - DNA, 1967 bp, Panicum virgatum
ccgcctaccctgcgtgacgtaacctagccgcgccgcgcctcctccggtcggacgcctcgcgccgccgctcgaatccatggacgccgaggccggcgtcgtcggcgccgaccagctgccgcggaggcagtactacatgaatttattactcttagcttaccagagctttggcgttgtttatggggaccttagcacatcacctctctacgtttataaaagtacattcgctggaaagctccgtcaataccaagatgaggagacagtattcggtgtgctttccctcatcttttggacattcactcttattcctttgctcaagtatgtcactattgtcttgagtgctgatgataatggcgaaggtggaccgtttgcattgtattcgctcctttgtaggcatgcaaaacttagcttgcttccaaatcaacaagcagctgatgaggaactatcgacatactacagaaatgggtttgcccctcgcaatggatctgcgccttggctaagaaggtttctagagaagcacaaaaaaatgcgaaccgtgcttcttctcatagttctgtgtggcgctagcatggtgattggtgatggtatccttaccccagcaatctcagttctgtcatctatgtctggattgcaagttcgagctactggtttagagcatcgttctgtagttctcctttcgtgcattgtattggttggtctatttgccttgcaacatcgaggtactcagaaggttgcattcttgtttgcaccaattgtcatcatctggctgttttccattggtggaattggtttatacaacatacttcattggaacccaaatatatatcaagctctctctccgtactatatggttaagttctttaggaagacaggtaaagatggctggattgctttaggagggattcttctttcaatgacaggcagtgaagcaatgtttgctgaccttggtcactttacaagtgcctctgtcagggtggcttttgttactgtcatatatccatgtcttatactacaatatatgggtcatgctgcatttctatccaagaacactttccacatgacgacaggtttttatgatactatcccagaacctgtgttttggcctgtattcgtggtggccacactcgctgcagttgttggtagccaagctgtaatttcagcaacgttctccattgtgaaacagtgccatgctttgggatgtttcccacgagtgaaggttgtccacacatcgaggtggatctatggacagatatatatcccagaaataaattggatccttatggtgctttgcgtagctgttacggttgcattccgtgacactactcttatcggcaatgcctatggtattgcatgcatgactgttatgcttgtcactacattcttgatggcattgattgtcatctttgtttggcaaaggaacataatatttgccctaatttttctggctttctttggatccattgaagctgtatatctttcgtcgtctctcatgaaggttcctcagggaggatgggtgcctcttgtgcttgctttcatattcatgtctgtcatgtacatctggcactatgggttaaggaggaaataccaatttgacctacagaacaaagtatcaatgagatcgatcctgtctctgggtccaagccttggcatagttcgggttcctggtattggattgatttatacagagttggtgactggtgttccctccatcttctcacattttgtcactaatctccctgccttccatgaagtcctagtctttctttgcgtgaagtcagtaccagtgccatatgtttcaccagatgagcgataccttgtgggtaggattggacctaaagagtatcggatgtaccgttgcattgttagatatggttacaaagatgtgcagagagacgatgacattttgagaacatgttagttatgagtatagcaagttcattttgatggaagctgagatgcttctctcagca

SEQ ID NO: 4579 - DNA, 352 bp, Zea mays
catatcctgctgcatgacagaagagagagagcatgctttatctgatctggaagtggttcccggccgggtcgccgcggccgttctggtcggcgtgttggcggaatccattattgccgccgccggcgtgcgcgtcggccgagctcttccggcgccgctcgttgtggccggccagacgcaggcggcagctgcgcttgacgtcgtcgaactccgacagctcgtggaacctgccggaaacacacaagcgctggcggaggccggcgacgagcacgacgggggccttggagtgcgcctcgcacaccttgtgcctccggttgtacggcttctcctcggtcatctctagatcgccccttaa

SEQ ID NO: 4580 - DNA, 1174 bp, Sorghum bicolor
cttcccctcatgagaggcacggcaccggagctgcagcttcacctcgccagctctcggcccgcccctcgatcgcccaggccggtatcctccctcgccggcgccaccatggaccgcaagagcaagtccaccaagggctccgcggcgagctcggcagcggcgtccatggccgcgctcgctgccgccgcggcggccggcgacagcagcgcggaccccggggcggaggacaacgtgcctgcgaagatggcagccgtgggagacgtctccagctcctccccggtggcggcgaggaggagcgtggcggccgcgggcggtgccgcctccagctcctccccggtgccggcggcggcgaggaggggcgcggcggcggcggcggcggcgtctgtcgcggcaggaggaggaggcggcggcgggccgaggtgccaggcggagcggtgcaacgccaatctgatgaccgacgagaagccgtacaaccggaggcacaaggtgtgcgaggcgcactccaaggctcccgtcgtgctcgtcgccggcctccgccagcgcttctgccagcaatgcagccggttccacgagctgtcggagttcgacgacatcaagcgcagctgccgcctgcgtctggccgggcacaacgagcggcgccggaagagctcggccgacgcgcacggtggtggcggcgccggcgccggcgccggcaatggattccgccaacacgccgatcagaacggcccggccgggaaccacttccagatcagataaaccatgctctctctcttctgtcatgcagcaggatatgctagcattattattaccgataaatatgtgttgcatcggtcgtctaccctgtgttgcgttactagtactacgtgctaactgaatcatgtcggcagtgcacatgacctcctgcagtggtagtgtgcttgtatgtgcaccgaccggaggtctacgtgctaatctctgccagaaaaaaccagctaattatatctgctgattgtaacctaattaatttgcagccaattaagcagggactgctagctagcgtaattgttggtgtgagtatgtctgcactacgtgtgtaatcctgtggcctgtccaaacagtaatttgtgctggctgtgtgtattgatgttgatgctgctctgataattgtggtaatatatgtgctatttattcaagtagt

SEQ ID NO: 4581 - DNA, 1284 bp, Sorghum bicolor
cttcgtcttcccctcatgagaggcacggcaccggagctgcagcttcacctcgccagctctcggcccgcccctcgatcgcccaggccggtatcctccctcgccggcgccaccatggaccgcaagagcaagtccaccaagggctccgcggcgagctcggcagcggcgtccatggccgcgctcgctgccgccgcggcggccggcgacagcagcgcggaccccggggcggaggacaacgtgcctgcgaagatggcagccgtgggagacgtctccagctcctccccggtggcggcgaggaggagcgtggcggccgcgggcggtgccgcctccagctcctccccggtgccggcggcggcgaggaggggcgcggcggcggcggcggcggcgtctgtcgcggcaggaggaggaggcggcggcgggccgaggtgccaggcggagcggtgcaacgccaatctgatgaccgacgagaagccgtacaaccggaggcacaaggtgtgcgaggcgcactccaaggctcccgtcgtgctcgtcgccggcctccgccagcgcttctgccagcaatgcagccggttccacgagctgtcggagttcgacgacatcaagcgcagctgccgcctgcgtctggccgggcacaacgagcggcgccggaagagctcggccgacgcgcacggtggtggcggcgccggcgccggcgccggcaatggattccgccaacacgccgatcagaacggcccggccgggaaccacttccagatcagataaacctatctatctaagcatgctctctctcttctgtcatgcagcaggatatgctagcattattattaccgataaatatgtgttgcatcggtcgtctaccctgtgttgcgttactagtactacgtgctaactgaatcatgtcggcagtgcacatgacctcctgcagtggtagtgtgcttgtatgtgcaccgaccggaggtctacgtgctaatctctgccagaaaaaaccagctaattatatctgctgattgtaacctaattaatttgcagccaattaagcagggactgctagctagcgtaattgttggtgtgagtatgtctgcactacgtgtgtaatcctgtggcctgtccaaacagtaatttgtgctggctgtgtgtattgatgttgatgctgctctgataattgtggtaatatatgtgctatttattcaagtagtaatgatatatatttgttgtacattgtgtctaacagtgtcagtgatttgcgcatggttttttacattgtcgcctctatatctcgattgccta

SEQ ID NO: 4582 - DNA, 1591 bp, Setaria italica
agaggaggggaaatccaaatgttcctgggttagtcttgatgacatcactaattgcttgataagaggagattctgaaaaatctcatcatcaccagcgtgtagctgagttgcaacggcttcgttccatatttgctacaagtgaaaggcagtggattgaagcacaagttgagaatgctaaacagcaagccatactctctatattgaaagctcaagtgtcatccgacgaggctcatatacatagggacatccattctctcaggagaaaaggttctgagcttgctggagagctctcaacactttctcaaaaggtgcaagcttttgtatctgagacgataccatgcctctgttcagaacttgctcaacttcaaggcacatatattttgcaaggggattatgatttaaaggtcatgcgccaggagtactacattaacaggcaaaagacgttcatcaatcacttggttaatcagctcgccagacaccagtttctgaagattgcttgccaacttgaaaggaagaatatagctagtgcttactcattgcttcgagtaatagaatctgagctccagagctacctctcagcagtcaatacccgtttgggccattataattcattaattcaagctgcatctgatgtaagagaacaaggagcaattgatgatcgtgacactttcctccatgcagtgcgagatctcctatgtattcactcaaatgtccaagcaacagtgccaacatacatgtcagcacatgcattggttcagcagatatcagctcttcaatctgacttgctttctcttcagtctgagctggagaatacccttccagctgaccggaaaagatttatcaatgagctatgcactctgattcaaactgtggaacagcttttgtttgcatcatcaacaactgcagaaccgatattgacaccttggccactgatgcgggcgcttgatgatatggaaaatgcaaacgctcaagttgaagtttctgtggaagaagtaacaaaggctcgcacccagaagataaagatcttcgagaatcgtgctcatgaggtggggagggagaggcaaatattcgttgatttcttctgcaaccccgagcgcctcaagaatcaagtccgagagctgacctcccgcgtgaaagctctccaggactagacttttttttttgcaggctggaaagtacaggacgtgtctcatgtgccgcgatatgttttgtgtaaagtttggctttgctccaagtccaacatgaagttggggctgctgtgcagggacggtatggaacaatatagaccatcaggtagtttagtgattcaggttctaaggtccttgtgccgcccggcaaggatggcgctgttgtgatattatttattagtgatctgtatgttgtaaaatatgtcagaaaccacgagctccttctttcgtgtatgattgcacttgagtaggttgaggtggtagtacatttgtggtgtgcaaagaacaatcgatgctgtagtttgggtaaatggaatcgtccttcactcgcaggggggtgcgatgaagtgataatcccctcccaaccattgggtgaaattgacaggaaagttgggctcttttttc

SEQ ID NO: 4583 - DNA, 1126 bp, Pennisetum glaucum
aaggagattatgatttaaaggtcatgcgccaggagtactacattaacaggcaaaagacgttcatcaatcacttggttaatcagctcgccagacaccagttcctgaagatcgcttgccaacttgaaaggaagaatatagctagtgcttactcattgcttcgagtaatagaatctgagctccagagctacctctcagcagttaatacccgtttgggccattgtaattcattaattcaagctgcatctgatgtaagagaacaaggagctattgatgatcgtgacactttcctccatgcagtgcgagatctcctttgtgttcactcaaatgtccaagcaacagtgccaacatacatgtcagcacatgcattggttcagcagatatcagcgcttcaatctgacttgctttctcttcagtctgagctggagaatacccttccagctgatcggaaaagatgtatcaatgagctatgcactctgattcaaactgtggagcagcttttgtttgcatcatcaacaacagcagaaccaatattgacaccttggcctctgatgcgggcgcttgatgatatggaaaatgcaaacgctcaagttgaagtttccgtggaagaagtaacgaaggctcgcacacagaagataaagatatttgagaatcgtgcccatgaggtgggaagggagaggcaaatattcatcgatttcttctgcaaccctgagcgcctcaagaatcaagtcagagagctgacctcccgcgtgaaagctctccaggattagacttgttttttgtaggctggtcttgcatgtccacgatatttttttttaggtaaagtttggccttgttccaacatttaattggggttgctgtgcaggggtgatatggagcaacagtgtagacctcaaggtcattgtgccacccagagaggcaggcgctgtatgttgtaaaatgtgtcagagaccacgagctcctcctttcgtgtatgattgcactttaggttgatgaggtggtagtacagttgtggtgtgcaagtgcaaagaacaatcgattctgtagtttgggtaaatggaattggttgggtgaaccgagcgctgcggacatataattggttgcatgataatcccctccggtcatcagg

SEQ ID NO: 4584 - DNA, 2329 bp, Secale cereale
gactcaccattttggttgttgtttcgaacgcactccacccctcctctaccggcttccgctgccggccgcggccgtccccacccaccaccaccaccgcgaccaccactgccggacagcgcagcctcgggcatccggcgagcaccgacgcccggagtgtgaggaagagaggatgagcggggcggcgctgtgcgcggcgctgacggagctggggttcgacggggaggacccgctggacgcggacgcgctcgagtggcccttccagtacgaggaggcgcgcccgctgctcgcctggatctgctcctgcctccgcccctccaacgtcctctccccgtcccacctctcgcagtatgagcaactcgtggaagagggaagactgctagagggtgaggatttggactctgcttttgatagtatttcagccttttcaagcaagaaagacaatcaagaggctgtctttgaagcagaagaaactattcttgacattcgagaagcaaaactagcttatagagctgaagtttttgagttgcagaggcagcttgcacggcagcaagcacaatttgatatgcttgcagggcaagcatcttctcttattcaaggcagacgagcacgtgtatcagctatgtctgcagttagcgtgcaacttatatcactagatgagatactttcatcccgaaacttggagatgaatgcagttcttgggagaattaccgctacaacccaagaattggcacattatcattcaggagatgaggacagtatatacttggcatattcagacttccatccctatgttattggggatttggcttgtacaaaggagctaaaccggtggttctcgaagcaatttgagaaggggccatttcgacttgttgccgaggagggaaaatcgaaatgttcctgggtgagtcttgatgatatcacaaatggcctgacaagaggagattctgaaaaatcgcatcatcaccaacgtgttgctgagttgcaacgactccgttcgatatttgctacaagtgaacgccaatggattgaagcacaagttgagaatgctaaacaacaggccatactccaaattttaaaatctcaagtatcctccgatgaggctcacatacatagggatatccattctcttaggagaaaaagttctgagcttgctggagaactctcgacacttactcaaaaggtgcagcctttcatatctgagaccataccatgcctttgttcagaacttgctcaacttcaaggcacatagtatttggcaaggtgattacgatttaaaggtcatgcgccaggaatactatatcaacaggcagaaaacgttcatcaaccacttggttaatcagcttgctagacaccaatttctgaagattgcttgccaacttgaaaggaagcacatagccagtgcccacgcattgcttagagtcatagaatctgagctacatagctacctatcggcagtcaacacccgtctgggccattgcaattcattaattcaagctgcgtctgaggtacgtgaacaaggagcaatcgatgatcgtgacactttcctccatgcagtgcgggatctactatgtattcactcaaattcccaagcagcagtaccaacatacatgtcagcgcatgctttagttcagcagatatcggcacttcaatctgacttgctttctcttcagtctgaacttgaaaatacccttccagctgacaggaaaagatgtatcaatgagctgtgcactctgattcaaacagttgaacagcttctatttgcatcgtcaacaactgcagaaccagtattgacgccctggccactgatgcgagcacttgatgatatggaaaatgccaatgctcaagttgaagttgctgttgaagaagtaaccaaggctcgcactcaaaagataaagatctttgaaaatcgcgcacatgaggtggggagggaaaggcaggtgtttgttgattttttcagcaaccacgaacgtctcaagaatcaagtcagagagctgacctcccgcgtgaaagctcttcaggaatgaagccattgcctcctggagggtcttatgaaaatcggaagcagtggcccaaagctcacatctcctgtgtggcaactctatttcttgtagagagctccagcgcaaaattgggcatgtgtgtgctgccggtatgcaacatcgagtgatttagatggatattcaggacatatatgccagtggccacctgaatggttggcgtttatgcttctttgtatgttgtaaaatatgctagagatcacgagcaagcttggaataggttgtgggcgtggtgtgtaaaatacaattgatttagtttgtattagatggtt

SEQ ID NO: 4585 - DNA, 1895 bp, Triticum aestivum
gtttttgagttgcagaggcagcttgcacggcagcaagcacaatttgatatgcttgcagggcaagcatcttcgcttattcaaggcagacgagcacgtgtatcagctatgtctgcagttagcgtgcaacttatatcactagatgagatactttcatccagaaacttggagatgaatgcagttcttggaagaattactgctacaacccaagaattggcacattatcattcgggagatgaggacagtatatacttggcatattcagacttccatccgtatgttattggggatttggcttgtacaaaggagctaaaccggtggttctcgaagcaatttgagaaggggccatttcgacttgttgcggaggagggaaaatcgaaatgttcctgggtgagtcttgatgacatcacaaatggcctgacaagaggagattctgaaaaatctcatcatcaccaacgtgtggctgagttgcaacgactccgttcgatatttgctacaagtgaacgacaatggattgaagcacaagttgagaatgctaaacaacaggccatactccaaattttaaaatctcaagtgtcctccgacgaggctcacatacatcaggatatacattctcttaggagaaaaagttctgagcttgctggagaactctcaacacttactcaaaaggtgcagcctttcatatctgagaccataccatgcctttgttcggaacttgctcaacttcaaggcacatatattttgcaaggtgattacgatttaaaggtcatgcgccaggaatactatatcaacaggcagaaaactttcatcaaccacttggttaatcagcttgctagacaccaatttctgaagattgcttgccaacttgaaaggaagcacatagccagtgcccacgcattgcttagagtcatagaatctgagctacatagctacttatcggcagtcaacacccgtctgggccattgcaattcattaattcaagctgcgtctgaggtacgtgaacaaggagcaattgatgatcgtgacactttcctccatgcagtgcgagatctactatgtattcactcaaattcccaagcagcagtaccaacatacatgtcagcacatgctttagttcagcagatatcggcacttcaatctgacttgctttctcttcagtctgaacttgaaaatactcttccagctgacaggaaaagatgtatcaatgagctatgcactctgattcaaacagttgaacaacttctatttgcatcgtcaacaactgcagaaccagtattgacgccctggccactgatgcgagcacttgatgatatggaaaatgccaatgctcaagttgaagttgctgttgaagaagtaaccaaggctcgcactcaaaagataaagatctttgaaaatcgcgcacatgaggtggggagggaaaggcaggtgtttgttgattttttcagcaaccacgagcgtctcaagaatcaagtcagagagctgacctcccgcgtgaaagctctccaggaatgaagccgttttctcccgggcggtcttaagaaaaatcagaagcaatggcccaaagctcacatctcctgtgtggcaattctatttcttgtagagagctccagcgcaaaattgggcatgtgtgtggtgccggtatgcaacatcgagtgatttagatggatatttaggacataggagtatatgccagtggccacctgaatggttggcgtcattgttgtatttatgcttctttgtatgttgtaaactatgctagagatcacgagcaatcttggactaggttgtgggggtggtgtgtaaaatacaattgagttagtttgtattaggtggttgatttaggtttttttttagtttggtggctgatttagttgagccaacatctcatgtgtcaaatg

SEQ ID NO: 4586 - DNA, 2890 bp, Sorghum bicolor
tcaagatgatggacacgaggcgtcactctgtgtctgtggatgtcccactgtcaagaaccttggtgcagctcaagcgagtgagatcgctgcgggatccagcgacgaactcgatgagcaagtacgcatctccttctgatcacatgatctgggagactgcttctagcaatggggtgactctggaccttggcaggagcaagtcttctgctgcaatgagccgtgttgggagcccctgtatgtcagccagtgaggcacgctccgttgggtcaagaagaagcactttagggcatggaactgaggatacacgactgaggtcgaatgatgtcgtgggatcgaattttagtggctgtggtataagctactgctggtcaggagcatcgaagtaccgagaactttattcagatagtgatggtccagatcaacctctcttgtctacagatgggaccgaggctgcattccaaggcaatgtaccatacactgagacaccgaggtgtttaagccagaaattccgccctcgttctttcagtgaattgatcggcctaaatgttgttgcccagtccctcttatattcctcttgcaaaggaaaagttgctccaatgtacttgtttcatggcccccggggtacaggcaagacatccacagcaaggatttttgccgcagcactaaattgtgtatctcttgaagagcaaaggccatgtgggttctgtaaagagtgtgtcattcttttctctgggaagagtagagatgtgaaagaacttgatgcagcgaaaatggatcgtttaggtcgagtaaaggcacttctcaagagtgcatctctcgttccatactcttcgcgcttcaaggttttcataatagatgaatgccatctcttgcaagaagatgcatggtcagcaatactgaagagtcttgatgagccataccggcatacagtatacattatgattacttctgacatagaaagcctgcctcgcacttccatcacacattgccagaagttccattttccgaagataaaggtggcagatattgtctacaggttggagagaatctgtatagaagaaggattggaatttgaccatgatgggttgtatttcattgctgcaaagtctaatggttctcttagagattcagaaataatgcttgatcaactcagtttgctagggaagaagatcacaatttctcttgtgcatgaacttgtaggatctgtgtctgatgacgagttgattgaattgcttgatctagcattgtcgtccgacacaaccaatactgtaagacgagctcgagaacttatggggtcagcaattgatcctctgcagctggtgtctcagttggccaaccttattatggacattctctcagggcgatgtcaatctgcagtcactgaagtcagcaaaagtttcttgggtagatatgcattatcggagattggaataaagaaattaaggcatgcactgaagatactatcagaaactgaaaaacaattaaggacatcaaggaatcaggctacttgggttacagttgcgcttttgcagtttagcaccaatgaacctaaccttgctgctgaaccgaatgatatgcatgcacattcagtaactggatatacagatgactgggtttccaaggtgcactcaagtgccaatttttgtcaggcatgtaacagcagcaagtccaactgctctgagagacactgtaggcggcttaagcttgagaacatatggaggagagccattggaaagtgtcgatcaaggtcagccaaaagtttcctcaggaaagaaggcttcttatcatcggttcatgttactgaagagctggccatagcagaagttggttttggacacccggatcacctatcaagagcagagaaaatgcaaagcctcatagaatgctctttacagcatgttcttgggtgcaatgtggagatcagattcaaacttgtaccctgtccagtcagaaaagatgctaggttgaagagacagtcgttcagttttctcaactgctctggccggaagcaagagctgtcagattcagttgtgactgatgaagatgaagttgtgaggcctggagcaagagagacaccgcttaaaggctacacctctagtcagcaggaatcaccatataccatgcaacgtgttgattcaaaaccaacagtccatggttgtgaggatgatgctcggagtaccttgacgtcaaacagatccatgacagatgatctgacaaggacgtgcaggtcagagactaactactcaaagggtgtaagtgagcacggccactttgatagcatccaggaaccggacctacagccgaattgcttctcgcgaacactcaagcttcaaaagaagctattgtcttctggcgcagcacacacaatctgtttgaggatccagccacataacaagatggacttcctgcctaagaaagaattcgatacatacttctgcgcatacgaaccttacgagcagtgttcaagatcaaattcaagagctacttacagttcaagagatgatgacttgtggagcaagaattcacgctttggttcgaatctactctgctggagggccccaaaacaatccatgtaaccgaggaaaggatgagcatactagatggaagacagcaattctgctatgacatttgccaattttgcccgaagctgtaaacatgaacaccacctgcggggacaatttttcaaggaaagtccaggagtggtctgtgttattcttgttctgagaaactgtttagtgatattttcttggtaatgcaggtcctttataatgctagtgggcagttgtacagcgcgccaatgatgaaaccctgtgtatactgaatagttctgttattctgaattttgtagggcgatttgatgctctccccatttacatgatctttttattagctg

SEQ ID NO: 4587 - DNA, 3487 bp, Sorghum bicolor
gtccgtgctgctgctgccgctgcaccccgtcgccatgaccactgcacttgttaattaattaatcaccccccaaacctgcccttttccgtgccgttctgccaactgagcacatggccacacccatgctcgctgccgttctgctcagtcgctcacgctccccgctctcttcctctcctctcggtgcggtgaggtggtgaggtgctgggccgaccggctgagcagctagctgactgtacccgccgctaccattaccacgctgcaccgtaccagagcagggcctcacgcggcgctgtcccgaccccgtcgaggcaaaacccctggccgttccctctcgtcccgtgccgccgccgccgccgccagccgccaccgccgccgtgcgcccaggcttctttccttctgtgactttgctacaatgggtcatgttctaatcaaaagaaggaccacattttcttgtcaacattgaagatacaatctttcattattgctgggtaagttggaacagagaagcgcatattcaagatgatggacacgaggcgtcactctgtgtctgtggatgtcccactgtcaagaaccttggtgcagctcaagcgagtgagatcgctgcgggatccagcgacgaactcgatgagcaagtacgcatctccttctgatcacatgatctgggagactgcttctagcaatggggtgactctggaccttggcaggagcaagtcttctgctgcaatgagccgtgttgggagcccctgtatgtcagccagtgaggcacgctccgttgggtcaagaagaagcactttagggcatggaactgaggatacacgactgaggtcgaatgatgtcgtgggatcgaattttagtggctgtggtataagctactgctggtcaggagcatcgaagtaccgagaactttattcagatagtgatggtccagatcaacctctcttgtctacagatgggaccgaggctgcattccaaggcaatgtaccatacactgagacaccgaggtgtttaagccagaaattccgccctcgttctttcagtgaattgatcggcctaaatgttgttgcccagtccctcttatattcctcttgcaaaggaaaagttgctccaatgtacttgtttcatggcccccggggtacaggcaagacatccacagcaaggatttttgccgcagcactaaattgtgtatctcttgaagagcaaaggccatgtgggttctgtaaagagtgtgtcattcttttctctgggaagagtagagatgtgaaagaacttgatgcagcgaaaatggatcgtttaggtcgagtaaaggcacttctcaagagtgcatctctcgttccatactcttcgcgcttcaaggttttcataatagatgaatgccatctcttgcaagaagatgcatggtcagcaatactgaagagtcttgatgagccataccggcatacagtatacattatgattacttctgacatagaaagcctgcctcgcacttccatcacacattgccagaagttccattttccgaagataaaggtggcagatattgtctacaggttggagagaatctgtatagaagaaggattggaatttgaccatgatgggttgtatttcattgctgcaaagtctaatggttctcttagagattcagaaataatgcttgatcaactcagtttgctagggaagaagatcacaatttctcttgtgcatgaacttgtaggatctgtgtctgatgacgagttgattgaattgcttgatctagcattgtcgtccgacacaaccaatactgtaagacgagctcgagaacttatggggtcagcaattgatcctctgcagctggtgtctcagttggccaaccttattatggacattctctcagggcgatgtcaatctgcagtcactgaagtcagcaaaagtttcttgggtagatatgcattatcggagattggaataaagaaattaaggcatgcactgaagatactatcagaaactgaaaaacaattaaggacatcaaggaatcaggctacttgggttacagttgcgcttttgcagtttagcaccaatgaacctaaccttgctgctgaaccgaatgatatgcatgcacattcagtaactggatatacagatgactgggtttccaaggtgcactcaagtgccaatttttgtcaggcatgtaacagcagcaagtccaactgctctgagagacactgtaggcggcttaagcttgagaacatatggaggagagccattggaaagtgtcgatcaaggtcagccaaaagtttcctcaggaaagaaggcttcttatcatcggttcatgttactgaagagctggccatagcagaagttggttttggacacccggatcacctatcaagagcagagaaaatgcaaagcctcatagaatgctctttacagcatgttcttgggtgcaatgtggagatcagattcaaacttgtaccctgtccagtcagaaaagatgctaggttgaagagacagtcgttcagttttctcaactgctctggccggaagcaagagctgtcagattcagttgtgactgatgaagatgaagttgtgaggcctggagcaagagagacaccgcttaaaggctacacctctagtcagcaggaatcaccatataccatgcaacgtgttgattcaaaaccaacagtccatggttgtgaggatgatgctcggagtaccttgacgtcaaacagatccatgacagatgatctgacaaggacgtgcaggtcagagactaactactcaaagggtgtaagtgagcacggccactttgatagcatccaggaaccggacctacagccgaattgcttctcgcgaacactcaagcttcaaaagaagctattgtcttctggcgcagcacacacaatctgtttgaggatccagccacataacaagatggacttcctgcctaagaaagaattcgatacatacttctgcgcatacgaaccttacgagcagtgttcaagatcaaattcaagagctacttacagttcaagagatgatgacttgtggagcaagaattcacgctttggttcgaatctactctgctggagggccccaaaacaatccatgtaaccgaggaaaggatgagcatactagatggaagacagcaattctgctatgacatttgccaattttgcccgaagctgtaaacatgaacaccacctgcggggacaatttttcaaggaaagtccaggagtggtctgtgttattcttgttctgagaaactgtttagtgatattttcttggtaatgcaggtcctttataatgctagtgggcagttgtacagcgcgccaatgatgaaaccctgtgtatactgaatagttctgttattctgaattttgtagggcgatttgatgctctccccatttacatgatctttttattagctgaattattaacatcgtctaaactcctcacgagtcacgactcatatagattgatcttcctttcaatcaaaaggtaagcgtgcaaa

SEQ ID NO: 4588 - DNA, 3368 bp, Zea mays
cggaagctccagccgccgctaccattaccagtgagttgaggtgctctggtgctgggctgactgtacccgccgctaccattaccacgcgctgcaccgtagcagagcggttccaaccccgtcgaggcaaaaagccctggccgttccctggccccgtgccgccgccgccgcctccgtgcgcccaggcttctttctgtgacttcgctaaaatgggtcatgtcctcatcatcaggaccacactttcaagtcaaaattgaagataccatcttccactattccactttcatgtcaaaactcaagatgacggacatgaggcgtcactctgtggatgtcccgctgtcaagaaccttggtgcagctcaagcgattgagatcgctgcgggatccagcgacaaactcaatgggcaagttcgcatctcctgccgaccacatggtgtgggagactgcttctagcaatggggtggctctggagctcggcaggagcaagccttcggctgcaatgagccgtgtcgggagcccctgcatgtcagctagcgaggcaagatcagggcatggaaccgaggatacacgactgaggtcaaacgatgtcgtggggtcaaattttagtggctgtggtataagctactgctggtcaggagcgtcaaagtgccgagagctttattctgacagtgatggtccagatcagcctctcttatctacagatgggactgaggcagcgttccaaggcaacgtaccatacactgagacgcccaggtgtctaagccagaaatttcgccctcgttccttcagcgaattggttggactaaacgttgttgcccagtccctcttatattcctgctgcaaaggaaaagttgccccaatgtacctgtttcatggcccccggggcacaggcaagacatccacggcaaggattttcgccgcggctctaaattgcgtgtcccttgaagagcaaaggccatgtgggttctgcaaagagtgtgtcatccttttctctgggaagggtagagatgtgaaagagcttgacgtggcgaaaatgggtcgtttaggtcgagtgaaggcgcttctcaagagcgcatccctcgtaccctactcttcgcgcttcaaggttttcataatagatgaatgccatctcttgcaagaagacgcatggtcagcaatactgaagagccttgacgagccataccggcatacggtatacattatgatcacttctgacatagaaagcctgcctcgcgcttccatcacacgttgccagaagttccattttccgaagataaaggtggcagatattgtatacaggctggagaagatctgtataggagaaggattggaattcgaccatgatgggttgtacttcattgctgcaaagtctagtggttctcttagagattctgaagtaatgcttgaccagctcagtttgcttgggaagaagatcacaatttctcttgtgcatgaacttgtaggatcagtgtctgatgacgagttgattgagttgcttgatctagcattgtcatctgacacaaccaatactgtaagacgagcccgagaacttatggggtcagcaattgatcctctgcagcttgtttctcagctggccaaccttattatggacattctctcaggacgatgtcaatctgctgtcagtgaagtcagcaaaagtttcttgggtagatatgcattatcagaggttggaataaagaaattaagacatgcactgaagatactatcagaaactgaaaaacaattgaggacatcaaggaatcaggctacttgggttacagttgcgcttttgcagtttggcaccaatgaacctaaccttattgctgaaccgaatgatatgcattcacattcagtaactggatatacagatgactgggtttccaaggtgcactcaaacaccaatttttgtcaggcatgtaacagcagcaagtccaactgttctgagagacactgtagacggcttaagcttgagaacatatggaggagagccattggaaagtgtcgatcaagatcagccaaaagtttcctcaggaaagaaggcttcttatcatcggttcatgttaccgaagagctggctatagcagaagttggcttcggacacccagatcacctatcaagagcagagaaaatgcaaagcctaatagagtgctctttacagcacgttcttgggtgcaatgtggagatcagattcaaacttgtaccttgtccagtgagaaaagatgctaggttgaagagacactcgttcagttttctcagttgctctggccggaagcaagagctgtcagattcagtagtgactgatgaagacgaagctgtgaggcctggggcaagggagacaccgcttaaaggctacacctctagccagcaggagtcaccatataccatgcaacgtgtcgattcgaaaccaacagcctatggttgcgaggatgatggtcggagcaccttgacgtcgaacagatccatgacagatgacatgacaaggacgtgcaggtccgagactaactactcaaaggggggtgtgagtgatcagggccgctttggtagcatccaggagcctgacctacagccaagctgcttctcgcgaacactgaggcttcagaagaagctgttgtcttctggcgcagcgcacaccatctgtctgaggatccagccgcataacaagatggaattcctacctaagaaggaatttgatacgtacttctgcgcgtatgagccttacgagcagtgtccaagatcagtttcaagggctacttacagttcaagagatgatgacttgtggagcaagaattcacggttcggttcaaatctactctgctggaaagccccaaaacaacccatgtaacggaggtacattactctgtattttcacatcacttggtccgtcggaatagccatgtgaattcagcgtcttggctcgctcggttgctgtttgctagtgttcatattacatgttgaccccagttctgccagagcccagagcactttcacaccagcaagctgctttcttacaagcgtaactgcgacaaccagcaccagcattgctgccggggaaaagtgaaccatggtagcagaacattggcatgctgaaaaacagtgtcaaatcattcagtttttgctaggacatttaccaatttctcccgaagctggaggcatgggcaccacctgtggggacaattttcaaaggaaatcccaggaggggtctttgtttttattgttcttggcaggcagctgaggaactattcatcagtgatgtttcttggatgtgctggtccttcaaaatgctaatgggcagttgtacatgttacgttatatgctactgaactcagaggctataatacactttttttatgtcaacacatagaaattaagatc

SEQ ID NO: 4589 - DNA, 3697 bp, Sorghum bicolor
cagatacaatgaggtgctgagcttatcgcctgcttgtctttccaagagtgcgtttcccagagaacagatgctttggtttcaaagtgggaataacacgatcagcctctccacggcgagcctccttgttcctgttcctagtagaggccttcgctttcttgatagccttcttcttctgctcagagtccttgaatccctctccaggaatgacctcctcaggagcccgtgacctcgacctagaccttgatgtccgacgcagtttcttgttggattgctggccatctatctccatactgtcaccatcagctgcagctctgctcaatgacctctcacgcttgcggcccctagacttgctgcgagctctattcatggcagcactaggatccacacccatggaggaaagctgacgtcccatcctatcagttgtgaatttcctatctttgtcaaactttctagggacaataggacggctttctgcagttctcttcttcattctatgttcttggatgagtaatgccttcttcttcctaatctgagccaaaatctccttctgttcctgagttagttcatgaccatcaatctggaaagcatcttctgcagcttgttcttccagacgaagcccttcctctctttccaactcttcacaccttactaggatatctggatccagaaaatcggcaacgttgtgaccatccagtatctctggaagaatatcctccttccattcatcattggccaatatataatgtttcttgagacttgcagaatacaccccagcacctccattctcattctcaatgtccttctcaagcttcttcttttcctttgcagcagcattcgccctagcttccagaacagcctgagggatgcaaacaggcctctccttgttgtcacgaggctttggaacagcaacatgaaacctattcaaacaatccatcatcttctttgacttcatcttcacatccaccctctgttcaagcagcctctcgcatgcagcatttttgacagccattacaccatcatcagttaaagtgctcatagtcaacaaaacaccttcttcattaggaccaccagcttgggttatagtcttcatagcctctgccttcatctccatgactagcttcatgtcatcctcagaaagcccttcaagcggctgcaagtcagtcttgttgcacacaatgaccaaaggcttattcatgaacagagactttatactgtggaagagtgcagcttgctgagcaatactgtatccacaagatccagagatgtccagaaagaacaacaccgcagccctcaaatgcgccagagcagtgatgctgcacatttctatgatgttcctatcttcaaaaggccgatcaagtatacctggtgtgtcaatcacttggtagcgcaggtacttgtaatctgtatgaccaacaaacagggattttgttgtaaaggcatacggttggacatccacatctgcccttgtaaccttgttcatgaaagaactcttccccacatttggatatccacaaatcagaacagtacgggtgttcggatctatggatggaagcctggccatgtgctgcctgatctgctctaagtaagccaaactaggactgatcctcttcacgacagtgcacatgcgacctagtgcagccaccttcagacacttgcaccggtacagggtgtctccatacttgagaagcctcaagtagtccttggatatctttgcaatgatgttcctagctgtgttgatctgacccagggcaagcttgtagtgatccttgttgtagagcacatggaggagatcaccatagaaagggtggatgtcatccagtcgaggaaactcatcgatgatggtggagagcttttcatagaagttctgctgggaatacctaaccttgcgcatataaaactgacgaatgcggttgatagcatatcccttgtggacaacagtcggtgtctgcctttgggtgcgggacaggattatgtcaatgaagtccttcccaggagggacaacagtgatcttcttgaaattgtactgcaccatcttggtgatacaaagcgctgcttaccttgtgagaagcccggaagaagaggaccgacttgtcgccgggagaggtcgcgtcctctccggcaagtgctggtggaggcggcgcaggtgtccccctctggcggcggacggggagaagggagggttagggtgggtttctccgagtcttatagcctgggcgttggtgggctgggctttgttcggcctatatacatatttcccttaatgggccattcggcccatttcctgcggtggcggcggcttgtgtctccaaagtccaaagtccgaactcctccacggcacggcggcgtctgacggctcaccccaactcgtcgccttccccgtccttcccgccgtcgtggagaggaggtcgcgcggctggctcccgccgcttccggacggttcggtctcccagcttccgcggttcggagggagcaggatcagctgccgcgatgttccccaggatctcccggctcggggcgcgcctcctgcgcgagtctagagccgagacgagagctggaaatttgctaagcagtcgaggcattttgtatcaaggtcatgttaaccggcattcgaccccagtgatgacccctactgtattatcgttgcggaatgtccttttgtcaactgcaacaagtggtgagcaggatgaaagcagtcagccaaaagataagtaagtgcatttttctcttgtttcatcctcttatatatcacgaaatttgaactccctagttgtctttgtatcttggaaccaggtaatagcttagtccagatccttctaacatgaaattcttttgttattgttgtctctccatttaaggagctgctccttccacatctagaggaatagatgccactaaacaatagcttgatcagttttactgaattaatctcagtaacatttgtcaacaaggatggctcagaaaagacaataagtgttccagttggcatgtccatgttagaagctgctcatgaaaacgacatagagcttgaaggagcatgtgagggctcacttgcgtgttctacttgtcatgtaatagtaatggatgtaaactattataacaagttagaagatccagcagatgaagaaaatgatatgcttgaccttgcatttgggctcacagaaacatcacgccttggttgccaagtgatcgcgaagcctgaacttgatggtatgcggctggcattacctgtagccacaagaaactttgcagtagatggctatgtaccgaaaccacactgaagagacagtcatctatccaccaaactgaggaggcagtcatcttggggaacacggattcttacaacagtcagttttgtagtttataacctgtaacttaactacagctttgtttacttgtagtccggctggcttcggactacctttttgagggagggtttgttcattgatgaacccccgggttacttgctgagaacagtgcttcatctgggcgaataaacatagtatttcgttctttgtgcagggcgaaaccagcgaataaacatctttcgttctgtgtgtactcagaaacaattgcatcatattttgctcccaatatttggtcctttgcaactttggccgctgttccgaggccagaagtacaaggatgtgtctttgttattacatatatattctgggtgggtttacacttgtttgttagg

SEQ ID NO: 4590 - DNA, 1300 bp, Zea mays
ggtggcggcggcttgtgtgtccaaagtccatctacggcacggcgtctcacagcctcaccccaactcgtcgccttcctcgtcattcccttcgtcgcggagaggaggtcacgcggctgattcccgccgcttgcgatcgggttcgtagggagcaggatcagctgacgcgatgttccccaggatttcccggctcggggcgcggctcctgcgcgagtctagagccgagacaagagctggaaacttgctaaacagtcaacgcattttctttcaagatcatgttaaccggcattcgatcccagtggtgactcctgctgtattatcgatgcggaatgcccttttgtcaactgcaacaagtggtgatcaggatgaaagtagtcaggcaaaagataagtaagtgcatttgtctcttgttttcttatagtcttatatatcacaaaatttgaactccctggttgtctttttagcttggaaccaggtaccaccttacccagatccttctaacatggaattcttttgttattgttgtctctccatttaaggagctgctccttccacatctagaggaatagatggcactaaatgcatcagttttactgaattgttagtgttgagctttcaataattatttagggtagaagcagtcctctgatgattgttgaggttatttttctccatactgtgaacagaatctcggtaacatttgtcaacaaggatggctcagaaaagacaatatgtgttccagttggaatgtccatgttagaagctgctcatgaaaacgacatagagcttgaaggagcatgtgagggctcacttgcgtgttctacttgtcatgtaatagtaatggatgtaaaatattataacaagttagaagatccagcagatgaagaaaacgatatgcttgaccttgcatttgggctcacagaaacatcacgccttggctgccaagtgatcgcgaagcctgagcttgatggcatgcggctggcgctacctgtagccacaagaaacttcgcagtagatggctatgtaccgaaaccacactgaagagacggtcatctaccacactgaagagacggtcatctaccacactgaagagacggtcatatcggggaacacggattcttacagcagtcaattttgtagtttataacctgtaacttaactacagctttgttacttgtagtccggtccgggtggcttcggactaccttgttgagggtttgttcatttgatgaatcccttggttacttgcagagaagagagaacagtgcttcatctgggcgaataaacatccgttctgtgtgca

SEQ ID NO: 4591 - DNA, 1094 bp, Cannabis sativa
aaatttaggtatcacatactcctctcctctcccatcgagccgtgcctcactccctctctccgaatctccaaccgccgtctaccgtcttcctcctccgagggctccgccgttttccgtgaaaggttatacgattatgttcatttctaaactttcaagagttggtgtttggatggttaaagagctttgtagaggaaaatctagaaccctaactagtgctggatatacacacagaccttctagccattacttgcaaacactgtcagaagctaaggtttcaaggggagcaatctttcaaaagcatcgtcttttttcttcagtaaatagcgccccttcggaggaagggagtgagccggaggaagagatttctgtgacatttgttgataaggatggtgatgagaagctcattaaagttccagttggaatgtctatgctagaagctgctcatgaaaatgacattgaacttgaaggagcttgtgaagcctcacttgcatgctcaacatgtcatgtgattgttatggatatggagtactacaataaattagaagacccaactgatgaggagaatgacatgttggatctagcttttggacttaccgaaacgtctcgtctgggctgtcaagtaattgcaaaacccgaactagatggagtccggttagctattcctagcgctactcggaactttgctgttgatgggtatgttccaaaaccacactagctagatgtaataaaaagcacacatttttgcagctcctgtattctattggatcaagatcaattatttgtttttgagtaacttatattgatgagttctcatcatctaaagaactgaactagtgtaatagtagttctcttgatttgagggaattttcctgaccattttaatttatggtatggtgtattatgcaataagaaattcttggaagagttatttgtattggcttttgttgcctttttaataaggtatgcttagctttgggcttcattataagctcagcagttgtatgtaatacattatacatactcaattttgaagatatgaattatgcattaaagtttagcatataccattactcatataattattggtatcttta

SEQ ID NO: 4592 - DNA, 744 bp, Eschscholzia californica
tctctctctctaacccccagttgctgtttcaatcatgttcaaacataaactatcacaagttgcatctttgatggtcaaagagttcactggaggaggtcagttgagtaacttaagtagaaggagctatttgagaggaccttgtgatcgttctccaactccgaagtttcgctcttttgcaagttcagctgccgatagtgctcatggggaagtaaatggacaacaagagaaaatatccgttacatttgttgacaaggatggagaggaaaaggaaatcaaggttcccattggaatgtccatgttagaagctgcccatgaaaatgacatcgaactcgaaggagcatgtgaaggctcacttgcttgctcgacatgccatgtgattgtgatggatgtgaactactacaataaacttgaagacccgacagatgaggagaatgacatgctagatcttgcctttggattaactgaaacgtctcgtcttggatgccaagtaattgcaaaacccgaactagatggagtccgcttagcattgcctgctgcaactcggaattttgctgttgatgggtatgttccaaaaccacactaaagacgattatttagcagcttccttttcagcaaagcccatcaccgtagaggactcttgagtagattatttctttacatacgtaaatgcacgaacgagtctcagttttgtagcttttccccgatataatgtcaagtagatactctctctatctccttaatcat

SEQ ID NO: 4593 - DNA, 1132 bp, Malus domestica
caggtaaacgcttcggttccccgaaaggccataactgttttttcaaccttttcttactatagattttggcatcgaagcctcccttgcttgttcatcttcctcgttgcgctggtgctacataaattctgtgctacctctctcagtcaccaaactgattttcctccctgctccaggctccagaggataataatttcacagcctttggttttatggattaaagttcctcaacttgctttggtggaattagggtttaccaagaggtctgacgattatgtttgcttctcaagtatcaagaattggagttttgatactgaaacagctctcaagaggcaaatctgtgtctataacaagagcaggagatactagtaattcttacagacattacttgcaacctctgtttgatcaacaatctgaaactaatttgttgcgaggaaccatctttgagaagcatcgtcttttttctaccagtagtgccagccattcttcgaatgaagggattgagcagaaagaaaagatatctgtgacatttgttgataaggatggagaggaaaaacatatcaaggttcctactggaatgtctatgcttgaagctgcccacgaaaatgatatagaacttgaaggagcgtgtgaaggttcacttgcctgttcaacatgtcatgtgattgtgatggacgtggactattacagcaaattagaagacccaactgatgaggaaaatgatatgttggacttggcctttggactcactgaaacgtctcgcttgggttgtcaagtcattgcaaaacctgaacttgatggaattcgtttagcaattccagctgccacccgaaactttgctgtcgatggctatgttcctaaaccacactagagatgatgcacctgaacttgatggaatttttgtagctattcctgcagccacccaaagcgatgattgtggaagagttggttgagtgtaacgtataacttcacagttttggagctcctgtattttattggaccaatgagcacgacttaagatatatatatttgttacttttatcaattatgtcccagtttgggagtaattctgggagggtcataataacttgtagaaaaaaatatgtgatggattagagccaagatggatctacta

SEQ ID NO: 4594 - DNA, 654 bp, Amborella trichopoda
tagaatcactgtgactttcgtggataaggatggtgaggagaagcaaataaaggtccctgttggaatgtccatgttggaagctgcccatgaaaatgatatagaacttgaaggagcatgtgaaggatcccttgcatgttcaacttgccatgttattgtaatggatgtggattattataacaaactggaagatccagcagacgaggagaatgacatgttagatcttgcctttggactcacagaaacgtctcgtctgggttgtcaagtgattgcaaaacctgaacttgatgggatccgcctagctctcccagtagctaccagaaactttgcagttgatggattcgtgcccaagcctcactgaaattcaaacaaaacaatcccgcacccaacaaccccagttgatatgctctttgagtgcatagaatctgaccatctcaattttgtactatcgtcagcattcaggtttataagtggaaggctttcggttcttactatctctgcttgtttgagatcaatccctattaatcacagtggctgatatttcctgaggttaactgcatttgtcttgtcaaattatgtattgtcttttttgaatgggttgccatctataattattcaaaataaaaattggcaaatggaatttgggggcttgaaagt

SEQ ID NO: 4595 - DNA, 602 bp, Abies balsamea
agaaaaattaatgtggatgctgatgggctttcaaaagctgggctgcatttggatgcacgaatttggcacaatcaggagcaggcggatgaacagaagaggaattttgcgtcaaagtcagataaagccaatgaatgcgagcaagaagctaacacaaaaacaatctcagtgacatttgtggacaaggatggtgaagagaagactatcaaagtgccagttggaatgtcgatgcttgaagctgcccatgagaatgacatagagcttgaaggggcatgtgaaggatcacttgcctgttctacttgtcatgttattgtcatggatgaggattactataacaagctcccggagccaacggatgaagagaatgacatgttagatcttgcttttggccttacagaaacgtctcggttgggttgtcaagtcattgctaagccggagcttgatgggttgaaagttgctttgcctcctgccacaaggaattttgctgtagatggatatgttcccaagccccattagggtgcggattttatgatgatattatcttaatcgtcgttgttatccttctgagaacagtccacattacttgtatgggagtcatggcaatt

SEQ ID NO: 4596 - DNA, 990 bp, Cannabis sativa
attttggtagtgaaaggttatacgattatgttcatttctaaactttcaagagttggtgtttggatggttaaagagctttgtagaggaaaatctagaaccctaactagtgctggatatacacacagaccttttagccattacttgcaaacactgtcagaagctaaggtttcaaggggagcaatctttcaaaagcatcgtcttttttcttcagtaaatagcggtccttcggaagaagggagtgagccggaggaagagatttctgtgacatttgttgataaggatggtgatgagaagctcattaaagttccagttggaatgtctatgctagaagctgctcatgaaaatgacattgaacttgaaggagcttgtgaagcctcacttgcatgctcaacatgtcatgtgattgttatggatatggagtactacaataaattagaagacccaactgatgaggagaatgacatgttggatctagcttttggacttaccgaaacgtctcgtctgggttgtcaagtaattgcaaaacctgaactagatggagtccggttagctattcctagcgctactcggaactttgctgttgatgggtatgttccaaaacctcattagctagatgtaataaaaagcacacacatttttgcagcttctgtattctattggatcaagatcaattatttgtttttgagtaacttatattgatgagttctcatcatctaaagaactgaactagtgtaatagtagttctcttgatttgagggaattttcctgaccattttaatttatggtatggtgtattatgcaataagaaattcttggaagagttatttgtattggcttttgttgcctttttaataaggtatgcttagctttgggcttcattataagctcagcagttgtatgtaatacattatacatactcaattttgaagatatgaattatgcattaaagtttagcatataccattactcatataattattggtatcttta

SEQ ID NO: 4597 - DNA, 1015 bp, Humulus lupulus
ctatcgagccgtgcctcactctctctccgaagctccaaccgccgtcttcctcctccgagggctccgccgttttccgtgaggttaaatacgattatgttcatttctaaactttcaagagttggagtttggatggttaaggagctttatagaggaaaatccagaggcctaactagagctggatatacacacagaccttttagccataacttgcaagcactgtcagaagctaaggtgtcgacgggagcaatctttcaaaagcatcgttttttttcttctgtaagtagcgatccttcggaggaagggagtgagctggaagaagagatttctgtgacatttgttgataaggatggagaggaaaagcttattaaggttccagttggaatgtctatgctagaagctgctcatgaaaatgacattgaacttgaaggagcttgtgaagcctcacttgcctgctcaacatgtcatgtgattgtgatggatatggagtactacaataaattagaagacccaactgatgaggagaatgacatgttggatctagcttttggacttacagaaacgtctcgtctgggttgtcaagtaattgcaaaacccgaactcgatggagtccgtttagctattcccagcgctactcgaaactttgctgttgatgggtatgttccaaaaccacactagctagatgtaataaagcacacatttttgcagctcctgtattctactggatcaacatccccctcccttatttgggtttctaatatcaattattggttttgagtaacttatattgctgagttcaccatctaaagaacagaactagtgtaatagtagttctcatgattttgagggaattttcctgaccatttaatttataagaaattattggaaaagtaatttgtattggctttgttgcattttaataaggtctgcttagctttggactttcttgtgagctcggcagttgtatgtaatacattatagcatacatactcaattcagaagatatacatttaagttt

SEQ ID NO: 4598 - DNA, 1241 bp, Populus trichocarpa
aaagtaaacgacctgtcggtttgcttaagggtgtgtttgcttctgtatttttttaagctttcaaagcttaatagacagaaaccctccagagaattcgcggctcaaagctaggagaaccagaaattgaacagtgaacacaaaaagacataaactttgttgtatcgtcgactctgttctttttcagtttcaccaaactgtttaggagaaagattatgttaaggtctagactttcaagaattggagctgggatagtcaaagaactctcaagaggacaatgtacagccatgtgtagatcatcatttatactaaggccgtatagtgcatgttggcgacctcaggttgaattacacccagaaactaagggtttccaaggtactatatttcgaaagcattaccagttctctagcacagctaccagtagtgattctgcaaatggcagtgacccagaggagatgatatccataacatttgtaggtaaggacggggaggaaaaggatatcaaggtccctgttggaatgtccatgttagaagctgctcatgaaaatgatatagaacttgaaggagcatgtgaaggctcacttgcttgttcgacgtgtcatgtgattgtgatggacatggaatactacaacaaattagaagacccagctgatgaggagaatgacatgttggatttggcatttgggcttacagaaacttcccgtctgggttgtcaagtgattgcaaagcctgagctcaatggaatgcgcctagctattcctgctgccactcgtaattttgccgttgatgggtatgttccaaaaccacactagacaacatgtttcggcaccagaagatgtttattgagtgtaaaaatgtgatcgtcccagttttgtagctcctttgctgtagtggatcaatgagcatatacaacagtcaagccatccctttccattgaatattttgcttatctatctcaataatcaccttcactaattctaagagatacacaaacaatgttaccattttagtggtcagcaaagttgtagctagaccatccaatttttattatttgatttatccccatattttacacaatatgtacatcaagtacataaagtcattcataatatagaacattctttctcaggaacctagttaagttcagacataagagatgttgacttgttagcgattgttacattggattatgttctgttctggttttagtctaaatgaaatacaagttggattcttagctacta

SEQ ID NO: 4599 - DNA, 1500 bp, Glycine max
gggctttgagagattgggcttttgaagctgattttacaactcaaatctttctcccatctttctcgcatgctttgcggctcttctggtcacattcttcctcgccaccacggcttttgtaacatcggtttcttaaacccctaaaatcactatgctaaattcccgagtagtagctagagtcggagcttcgatcgttaaacacctctgcacaaggaattgtacatccttgcgtggagtaggatatattcgaagcgcaagatatcatcacaatcaacctctgtttcaacagcattcttttactaagttatacaagggagccatgatagaaaagcataatttcctttcaacaatgactactaacaacactactgaggaaggaagtgaacaagaacaaacgatatctgtaacttttattgataaggatggtgaggagaagcatatcaaagtccctgttggaatgtctatgttagaagctgctcatgaaaatgacattgaactagaaggagcatgtgaaggctcgcttgcgtgttcaacttgccatgttatagtcatggacgtagaacaatacaataaattggaagatccaactgatgaggaaaatgacatgttggatctagcttttgggcttactgaaacatcacgtctgggttgccaagtgattgctaaacccgaacttgatggaattcgtttagctattcctgctgccactcggaacttcgctgttgatggttatgtgccgaaaccacactgactcatttgttttggttcaatgcaaagagtgttgctttcagttttgtaccctcaccgatttagataaatcggcatttattgatcatatcataggcattatttttgtattgtccgtgttcacggagcacctctatatatcaatttagagagagatcgatcatgttgtaattttcgacgggctacatttttgcgtgtcaataaattacttgtactgttttatattcttgaaccaataacgtgaacaaacacgtccaaaaaatataaatatatgaaaggcagaatggaggacaagattatttgggccttcttggattcgagagtattgatccaaatcaaaccgaaggtagttttcctgtgtatgttaagttgctacccgatttcgctatttatgttttacatttgtctatcacggtcagattttatttcaagtaatttctaacaaaaactcaagtaaaattaatcggtaaatattatcatttgtaattaattatgtagttgctcgttttctcgtaaatgttgccttgtgtatcctttcattacgagtcgtttgagatccttggaaaagatgcctaaaaggagaaatgctggggaaactgtctcaaggatattgaatataaaagaaaatataaaggtatttttgctggtttgtttctacctttttgttctttcgttagtcttctaaataaaaataacatgaaaaaaatgatattattataattgagtgaaaatataagatatatcaactaaaaatgg

SEQ ID NO: 4600 - DNA, 845 bp, Amorphophallus konjac
tcgagggataatgttcctctccaagctccggcaagcaggatttcggatggtctcgcagtccaaatcaggtcaattacctgtagcaaggatgggatattttcagcaaccattcagtcattatttgtggcctttgaaccggcactgttctacttcagccactagtgaagttaacaaggaaggatctgagaagaaagaaaaaataactgtgacatttgttgacaaagatggagatgaaaaggttattcaggtccctattggaatgtcaatgctagaagctgcccacgagaacgacatagaacttgaaggagcatgtgagggctcccttgcttgttccacttgtcatgtgattgtgatggatgttgatcagtacaatagattggaagatcctacagatgaggaaaatgacatgttggatctcgcctttggactaacagagacatcacgccttggctgccaagtgattgccaaacctgaacttgatgggattcgcttggcattgccagcagctactaggaactttgcagttgatggttatgtacccaagccccattgatatctgcatccttctttgagtgtagaggtagcatcataaacccgattttgtagttcatccatgtaaacctttttttcttcaatagacattttaatcagcacactgcagatctccacaaaatccacctctgccttgacccaaagtagagcaaattagggtcttggttatacgtcatcagttgacaaccatcgctagtttatgtaagttaattggtttatcttggagttttgactacacgagtccagtgtaccttcaacattcgctattcacaaggaataaaggttgtatctag

SEQ ID NO: 4601 - DNA, 914 bp, Elaeis guineensis
cctctcccgagtctccttcgactcagcccgtgcccgctctcctcgctggagcagagcgagaaccgccagtgtccttcgccgccgtcctcctccaacccctcgttctgcggttgaggtccgatcatggttctctctcggttctcacaacttggggcccggttcttgaaagagtctggaataggtcagttttgggtaactagaagaggatgtgtaaaatggccttccagtcattacttataccccacgaaaagtctttccttttctactgcagtcactggtaaagctcaagaggaaagcagtgaacaaaaagagaagataactgtgacgtttgttgataaagatggtgaggaaaaggtcatccaggttcctatgggaatgtcaatgttagaagctgcccatgaaaatgacatagaacttgaaggagcatgtgagggctcgctagcttgttctacctgccatgtgattgtgatggatatggaatactacaacaaattagaagatccagcagatgaagaaaatgacatgttagatctagcatttgggcttactgaaacgtctcgccttggttgccaagtgattgcaaagcctgagctagatggaatgcggttagcactaccagcagctactcgaaactttgctgttgatgggttcgtaccaaaaccacactgagtgtgtttacatacttttcaagtgtaaagattgcatccaaaccacaattttgcagtttgtgctgctggacaattttgatctttaacatccaaaatcatcaaaatcagacgtgccattgttgtacaataatcattcaacacttcaaaagacaaaaaaaaaaaaaactaaacgtaggaacttacgaccgaaaccggaacggaccaaacccgtaaacgggggtaaagggggtaaacgggtaagggaca

SEQ ID NO: 4602 - DNA, 1013 bp, Glycine max
gcaattttagggtttcttaaacccctaaaatcactatgcaaaattccaaagtagctagagtcggagcttcgatcgttaaacacctctgcacaaggaattgtacatccttgtgtggagtaggatatattcgaagcgcaagatatcattacaagcaacctctgtttcaacatcattcatttactaagttatacaagggagccatgatagaaaagcataatttcctttcaacaatgactactaacaacactaccaaggaaaggagtgaacaagaacaagcgatatctgtaacttttattgataaggacggtgaggagaagcatatcaaagtccctgttggaatgtctatgttagaagctgctcatgaaaacgacatagaactagaaggagcatgtgaaggatcgattgcgtgttcaacttgccatgttatagtcatggacgtagaacaatacaacaaattggaagatccaactgatgaggaaaatgacatgttggatctagcttttgggctcactgaaacatcacgtctgggttgccaagtgattgcaaaacctgaacttgatggaattcgtttagctattcctgctgccactcggaacttcgctgttgatggttatgtgccgaaaccccactgactcgtttttttgggttcaatgcaaagagtgccgctttcagttttgtaccttcaccgatttagataaattagcatttattgatcgtaggcattatctttgtctacagagcacctctatatatcaatttagagagagatcatggtgtaatttttgacgggctacagtttgcatgccaataaattacttgtactgtattattttttttgtaccaataacgtgaacaagcacgtccaaaaaatctaaatatatgaaaggcagaacggaggacaagaatatttgggccttctaggactcgagagtatagatccgaatcaaaccgacagtaattttcctgtgtttgactgtttgttaagttgctacccgatttcgatatttatgttt

SEQ ID NO: 4603 - DNA, 1414 bp, Cajanus cajan
tggttgtaaggtgaaaaatacacatctaatggagagaaaatattaagcaaaatgaagtggagcgagtgtcaaccaaatccaagttaagcaaacgtcatgaataaaaggttgcacaatttcatggttgggcttggattattgggcttggagtgtctcatctcatcgttctgttctggagcctgattttgcaactcaactctgtcactcatgctttgtggctattgttatcgtctacacttaatttttctggaccggagatcccttttcatatcaatttatatttatatttcctttgcaattttagggctagggtttcttaaaccctaaaatcagacctaacttctcaaattgcattttttttctcccgagtgaagatccttttttcatatcaatttatttatttcctctgcaactttagggtttcttaaacccctaaaatcactatgctaaattccagattagccagagtcggagcttcgatcgccaaacacctctacacaaggaattgttcatccatgtgtagagtaggatatattcgaagcgccagatataattacctgcaacctccgtttcaacagcattcatttactaagttatacaagggtgccatgattgaaaagcatcatttcctttcaacaatgactactaacaacactactgaggacaggagtgaacagaaagaaacgatatctgtaacttttattgataaggatggtgaagaacagcatatcagagttcctgttggaatgtctatgttagaagctgctcatgaaaatgacattgaactagaaggagcatgcgagggctcgcttgcgtgttcaacttgccatgttataatcatggacgtagaacattacaataaattggaagatccaactgatgaggaaaacgacatgttggatctagcttttggacttactgaaacatcacgtctgggttgtcaagtgattgcaaaacctgaacttgatggaattcgattggccattcctgctgccactcggaacttcgctgttgatggttatgtgccgaaaccacactagtaatgacccatttattttggggttcaatgcagagagtgcaactttctcagttttgtagtcattgattttgataaatgatgatcacataggcattatttttgtatttttttcgtgttcacggagcacctttatcaaattagagagatcatggtgtaattttcgacgggctacattttggacgccaataaattgtactgtattaatttattgtaccagtaaggagggcaagccacaatagcatggtttgcatatttaaattttttgttcgacatttggtcgggttttaatcggaattaatccgaaaatattaatataaaccatcattcttgccatatatttgaaattaattgtttgttagcttgcattcaggaaaa

SEQ ID NO: 4604 - DNA, 1360 bp, Pinus pinaster
tcgattctcaccttgaaaagtgagcaacggaatacctttcctttgtcacgacttaggtttcggaggtcccaaaccttgaaacaatgcatcttatttctgaagttcgcatgccccttcacaaatttacagccgcgtagcgatgacaaatgcttcaatccaccttcttgcaactgtggtcaatcggctgggttagggttagggttagggcagacgaggtgctttcggtgaagattgattgatcctctttaacggaaagggtagctcgtcataatgcaggccgctgcgaagcgggccgcccagcttcgccctctctcggctggtaatggttttgtgggactgcggtatgctttacctgttcagggagcttcatctgaatacaagttcgaccattcacggtgtgcgtcatcgctgactgataatgggcatcttattcgcacaggaatcggagggagatcatctgtcagcggtatcattgcaactctctttggagccacgggtttcctggatcgatatattgtccatcaagttgctaagatgggttcgcaagttctggttccctttagaggtttggaggattcacccaggcatttgaaacttatgggctatctaggacaaaagaggaatttcacttcagagtcagataaagctgatgaaaaccagcaagcagctaacacggaaacaatctcagtaacattcgttgacaaggatggtgaagaaaatactatcaaagtgccagtaggaatgtcgatgcttgaagcggctcatgagaatgacatagagcttgaaggggcatgtgaaggatcactcgcctgttctacttgccatgttattgtcatggatgaggattactataacaagctaccggagccaacagatgaagagaacgacatgttagatcttgcttttggccttacggaaacgtctcggttgggttgtcaagtcatcgctaagccggagcttgatgggatgaaagttgctttgccttctgccacgaggaattttgctgtagatggatatgttcccaagccccattaggatgatattgtcttgatctttgttcttattcctgtaataacaatccgcatcacttttatatagagtcgtggcaatttttgtaatgagagcaacaatgatttttttcaaggtttttatcatttcttattttacctgtctgcttcattattctgcccaaccatttttgtggattgtttaatgagcctgaaaatgtggttctagcaaagttgacattgcctactgctagaacctgtcctctctactgttttgccttcgacgttcaaattgcattgacgataatgataacagaagccccaataactagttactctcgaggatgcaataa

SEQ ID NO: 4605 - DNA, 1414 bp, Pinus taeda
ggggattttcattatcctcagtggtggaacttcctgtaaaatctctaatattccactctcgcataggctttcgttaaaatctttgacaacgtaaatgttgttccttccattatcagcacacaatctcgattctcaccttgggaagtgagcaacggaatgctcttcccttgtcacgacttagggtttcggaggtcccaaaccttgaaacaattcatcttatttctggagtttgcatgccccttcacgaatttacagtggttttgtgcccagccgcgtagcgatgacaaatgcttcaatccaccttcttgcaactgtggtcaatcggctgggttagggttagggttagggcagaggaggtgctttcggtgaagattgatcgatcctctttaacggaaagggtagctcgtcataatgcaggccgctgcgaggcgggcagcccagcttcgccctctctcggctggtaatggttttctgggactgtggtatgctttacctgttcagggagtttcatctggaatcggagggagatcatctgtcagcggtatcattgcaactctctttggagccacgggtttcctggatcgatatattgtacatcaagttgctaagatgggttcgcaagttctggttccctttagaggtttggaggattcacccaggcatttgaaacttatgggctatctaggacaaaagagggatttcacttcagagtcagataaagctgatgaaaaacagcaagcagctaacacggaaacaatctcagtaacattcgttgacaaggatggtgaagaaaatactatcaaagtgccagtaggaatgtcgatgcttgaagcggctcatcagaatgacatagagcttgaaggggcatgtgaaggatcactcgcctgttctacttgccatgttattgtcatggatgaggattactataacaagctaccggagccaacagatgaagagaatgacatgttagatcttgcttttggccttacggaaacgtctcggttgggttgtcaagtcatcgctaagccggagcttgatgggatgaaagttgctttgccttctgccacgaggaattttgctgtagatggatatgttcccaagccccattaggatgctattgtcttgatctttgttcttattcctgtaataacaatccgcatcacttttatatagagtcgtggcaatttttgtaatgagagcaacaatgatttttgtcaaggtttttatcatttcttattttacctgcctgcttcattattctgcccaaccatttttgtggattgttaaagaagcctgaaaaatattggttctagcaaagttgacattgcctactgctagaacctgtcctctactgtttgccttcgacgttcaaattgcattgacaataatgataacagaagcccacatctgttct

SEQ ID NO: 4606 - DNA, 981 bp, Populus trichocarpa
agataattcgcagcccaaaactaggaaaacccgaagttgaacagtgaacacagaaaacacaaacttcgttgtatcttttgctctgttctttctcagtttcatcaaacaggggaaagattatgtcaaggtctagactttcaagaattggagttgggatagttaaagagctttcaagagaacaatgtacagccttgtgtagaaaatcatttatacgaaggccttatagtgcatgttggcgatctcaggtcgaattacacccagaatctaaggggcaccagggtagtatatttcaaaagcatcatcagttttctagcacagctaccagtagagattctgcagatgggagtgacccgaatgagatgatatctgtaacatttgtagataaggatggagaggaaaaggatatcaaggtcccagttggaatgtccatgttagaagctgctcaagaaaatgatatagaacttgaaggagcatgtgaaggctcacttgcctgttcgacatgtcatgtgattgtgacggacatggaatactacaacaaattagaagacccaaccgatgaggagaatgacatgttggatttggcctttgggcttacagaaacttctcgcctgggctgtcaagtgatcgcaaagcctgagctcaatggaatgcgcttagctcttcctgctgccactcgtaattttgccgttgatgggtatgttccaaaaccacactagacatgttttggtaccagaatgtgtttgttgagtgtaaaaaaatgcaatcttcacagttttgtagctcctttactgtagtggatcaatgagcatctccaacattcaagtcatccctttccattgattattacatatctgtctcaataatcactttccccaagtcttaagagcatacagcatcaatgttaccatttcctggtcagctaagttgttgctagaccttgcaatttttatcatataatttatctccaaactttacagaata

SEQ ID NO: 4607 - DNA, 696 bp, Sequoia sempervirens
ggaaacgcggaatctctgtgacatttgtcgataaagatggtgaggaaaagacaatacaggtgccggttgggatgtcaatgcttgaagctgctcatcaaaatgacatagagctggaagggcctgtgaaggatcgcttgcatgttctacctgccatgttattgtcatggatgagaactattataataaactagaggaaccgacagatgaggagaatgacatgttagatctggcttttggtcttactgaaacgtctcgattgggttgccaagtaattgctagcccagaacttgatgggatcagacttgctttgccttctgccactagaaattttgctgttgatggatatgttcctaaaccgcattaattattgcaaatcaaaaagaccatggattgaaaatatttttgcagatgtaatccttgccatttatttgtgattgtgcttagcttagtctcacatacatttatatgtcaaggaacttttgtgtagtgttcaaaaaatgagtttttcttctcccgatataatcctttttgcaactatttgtctttgtttgcacctgccaataggtgttaaattatattcatgtcggggtgaatgtggtcattttatattggtgagaacaagtgatttttcgccagcctacgaatatgaggcttatgagaatattatgatctgaggcacaatctatgtaatgacat

SEQ ID NO: 4608 - DNA, 1311 bp, Picea glauca
aattcatgaaagctcaagaatatgaataccattccgtacaggtttttgattttttaatctctcagcgacgacgtcagtcgttatctctcacccatttccaaatggcaatggaactttttctttagattctctactatttcacagaactaagaacccattcttcaaacctcagttcatctgtacggttcggcgagaaatccatggcgctactgtgtcgccggaaaactcttctctaccgggaacttcacggattaggtctccgtgaaagttattattcgaatgggaagtttaatagggtcatttcttcatttgatcagtttagggtttcgagaatggggatttccaaagcagttcaaatgcagcctgcggttaaaaaaccctctcacgaggaaatgacgaaagaacgcttgccggagccacggccattcgatttgtacaggtcgatatgctcgtcggatcgccggggcggtgcagttgcagcgttggaggggtggttaaatggaggccggaaggccgcgaaatgggagccaaaccgtgttatcagtgacccgatgaagtataagagagacatccatgctctccagaagaggaatttcgcatcagagtcggataaagctgatgaaaaccagcaagaagctaacacggaaacaatctcagtgacattcgttgacaaggatggtgaagaaaaaaccatcaaagtgccagttggaatgtcgatgcttgaagctgcccatgagaatgatatagagcttgaaggggcatgtgaaggatcacttgcctgttctacttgtcatgttattctcatggatgaggattactataacaagctaccggagccaacagatgaagagaatgacatgttagatcttgcttttggccttacagaaacgtctcggttgggttgtcaagtcattgctaagccagagcttgatgggatgaaagttgctttgcctgctgccacaaggaattttgctgtagatggatatgttcccaagccccattaggatgcggatttgaagttgatattatcttgatcttatccttgtaacaacaatccacattacttttatatggagtcatggcaatttttgtaatgagagcaataataatttttggtaggcttttgtcatttcttattttacttgcctgcttcgttctgcccaggcatttttgtggattgtttaatatgtctgaaaaatattggttctagcaaagttgatcttgcctactgccaaccttttttctctctactaaggtcttatatatatataatgccaacttttatccttcgaggttacaaaaaaaaaaaaa

SEQ ID NO: 4609 - DNA, 1134 bp, Picea glauca
  misc_feature (67)..(67): n is a, c, g, or t
  misc_feature (1073)..(1073): n is a, c, g, or t
  misc_feature (1132)..(1132): n is a, c, g, or t
acccattcttcaatctcagttcatctgtacggttcggcgagaaatccatggcgctactgtgtcgccngaaaactcttctctaccgggaacttcacggattaggtctccgtgaaagttattattcgaatgggaagtttaatagggtcatttcttcatttgatcagtttagggtttcgagaatggggatttccaaagcagttcaaatgcagcctgcggttaaaaaaccctctcacgaggaaatgacgaaagaacgcttgccggagccacggccattcgatttgtacaggtcgatatgctcgtcggatcgccggggcggtgcagttgcagcgttggaggggtggttaaatggaggccggaaggccgcgaaatgggagccaaaccgtgttattagtgacccgatgaagtataagagagacatccatgctctccagaagaggaatttcgcatcagagtcggataaagctgatgaaaaccagcaagaagctaacacggaaacaatctcagtgacattcgttgacaaggatggtgaagaaaaaaccatcaaagtgccagttggaatgtcgatgcttgaagctgcccatgagaatgatatagagcttgaaggggcatgtgaaggatcacttgcctgttctacttgtcatgttattctcatggatgaggattactataacaagctaccggagccaacagatgaagagaatgacatgttagatcttgcttttggccttacagaaacgtctcggttgggttgtcaagtcattgctaagccagagcttgatgggatgaaagttgctttgcctgctgccacaaggaattttgctgtagatggatatgttcccaagccccattaggatgcggatttgaagttgatattatcttgatcttatccttgtaacaacaatccacattacttttatatggagtcatggcaatttttgtaatgagagcaataataatttttggtaggcttttgtcatttcttattttacttgcctgcttcgttctgcccaggcatttttgtggattgtttaatatgtctgaaaaatattggttctagcaaagttgatcttgcntactgccaaccttttttctctctactaaggtcttatatatatataatgccaacttttancc

SEQ ID NO: 4610 - DNA, 928 bp, Taxus baccata
ctcagattttccacagtttcttctggaaatgcattgattcctggagctttgctcaggcccttttccacgacctccataagggcagatgctgaaagaagcaagaaatctggctctgctgtaaaaagagcttgccaagcagaggagagacatattcgcaacaagtccggcaagattctgatgaagacctgcatgaaaaagactttaatattggaaggatacacaaatttatctcatccaatctcttcgcgaactacatctgcttatgccaaaatggaagagacaaatgaacaacgttatgaaggtcacgtggaatcgaagcgaagattttcatccaagacaggtaaagctaatgacaaccgtgcagaaggaaacaaggaaacaatctctgtgacatttgtcaataaagatggtgaggaaaagaccatccaggtgccagtcgggatgtcaatgcttgaagctgctcatcagaatgacatagagcttgaaggggcatgtgaaggatcgcttgcatgttctacttgtcatgttattgtcatggatgagaatatttatagtaaattagaggaaccgacagatgaggagaacgacatgttagatctggcttttggtcttactgaaacgtctcgcctgggttgccaggtaattgctatgccagaacttgatgggatgagacttgctttgccttctgccactagaaatttcgctgtcgatggatatgttcccaaaacccattagtaatcacaaataaaaaagaatgctgattgagcaattcttggaggggtaatcagtcatttttggagttggcatagtttggattcatagacatacaattatatgtatgaatccaaactatgccaactaaaatgtattgtttctgaacaccgcatttgcaggtatttgtttttttttttattgcaataggtaatag

SEQ ID NO: 4611 - DNA, 423 bp, Platanus occidentalis
agatacttgtgacatttgtcgacaaagatggagaggagaagcatatcaaggtcccaattggaatgtctatgttagaagctgctcacgagaatgacatagaacttgaaggagcgtgtgaagcttcacttgcatgttccacctgtcatgtgattgtgatggatgtggattactataataaactagaagatccgacagatgaggagaatgatatgttggatcttgcttttggtcttactgaaacgtctcgcttgggatgtcaagtgattgcaaagcctgagcttgatggaattcgcttagcgctgcccactgccactcgaaattttgccgtcgatgggtatgtaccaaaaccacactgaattttctgatggtgagatgctggataattttctagtgtaaggcataccagtttggtagcgtcccccc

SEQ ID NO: 4612 - DNA, 468 bp, Nicotiana tabacum
acgaggaaaagcaaacaaatatcggtaacctttgttgacaaggatggagaagagaagcatatcaaggtccctgttggaatgtctatgttagaagctgcacatgaaaatgacatcgagctcgaaggagcatgtgaagggtcacttgcctgttccacctgtcatgtgattgttatggatgtggactactacaacaagctagaagatccaacagacgaagaaaatgatatgttggatcttgcttttggcctcgcagagacgtctcgtctaggttgtcaagtaattgcaaaacctgaacttgatggacttcggttagctcttcctgcagccacaagaaactttgctgttgatggctataagccgaaaccacattagagaatctctaacatggataaaagattactggtgggatctgccaaaaatcaatgccagttttgtagtcctctcacaagtgagtgtataataatacct

SEQ ID NO: 4613 - DNA, 798 bp, Brassica napus
cgaacggaggaagaggttgtccttgtccacgcacgaaccctaaatcctctctttcagcccattcctccatcagtcttcaatcactcaaggaaaaaaggatcttcctttcgtcgaatcttctataaaactcaactttttgtggccgctggaatgatgctcttccataggctatcgagattaggttctcgcattgttaaacagcttcctagagagaggcatttctcagtatgcgggatgcgggttttacaaaggtcttatggtcattatctgcaatcttcggctgctgtactacagaggcaatctgggacttgtcagcaagcctttttctcaaataatcattatctgtgtacatccttcagtactgcctctggaaatagcggcgaagaaacagaaaagataaacgttatctttgttgataaagatggagaggagattcatattaaggtcccagttggaatgaacatccttgaagctgctcatgaaaatgatatagaactcgaaggggcttgtgaatgttctctagcctgttccacgtgccatgtgattgttatggacacggagtactacaacaaacttgaagaaccaacagatgaagagaatgatatgttggatcttgcttttgggttaacagaaacgtcaagattgggatgtcaagtcatagcaaaaccagagctagatggaatacgcttagccattccttcagccactaggaatttcgcagttgatggattcgttccaaagcctcactaagccccttcaacgtctctcacagaggatgagtattctattagttgagta

SEQ ID NO: 4614 - DNA, 1515 bp, Eucalyptus grandis
ttttcccttttcgcgagttcgaacgggccacgcctctcgccgccaggaagaagcagcagcatcgggaacgattcccttcttctctctcgccgccgtcgacgtctgctttcatctccttctcaaactctctctctctctctcagcaaggtaggactcgttgaggcggcgccgagtatggtgatctccagggcatccagaatcggagctcgcgtcgtcagggagctcctctcgcgacgaggtccgtccgcgcctctctctctcggttagggatttcgctcgctcgttttggttcggtcccgtgtcgtttcgcttctgacgacgtctgttttggcatcggatgattcgcgaagtgagttttttttccacctgctcatgctcgatatattgctgattcgttcggtctggattcttttcgattttggcaggcgcgagtacgtccctcgcaagaagacatctaggggcgcgaagacaatctagtcctgcaatgcagccttcggataagctgttccagggtgccctacttcagaagcatttcttttgttctacaaccactgctgatggtgctcatgggggatgcgatgaagagaaagacaagatatctgtgacgtttattgataaggatggtgaagaaaagcaaattaaggttcccattggaatgtcaatgttggaagcagctcatgaaaatgatatagaacttgaaggagcatgtgaaggttcgcttgcatgttcaacatgtcatgtcattgtgatggacgtggagtactataataaactggacgatccaactgacgaggaaaatgacatgttggatttagctttcgggcttacagaaacgtctcgtcttggttgtcaggtgattgctagacctgaattagatggagtgcgcttggcgattccagcagccactcgaaactttgctgttgatggatacgttccaaagcctcattaacatgatataactttggaaagttttttctgtgtaaaggatgcagtcatcccgattttgtagcagaggacgtgcaatttgctccgagcctaacttgttactcatgataaatcaacaaggtaagagatccttcattcttgtgactgagagagcggaaatcccaagtagttttagtttgttgagtggaatttatagttgaaatgataatttatctagacatgcatggagcatctattgaccaaggcttgggtgttccaatgctctgataactatccattggaacttttatccagtgtatgcattgctagaacttgttacaagtgcataacgtgatgctactctgtgtcaaactgcatttggtcacattattggggagcgaaagttcgaataaacttgtaaatcttgactaatctctactttttaatcattttcatcattttcgttcttcatgtaagttatttatgggtggcttcaatgaagttgatgacagtctaccaatgctaatgctttgaatatgtgacaacttgtatttctcctttgcccattataaaagatatggtcttctaact

SEQ ID NO: 4615 - DNA, 838 bp, Setaria italica
tccacaatttctgtgactacatttgctccatgtgacctgcctaaatttttctgaccgtataccaggtcaaaattcagttccttcaaggagccatgaagtagaggcaattagcacttatatgatccgtgcggggaggaatttattctgttcttccacaaacgctacaacaggtgacagtaacaacaaactggaagctagaatatctgtgacttttgtcgataaggatggtgaggaaaagctcgttaaagttcctattggaatgtcaatgctagaggctgcccatgagaatgatatagaacttgaaggagcatgtgagggctctcttgcatgttcaacatgccatgtgatcgtaacggatgtaaactactacaacaaaatggaagatcctgtggatgaagaaaatgatatgctggaccttgcttttgggcttacagagacatctcggcttggttgccaagtaattgcaagccctgagcttgatggcatacgcttggcactgccagcagcaaccagaaattttgctgttgatgagtatgttgcaaaatcacactgactgaccaagagcacttagttcatgaaagtcacatgttggaatttggatacctgctcagtttgacagaataagagaatgagatatattgtttgttacgctcgtcttgtcatatcttcaattctggatttcacattaaactggtttccttctctaattttggagagatggaaaatctgtcagtttactatttcagtaacttcttgaggatgcagaagtcatacattaatgatcatactgttgattatatagaatttcaaatgcttgaaaacatcatctttgttgact

SEQ ID NO: 4616 - DNA, 975 bp, Gossypium raimondii
gttccttgaaacggcgtcgttcactctctcttctttctcccggtagtctctacggcgcatattattctaaagaaacttgttcatctaacctcagccaactgccctcgccggcgggccaccatttgccttcaaaactagtcagagttttcgtcttaaagcgcattagagatcactgtcccagacctccctcttatctcgttacaaaaggtggatatgcatatatgtctagatcaagatatacacaaaggcattgctgtcaataccagtggtctacgcttgaattactgccagaaactagagcctttcaaggttccatatttcaaaagcatcatggtttttctacctcagcttccgatggtgcttctgcaggagcggatgaagagaaaggaacgatacctgtcacatttgtttcaaaggatggagaagaaattcccattcaagtgcctattggaatgtctatgctggaagcagctcatgaaaatgatatagaacttgaaggagcatgtgagggttcacttgcttgttcaacatgccatgtcatagtgatggacatggagtactataataaattggaagatccagctgatgaagagaatgacatgttggacctggcctttgggcttaccgaaacgtctcgtctgggatgtcaaatagttgcaagtcctgaacttgatggaattcgtttagcaatccctgctgccactcgaaactttgctgttgacgggtatgttccaaaaccacattagacatgatcaatatcaatacaacacctcactcaatttaaatgagcacagaggatccagttatccagttttgtagcttcagtaatcctatttgaatcggggagcatatattattctcaaatgattgctttttgtattgattattgcttattgaattcccaataatccttgtgtgacattgattctatatatcaaatgatgtcaaagctcccatgaccacactgtgttctgc

SEQ ID NO: 4617 - DNA, 647 bp, Carpinus betulus
tggagtttggatcctcaaagagctcccaaaggaaaatctgcagtcataaatagagcaggatgtgcacaaaggccttactcccaatattttgcttccactgttttgaacgaaatacagaaactaagccattccaggaagccatatttcagaagccacatcatttttctaccactactgctgacaatgcatccgaggaaacgatatctgtcacatttgttgacaaggatggagaggaaaagcacattaaggttccaattggaatgtctatgttagaagctgctcatgaaaatgatatcgaacttgaaggagcatgtgaaggatcgcttgcctgttcgacctgtcatttgattgtgatggacatggagcagtacaataagttagaagaccctactgatgaagaaaatgacatgctggatctggcttttgggctttcagaaacatctcgtctgggttgtcaagtgattgcaaagcctgaactcgatggaattcgtttagccattcccgcagccacacgtaattttgcagttgatggttatgttccaaaaccgcactagagatgtactatgatactggagagtgtttgctcatagcaacggcacaatcatcccaattttgtagctcctctattgtcagtggtcatagttttt

SEQ ID NO: 4618 - DNA, 834 bp, Pinus pinaster
tctctatgcgagatgctcgtcggatcaccggggcagggcgattgcatcgtcggagaggtgctggttaaacgaaggccggaaggccttaaaatgggagccaaaccgtattattagtgaccagatgaagtataagagaaacacccattctctccagaagaggaatttcgcatcagagtcggataaagccaatgaacaccagcaagaagctaacactgaaacaatctcggtaacatttgttgacaaggatggtgaagaaaagactgtgaaagtgccagttggaatgtcgatgcttgaagctgctcatgagaatgacatagaccttgaaggggcatgcgaaggatcacttgcctgttctacttgtcatattattgtcatggatgaggattactataacaatctaccggagccaacagatgaagagaatgacatgttagatcttgcttttggccttacagagacgtctcggttgggttgtcaagtcattgctaagccggagcttgatgggatgaaagttgctttgccagctgccacaaggaattttgctgtagatggatatgttcccaagccccattaggatgtggttttgaagatgatattatcttgatcatcgttcttattcttgtaacaacaatccacattacttttatatggagtcattgcatcttttgtaatgagagcaataatgatttttgcttcgttctgcccaagcatttttgtggattgtttaataagtctgaaaattattggttctggcaaaagttgatattgccccgctgctagaacctttcctctcaactaaggtcagctgttttccttcaaggatcaattacattg

SEQ ID NO: 4619 - DNA, 1307 bp, Picea glauca
ctgcagcaattcatgaaagcgcaagaatatgaataccattccgacaggttttgatttttaatctctcagcgacgacatcagtcgttatctctcacccatttccaaatggcaatggaactttttctttagattctctgctatttcacagaactaagaacccattcttcaaacctcagttcatctgtacggttcggcgagaaatccatggcgctactgtgtcgccggaaaactcttctctaccgggaacttcacggattaggtctccgtgaaagttattattcgaatgggaaatttaatagggtcatttcttcatttgatcagtttagggtttcgagaatggggatttccaaagcagttcaaatgcagcctgcggttaaaaaaccctctcacgaggaaatgacgaaagaacgcctgccggagccacggccattcgatttcatcaggtcgatatgctcgtcggatcgccggggcggtgcagttgcagcgttggaggggtggttaaatggaggccggaaggccgcgaaatgggagccaaaccgtgttattagtgacccgatgaagtataagagagacatccatgctctccagaagaggaatttcgcatcagagtcggataaagctgatgaaaaccagcaagaagctaacacggaaacaatctcagtgacatttgttgacaaggatggtgaagaaaaaaccatcaaagtgccagttggaatgtcgatgcttgaagctgcccatgagaatgatatagagcttgaaggggcatgtgaaggatcacttgcctgttctacttgtcatgttattctcatggatgaggattgctataacaagctaccggagccaacagatgaagagaatgacatgttagatcttgcttttggccttacagaaacgtctcggttgggttgtcaagtcattgctaagccagagcttgatgggatgaaagttgctttgcctgctgccacaaggaattttgctgtagatggatatgttcccaagccccattaggatgcggatttgaagttgatattatcttgatcttatccttgtaacaacaatccacattacttttatatggagtcatggcaatttttgtaatgagagcaataataatttttggtaggcttttgtcatttcttattttacttgcctgcttcgttctgcccaggcatttttgtggattgtttaatatgtctgaaaaatattggttctagcaaagttgatcttgcctactgccaaccttttttctctctactaaggtcttatatatatataatgccaacttttatccaaaaaaaaaaaaaaaa

SEQ ID NO: 4620 - DNA, 1018 bp, Setaria italica
ggcctgcttctcatccttggtcttctaaatgcgcccctggatcgcgcgcagagcagcctctctagcagcatcacgaacttcaggctctccctctctcgaccggcatcaggcgacgctgcttcggctcccgggcgaagcccgctgctaccccagcgtctgcttcggttcgcctcggcggatccagatgctgtcgaggctctctcgcgccggcctccaggccctgaaccgggcgagaccaggtcaaaattcagttccttcaaggagccatgaagtagaggcaattagcacttatatgatccgtgcggggaggaatttattctgttcttccacaaacgctacaacaggtgacagtaacaacaaactggaagctagaatatctgtgacttttgtcgataaggatggtgaggaaaagctcgttaaagttcctattggaatgtcaatgctagaggctgcccatgagaatgatatagaacttgaaggagcatgtgagggctctcttgcatgttcaacatgccatgtgatcgtaacggatgtaaactactacaacaaaatggaagatcctgtggatgaagaaaatgatatgctggaccttgcttttgggcttacagagacatctcggcttggttgccaagtaattgcaagccctgagcttgatggcatacgcttggcactgccagcagcaaccagaaattttgctgttgatgagtatgttgcaaaatcacactgactgaccaagagcacttagttcatgaaagtcacatgttggaatttggatacctgctcagtttgacagaataagagaatgagatatattgtttgttacgctcgtcttgtcatatcttcaattctggatttcacattaaactggtttccttctctaattttggagagatggaaaatctgtcagtttactatttcagtaacttcttgaggatgcagaagtcatacattaatgatcatactgttgattatatagaatttcaaatgcttgaaaacatcatctttgttgactataagt

SEQ ID NO: 4621 - DNA, 727 bp, Guizotia abyssinica
  misc_feature (640)..(640): n is a, c, g, or t
  misc_feature (649)..(649): n is a, c, g, or t
attcatactcaagtcatagcaagggtggttcgtaacagaccacatctttgttacggtcgatcacaaagatagtgcgtcattatgttcatttctagattttcaagacttggattcaagggcttatcaaaaggcccactaacaattggaccaaaaaggtcattttctcggatttctcctatagttcagaatgattatttggaattatcgagatttaaattgttctccactacagccacggaaaatttacaagaaaatgaagaaaccccaaagatctctgtgaccttctttgacaaagatggagagcaagaaattaaggttcccgttggaatgtcaatgttagaagctgcccacgagaatgacatagagcttgaaggagcttgtgaagggtcacttgcttgttccacatgtcacgtgattgtcatggacgtggaacagtataataagctggaagaccctacagatgaagagaacgatatgctcgatcttgcttttgggctgactgaaacgtctcgccttggttgtcaagtaattgcaaagcccgaacttgatggccttcgtcttgcccttcctgctgctactagaaattttgctgttgatggattcaaaccaaaaccacactgaccatatttatttggatcanagatagacnaccatttttgtaacatgagtcttgcaaataattatgcccccggtttacttacagttatgatttgtgaaagctactgat

SEQ ID NO: 4622 - DNA, 459 bp, Lotus japonicus
tttcaaatgcattcattcactaagtcatacaagggagccatgtgtgaacaaaataatttcctttcaacaatgactactaacagcactaattcaactttatgtaggatatctgtgactattattgacaaggattgcgaggaaaagattatcaaagtccctgttggcatgtctatgttagaagctactaatgaaaacgacattgaactggaaggagcatgtgagggctcacttgcatgttcaacttgccatcttatagtcatggacgtagaatattacaataagttggaagatccagctgatgaggaaaatgacatgttggatctagcttttgggctcactgaaacgtcacgtctgggttgccaagtgattgctaaacctgaacttgatggaattcgtttagctattccttctgctactcgaaacttcgctgttgatggttatgtgtcgaaaccacactag

SEQ ID NO: 4623 - DNA, 697 bp, Cajanus cajan
agaaacgatatctgtaacttttattgataaggtatggtgaagaacagcatatcagagttcctgttggaatgtctatgttagaagctgctcatgaaaatgacattgaactagaaggagcatgcgagggctcgcttgcgtgttcaacttgccatgttataatcatggacgtagaacattacaataaattggaagatccaactgatgaggaaaacgacatgttggatctagcttttggacttactgaaacatcacgtctgggttgtcaagtgattgcaaaacctgaacttgatggaattcgattggccattcctgctgccactcggaacttcgctgttgatggttatgtgccgaaaccacactagtaatgacccatttattttggggttcaatgcagagagtgcaactttctcagttttgtagtcattgattttgataaatgatgatcacataggcattatttttgtatttttttcgtgttcacggagcacctttatcaaattagagagatcatggtgtaattttcgacgggctacattttggacgccaataaattgtactgtattaatttattgtaccagtaaggagggcaagccacaatagcatggtttgcatatttaaattttttgttcgacatttggtcgggttttaatcggaattaatccgaaaatattaatataaaccatcattcttgccatat

SEQ ID NO: 4624 - DNA, 611 bp, Sciadopitys verticillata
caaagttgacaggttatttgggacagaagcagagttttacatcggagtcagataaagtctataacaatcatggagaagggaacaaggaaataatatctgtgacatttgttgatagggatggcgaggaaaagaacatccaggtgccagttggaatgtctatgcttgaagctactcatcaaaatgacatagatcttgaaggggcatgtgaaggatcgcttgcgtgttctacttgtcatgttattgtcatggatgagaattattatagcaagctagaggaaccaacagatgaggagaatgatatgttagatttggcttttggtcttaccgaaatgtctcgattgggttgtcaagtaattgctaagccagaacttgatgggatcagacttgctttgccttctgccactagaaattttgctgttgatggatatgttccgaagccccattagttatgggaaatcaaataaatggtagattgattattttttcttgtgcgggtgatatttaaggcatttttatatttgataagaacatcaatctttttgattttactagtttcgtatatgtatgtgtgtccaagcattattgtggactacttaaaacaattaaatgtt

SEQ ID NO: 4625 - DNA, 809 bp, Cephalotaxus harringtonia
ttggttatggtgttttccggcaaattggcctctattcttcactcctgcactcatattgtgacactttcccagttactacaagctcccgggtgtttgctacttcaagtgtttcagatgatttaacaaaccgatcaaagtcgtcaggttatttgggacggaagcggagatttgcttcggaggtggataaagctaatgataaatgtgcagaagggaacaaggaaacgcggaatcagtgtgacagttgtcgataaagacggtgaggaaaagaccatccaggtgccagttgggatgtcaatgcttgaagctgctcatcaaaatgacatagagcttgaaggggcatgtgaaggatcgcttgcatgttctacttgtcatgttattgtcatggatgagaattattataataaactagaggaaccaacagatgaggagaacgacatgttagatctggctttcggtcttactgaaatgtctcggctgggttgccaggtaattgctaggccagaacttaatgggataagacttgctttgccttctgccactagaaatttcgctgtcgatggatatgttcccaaaccccattagttatggcaaatcataaagaatgcggattgagtattttcttggagtagtctttgtgtcatttttgcgaatttgcttagcatggattcatagatatatttgtatgtctagaaacttttgtagactgtttaccatctagaaggtttgttcctcccaaaggtagaatatttgtttttgaacatggctcattttctctggatacgatcttatttgcaactattcatgttttt

SEQ ID NO: 4626 - DNA, 393 bp, Castanea mollissima
tatctgtcacatttgttgacaaggatggagaggagcagcacattaaggtcccaattggaatgtcaatgttggaagctgctcatgaaaatgatatagagcttgaaggagcatgtgaaggctcacttgcctgttcaacatgtcatgtgattgtgatggacatggagtattacaataagttagaagaccctgctgatgaggaaaatgatatgttggatctggcctttgggcttacagaaacatctcgcttgggttgtcaagtgattgcaaaacctgaacttgatggaattcgcttagctattcccgccgccacccgaaactttgcagttgatgggtatgtaccaaaaccacactagagatatacaagggcactggagagtttttgctgatagtaaa

SEQ ID NO: 4627 - DNA, 1059 bp, Fragaria vesca
tttcaaaaagaaatatacagaaaaattatttgtaaacggtgggagtgctgctgttttactgtttggaccagaaatccagctttcacctgtctctcaaagttggacgacagtagctgccgcttctccgccgccgatcaatttcacattcagggtttagggtttaggttgcccagattcaagggcgattatgttgggctttcgggcttcaagaatcggacttttgatacttaaacagcttaccagagacaaatccatttgtacacccacatatgccactcgttctttcactcaattcttgcaacctctgtataatcagcagtctgggacaaggttattcaggggagccatctttcagaagcatcatcatttttctaccactactgccagcacttcagaccaagggactgagcagaaagaaacgatatctgtgacctttgtagacaaggatggagacgaaagacatatcaaggttccaattggaatgtctatgctagaagctgctcatgaaaatgatatagaacttgaaggagcctgtgaaggttcacttgcctgctcaacatgtcatgtgattgtaatggacatggagtattacaacaaattagaagacccaactgatgaggaaaatgatatgttggacttggcatttgggcttacagaaacgtctcgtctgggttgccaagtcattgcaagccccgaacttgatggagttcgtttagctattcctgctgccacccgaaactttgctgttgatggctatgtaccaaaaccacactagagatagttcaggatgatttggttgaggatgtaactcggtatttatcccaattttagtagctctaattttattggcccaaagtaccgattgagtttagccctcctttttgtagttactgcattcattattatcgctgcaattttttaagttcagtagttagataatatcaatataccatatataagaggagggtgtttacaatcttctcattatgtcattcttgaagaatattgctgtctgcactctcattttcaaataaacaaataatatcacactctttgtca

SEQ ID NO: 4628 - DNA, 1000 bp, Trigonella foenum-graecum
caggaagtagcatttttggcatcccataataattaattaatttatcaaacattcaaacttcacttttcttttttagggtttgtgaagcaatcacctaaacccacccagccactatgctaaacctaaattcacgactagctagagcagcaatttcaatctctaaacacctctccacaaggaagaattatacatccatgtccatgtctagagctggatatactccaaccgcctctaattattatcgcctccaatattcgtttcaacagaatggattgactaatttatacaagggagccatgtttaaaaaacataatttcctgtcaacaacgacatctaacaacactgctgagggtgagagtgaagaagacaaaacgatatctgtcacttttgttgataaggatggtgaggaaaagcttataaaagtccctattggaatgtctatgctagaagctgctcatgaaaatgacattgaacttgaaggagcatgtgagggctcacttgcgtgttcaacttgccatgttatagtcatggatgtagaatattacaataaattagaagatcctactgacgaggaaaatgacatgttggatctagctttcgggctttgtgaaacatcacgactcggttgccaagtgattgctacacccgaacttgatggagttcgtttagctcttcctgctgccactcgcaattttgctgttgatggttacatgccgaaaccacactagttatcactggatttttttttttttacgtgtaatgcaaagaatgcagcaacgcacgagttagataaatgagcttttattgatcttaggcgtttttttggtactgagtttagacatgattgccaagctcttctgtatgacagactagagagatcatggtggaatttcgatggtacaattgcttaccaataaactacttgtattgtattattttattattgtaccagtgaaacactctccgactctaaataaacgaaaagaaagcaggctagagc

SEQ ID NO: 4629 - DNA, 1129 bp, Phaseolus coccineus
agggcatcaattcactcccctgtttcacttcagtttcgttgcatcacttcagtttcgctgcatcacttcagttccgctgtctcttcactcccctgcatctcttcacttcccttcacttccgctgcatctcttcacttccatgcggcggcagtggcgttcgttcgcggcggcgatggaaaatgttggcggtagcggtgacgatggctggcgccggcgatggttaaagctagcgccggcggtggcgtgggcggtagcggagaacatgaaccttaaaatggccgctctaggtcaaataaatttggaacaaaaacgtgtcgcgctagattacgatgggaatcgaggacgccttccgatgcaactatgcaccgagctgcgcagcgccacgtttcagcggcattcatttactaaattatacaagggagccatgatatacaagggagccatgatggaaagacataatttcctttcaacaatgactactaacaacactattgaggaggggagtgaacaaaaagaaacgatatctgtaacttttattgataaggatggtgaggaaaaccatatcaaagtccctgttggaatgtctatgttagaagcagctcatgaaaatgacattgaactagaaggagcatgcgagggctcacttgcgtgttcaacttgccatgttatagtcatggacgtagaacattacaataaattggaagatccaactgatgaggaaaatgacatgttagatctagcttttgggcttagtgaaacatcacgtctgggttgccaagttattgcaaaacccgaacttgatggaattcggttagccattcctgctgctactcggaacttcgctgttgatggttttgtgccgaagccacattaataaatgacttgggttcaatgcaaagagggcagctgtctcagttttgtagcctcacttatttagataaattaccatttattgatcacaggcattataaattagtgttttctgtgtttgacatttgtctaccacagtctgattttaatttcaagatattttcaacataaaaccaaagtaaaattaactgggagatattaatataaattgccattcatttgtagttactaacagtttagttgcttgcaattgtaaaga

SEQ ID NO: 4630 - DNA, 1007 bp, Phaseolus coccineus
gctgtctcttcactcccctgcatctcttcacttcccttcacttccgctgcatctcttcacttccatgcggcggcagtggcgttcgttcgcggcggcgatggaaaatgttggcggtagcggtgacgatggctggcgccggcgatggttaaagctagcgccggcggtggcgtgggcggtagcggagaacatgaaccttaaaatggccgctctaggtcaaataaatttggaacaaaaacgtgtcgcgctagattacgatgggaatcgaggacgccttccgatgcaactatgcaccgagctgcgcagcgccacgtttcagcggcattcatttactaaattatacaagggagccatgatatacaagggagccatgatggaaagacataatttcctttcaacaatgactactaacaacactattgaggaggggagtgaacaaaaagaaacgatatctgtaacttttattgataaggatggtgaggaaaaccatatcaaagtccctgttggaatgtctatgttagaagcagctcatgaaaatgacattgaactagaaggagcatgcgagggctcacttgcgtgttcaacttgccatgttatagtcatggacgtagaacattacaataaattggaagatccaactgatgaggaaaatgacatgttagatctagcttttgggcttagtgaaacatcacgtctgggttgccaagttattgcaaaacccgaacttgatggaattcggttagccattcctgctgctactcggaacttcgctgttgatggttttgtgccgaagccacattaataaatgacttgggttcaatgcaaagagggcagctgtctcagttttgtagcctcacttatttagataaattaccatttattgatcacaggcattataaattagtattttctgtgtttgacatttgtctaccacagtctgattttaatttcaagatattttcaacataaaaccaaagtaaaattaactgggagatattaatataaattgc

SEQ ID NO: 4631 - DNA, 1391 bp, Ricinus communis
aaagaaaccctacttctattttcatctaaacctcacagcctccaccctctcaagcctctttgcaatcaccaaaacttgctgccgtcgccgatctgtcatcgccgccgcccttgctgccgtcgccgatctgtcatcgccgccgcccttgctgcagtcatcgtcgccgtcgccgtcgcccttgctgtagtcgtctccgccctcggagcagtcggcttctccttcgccgttcatcaggtatatactggagtgctgcagcattttatggtttacaaaatctactggctgagaaacggggggtgttcatgatgttttcaatattgcaggttcgggtagtatgcgggtattcctattaggatttgggacttgttcgggtaacaagaagaacttcttaatcggatttcggacgggttcatttatttgttatttaaacggattcgggttcagatatcattaagtgagcggggagctattgaggtcagataattatgttagtttcttctagactttcaagaattggatctgggattgttaagcaactttcaagaggtatatgtacatccttgagtagaacagaatttgtacgaacaccttatagtcaatattggcgacctcaaggtgaattacatccagagactaagggattccgaggtaccttatctcccaggtatcatctgttttctacgacagcttctggtaatgatattgcggacggagatgaacagaagcacaaaatatctgttacattcgttgataaagatggagaggaaaagcacatcaaagttcctcttggaatgtctatgttagaagccgctcatgaaaatgacatagaacttgaaggagcatgcgaagggtcacttgcgtgctcaacgtgtcatgtgattgtcatggatatggaacactacaacaaattagaagatccaacagacgaggaaaatgacatgttggatttggcctttgggctcactgaaacttctcgtctgggttgccaggtgattgcaaagcctgaattggatggaatacgcttagctattccggctgccacacgaaactttgctgttgacgggtatgttccgaaaccacactagacatggcgcgaccctggtaaaatgtacgctgagtgtaaaggatgcaggcatgccaattttgtagctaccatattgtattcaaccaatacacattttcgatcctaatgttattgttttcgctattgattattacgcacatatttcagttaataattttttttatggtaccaattttataaccacatcatggtgaggggaaaatgggtttgacaccagcaaaatgtcaaaagggaatttcttatttattacactactgatgatctgaataattctacatttctatcataagctctttaccttgggcga

SEQ ID NO: 4632 - DNA, 1405 bp, Ricinus communis
cacagtacaaagaaaccctacttctattttcatctaaacctcacagcctccaccctctcaagcctctttgcaatcaccaaaacttgctgccgtcgccgatctgtcatcgccgccgcccttgctgccgtcgccgatctgtcatcgccgccgcccttgctgcagtcatcgtcgccgtcgccgtcgcccttgctgtagtcgtctccgccctcggagcagtcggcttctccttcgccgttcatcaggtatatactggagtgctgcagcattttatggtttacaaaatctactggctgagaaacggggggtgttcatgatgttttcaatattgcaggttcgggtagtatgcgggtattcctattaggatttgggacttgttcgggtaacaagaagaacttcttaatcggatttcggacgggttcatttatttgttatttaaacggattcgggttcagatatcattaagtgagcggggagctattgaggtcagataattatgttagtttcttctagactttcaagaattggatctgggattgttaagcaactttcaagaggtatatgtacatccttgagtagaacagaatttgtacgaacaccttatagtcaatattggcgacctcaaggtgaattacatccagagactaagggattccgaggtaccttatctcccaggtatcatctgttttctacgacagcttctggtaatgatattgcggacggagatgaacagaagcacaaaatatctgttacattcgttgataaagatggagaggaaaagcacatcaaagttcctcttggaatgtctatgttagaagccgctcatgaaaatgacatagaacttgaaggagcatgcgaagggtcacttgcgtgctcaacgtgtcatgtgattgtcatggatatggaacactacaacaaattagaagatccaacagacgaggaaaatgacatgttggatttggcctttgggctcactgaaacttctcgtctgggttgccaggtgattgcaaagcctgaattggatggaatacgcttagctattccggctgccacacgaaactttgctgttgacgggtatgttccgaaaccacactagacatggcgcgaccctggtaaaatgtacgctgagtgtaaaggatgcaggcatgccaattttgtagctaccatattgtattcaaccaatacacattttcgatcctaatgttattgttttcgctattgattattacgcacatatttcagttaataattttttttatggtaccaattttataaccacatcatggtgaggggaaaatgggtttgacaccagcaaaatgtcaaaagggaatttcttatttattacactactgatgatctgaataattctacatttctatcataagctctttaccttgggcgaacaagt

SEQ ID NO: 4633 - DNA, 1391 bp, Arachis hypogaea
ggggagttattactattatcttaccgcctcaaggatcaacttcaacctaagaaacttcttgagtttgaggcatcttccgacttcgataataatctcgtcttcttctctcttatttcttcgctttttgcggccgctgcattcttcttcccccctaggtggcggcgagggttttgtaatcccctcatcaactcctatgctaagttcaagacttccaagacttggaccatggatcgccaagcgcctcttcacaaggaattatgcatccatttatagaggaagatacaatcaaagcaccagaaaccgtttcctgcaacctccggcagtacagtttcaacaactttctcttaataagttatacaatggagctatgattggaaaacataatttcctatcaacaactagcaatgaagggaatgaacaaaaggaaacgatatctgtgacgtttgttgataaggatggggaggaacaacatattcgagtccctgttggaatgtccatgctagaagctgcacatgaaaacgacattgaactagaaggggcatgcgagggctcacttgcatgttcaacttgccatgttatagtcatggatgtagaatattacaacaaattggaagatccaactgatgaggaaaatgatatgttggacctagcttttggcctttccgaaacttcacgtttgggttgccaagtgattgcaaagcctgaactcgacgggattcgattagctattccagctgccacgcggaactttgcagtcgatggttatgtgccgaagccacactaatgaatacaatttataagtttgagtgcaaaagaatggcaactgataaggtttaggatttggaggtttaggttttgtagcttaatgattggttctagataaatgagcatttacatcttaggcattattttggtgctgagttttgtggataacaagctactcagtatgcgagaaccagaaatttgtcactgttgggaattttcagcgtcccaagtatagttgcatgccaataaattaatcagagatctgctacacgtccaagcaatattgccattcaagttcaactaagtagacctaataccaacaaaaccattcattaaaaagagtgtgattacacgcacatatatcatttttaatctagtcatttacgttcatggggtgttgtcgtcatctttttcttcgtgttcttcattttcctcttcctcctcctttttctcttttttctgcgtattttttcctcattgtcattctttattgttgctgttattgctattactatagtagaaggtaaggagaaagagttttgaattgagtagaatgagtttaaatatagcttaattcattcagaaatgaactgaaattacataatgattacgacaaaattaactac

SEQ ID NO: 4634 - DNA, 425 bp, Tripterygium wilfordii
aatgctgactctgcagataaaggagaacagcaagagatatctgtgacatttgtcgacaaggatggagaggaaaaacacattaaggtcccagttggaatgtctatgttagaagctgcacatcaaaatgatatagaacttgaaggagcatgtgaaggctcacttgcctgttcaacatgccatgtaattgttatggacatggagtactacaataaattagaagaaccaactgatgaggagaacgatatgttggatcttgcttttgggcttacagaaacatctcgtctgggttgccaagtgattgcaaaacctgaacttgatggggttcgcttggccattcccgccgccactcgaaattttgctgttgatgggtacgttccaaaaccacactagacatggtacaaagttgggaagtgtttgctgagtgt

SEQ ID NO: 4635 - DNA, 1107 bp, Citrullus lanatus
attcaacagagagttaagcttttgaatcagcttgccgattttaatttgaaatccaacttattttggacgcaaattgtgatttttaccttgcgggtgccctgaagcgcacctccaaagggaggccttctccaaaaaccacatctttcaatcgattgaaaaccgtcggcagactctgtttcagcttccagctgataatttgcaggtacccaacaaaacccaagtttcttttttctgccattcgcatttcgcaggaattattatgtcgctttttaaactttcaagaaatggagttcggatgataaaagagctcttcatagggcagtctttactggtgactaaagcaagctacattcagggtccttttttcaaatacttgcacactttgccacaggcaccagttcaggtgcttcaaggtttcaaatggcaggaacagcgactgtattctacctcaggtcctcagaatggctctaatgaagataatgagccaaaagaaacgatatctgtcacatttgtccttaaggatggagaagagcaacaaattagagttcccattggaatgtccatgctagaagctgctcatctaaatgatatagaacttgaaggagcttgcgaaggttcattagcctgttcaacttgtcatgttattgtgatggatatggactactacaataaactagaagagccagttgatgaggagaatgacatgttggatctggcgttcgggctaacagaaacgtctcgtttgggatgtcaagttattgcaaaacctgaacttgatggaattcgtttagccattcctgcagctaccagaaattttgctgttgatggctttactccaaagccacactaagcatttttccacaatgaggggaggatcaatcaaggtttaatccactagttttgcctcatgagtcaatttatctctgctttcatggttcaaagtatgctagaaactgttttaagaattggttaaaacttatcttcttctattcttttgaaaatgtagctgatatgtcatgatcaaattccataaaagaaagaaatatttaaaatttttaactaagctctgattactggtcaataatttatataaaattttgggcgatc

SEQ ID NO: 4636 - DNA, 552 bp, Tripterygium wilfordii
atatctgtgacatttgtcgacaaggatggagaggaaaaccacattaaagtcccagtcggaatgtctatgttagaagctgcacatgaaaatgatatagagcttgaaggagcatgtgaagcgtcacttgcctgttcaacatgtcatgtaatcgttatggacatggactactacaataaattagaagacccaactgatgaggagaatgacatgttggatcttgcttttgggcttacagaaacatctcgtctgggttgccaagtgattgcaaaacctgaacttgatggggttcgcttggccattccttccgctactcgaaattttgctgttgatgggtatgttccaaaaccacattagacatgatataaatttgggaagtgtttgctgagtgtgagaatgagatcatcccagttttgttgctcttgtattcattgcctttatgagcttcttttccaacataattaatgcctcttttgacgtcggcaatacctaaagcgtttttatttccttaggataatattcatgttacaattattttattgaatgcttgatgac

SEQ ID NO: 4637 - DNA, 959 bp, Cannabis sativa
aaaaaaaatttacatttaattttttaaaaggcaatatttttgttagtggggctatagcccccacatcaatcttaatgggtccgtcgtaatatacatcaattcaataaggtgcataaatattcttggtgaaacacattattgtctgattgagatttgcagttttcttagtttttttccccattctctatgtcttctcaggatttctgtgacatttgtggataaagatggagaggaaaagcatataaaggttccaattggaatgtctatgttagaagctgctcatcaaaatgacattgaacttgaaggagcttgtgaaggctcacttgcatgttcaacttgtcatgtgatagtgatggatatggagtactataataaattagaggagccaacagatgaggagaatgacatgttggatttggcttttgcactcacagaaacgtctcgtctcggttgccaagtaattgcaaaacccgaactagatggagttcgtttagctattcccgccgctactcgcaactttgctgttgatgggtatgtcccaaaaccacactagacgtgataaagcaatacataagagagtgttcaaagttttataaatgcagtcatcccatttttgtagctcctgtattttaatgattcaataatattatgcctctgtgggcaactttttgttttttctttttattcccctttatttggggttccaaattcttttgttgctttaaattatactgttgagtataccatgtagaaatatagtttaatagttctcatgactattaagggattttcccgaccatttatggtttacacaataagaaactttatttctttccacctcacaattcccaaaaaaaaaagggcatgatttagtttcgatgtattgcgttacagaccaattccaacttattaaggcctccttatgtgttaaaacatatgaaaggtagggtatgccttaa

SEQ ID NO: 4638 - DNA, 888 bp, Humulus lupulus
ttcctgctaactcagccattgaagcacttacaagaataaaggtcgaatagtgactcgtgaggttcaacgattatgttcattcccaaatttttaagagttggaatttggacggttaaagagctatcaagaggaaaatctagtaccgtaattagagctagatatacacagagcccttttagccagtacttgcaaacactgtcagaaaataaggtgtccaagggagcaatctttcagaaacttcgtcatttttcttcagctacagataacgatccttcacaggaagggagtgggcaggaagaaaagatttctgtgacatttgtggataaagatggagaggaaaagcatattaaggttccgattggaatgtctatgttagaagctgctcatcaaaatgacattgaacttgaaggagcttgtgaaggctcacttgcctgttcaacgtgtcatgtgatagtgatggatatggagtactataataaattagaagagccaacggatgaggagaatgacatgttggatttggcttttgcactcacagaaacgtctcgtctgggttgtcaagtaattgcaaaacccgaactagatggagttcgtttagctattcccgctgctactcgcaactttgctgtcgacgggtatgtcccaaaaccacactagacttgataaagcaatacataagagagaggggtcaaaattttatgaatgtagtcatcccatttttgtagctcttgtaatctaatggatcaataatactatgcctttgtgggcaactttttcctctttttattcccctcttatttggagcttcaaatttttgttgttcctttaaagtatattgttgagtttaccatgtaagaaactagtaataattctcatgagtattaaggg

SEQ ID NO: 4639 - DNA, 922 bp, Brassica napus
ggggggaaactgagtttgtccttgtccacgcacgaaccctaagtcctctcatatcctccatcaatcttcaatcactgaaaaggaaaaggctctttctttcgtcgaatcatctataaaactgagattttgtcacggaaggaatcatgctcttccataggctatcaagattaggttctcgcattgttaaagagcttcctagagagaggcatttctcagtatctgggatgcgggttttacaagggtcttatagccaatatctgcaatcttcggctgtaactcagaggcagtctaggacgtttcagcaagcctttttctcaagtaactataatctttgtacgttgttcagcactatctctgaaacggaaaagataaacgttatctttgttgataaagatggagaggagattcatataaaggtcccagttggaatgaacatccttgaagctgctcacgaaaatgatatagaacttgaaggggcttgtgaatgttctctagcctgttccacgtgccatgtgattgttatggacacggaatactacaacaaactcgaagaaccaacagatgaagagaatgatatgctggatcttgcttttgggttaacagaaacgtcaagattgggatgtcaagtcatagcaaaaccagagctagatggaatacgcttagccattccttcagccactagaaatttcgcagttgatggtttcgttccaaaacctcactaagccacttcaaagtgttctcacagaggatgagtattctattagttgagtaacttgagttgtaagagttttctgagcttacacacttgtttagaatcagaaacagcatattacaataaagcctttgggagttgtaactcagaagctgagagatttcacaattttatctcatctctttttggcaacattcttgttgtatgttt

SEQ ID NO: 4640 - DNA, 931 bp, Brassica napus
ggggggaaactgagtttgtccttgtccacgcacgaaccctaagtcctctcatatcctccatcaatcttcaatcactgaaaaggaaaaggctctttctttcgtcgaatcatctataaaactgagattttgtcacggaaggaatcatgctcttccataggctatcaagattaggttctcgcattgttaaagagcttcctagagagaggcatttctcagtatctgggatgcgggttttacaaaggtcttatagccaatatctgcaatcttcggctgtaactcagaggcagtctaggacgtttcagcaagcctttttctcaagtaactataatctttgtacgtcgttcagcactatctctgaaacggaaaagataaacgttatctttgttgataaagatggagaggagattcatataaaggtcccagttggaatgaacatccttgaagctgctcacgaaaatgatatagaacttgaaggggcttgtgaatgttctctagcctgttccacgtgccatgtgattgttatggacacggaatactacaacaaactcgaagaaccaacagatgaagagaatgatatgctggatcttgcttttgggttaacagaaacgtcaagattgggatgtcaagtcatagcaaaaccagagctagatggaatacgcttagccattccttcagccactagaaatttcgcagttgatggtttcgttccaaaacctcactaagccacttcaaagtgttctcacagaggatgagtattctattagttgagtaacttgagttgtaagagttttctgagcttacacacttgtttagaatcagaaacagcatattacaataaagcctttgggagttgtaactcagaagctgagagatttcacaattttatctcatctctttttggcaacattcttgttgtatgttttgattttgt

SEQ ID NO: 4641 - DNA, 891 bp, Cichorium intybus
agtcggtttgggccgtcgtggtttcatcaagagccacgaaaaattaaacaaaccaactctctgaagccttcgcatctttgtcaagatctccgggacgacacaaagatcgtgtgcttcttcagtattatgttcatttctaaattttcgagacttggagctcaggcattcaagggtttatcaaaagccccgttaacaattccatcaagaaagtctttcttccctatagttcagaatgactatttagatgcctcgagtcgtaaattattctccactaccaattcacaagaagaaaatgaagacaaaaaaaaaatctctgtgaccttctttgacaaagatggagaacaagaaatcaaagtccccattggaatgtcaatgttagaagctgcccatgagaatgacatagaacttgaaggagcatgcgaaggttcactcgcttgttctacatgtcatgtcattgtaatggatgtggagcagtataataagctagaagatcctacagatgaagagaatgacatgttagaccttgcttttggactgacagaaacgtctcggcttggatgtcaagtaattgcaaaacctgaacttgatgggcttcgacttgcacttcctgcagctactagaaattttgctgttgatggatacaaaccaaaaccacactaatgatattatttatttgggattaatgccaattttgtagcatttgtatttgagtggattataagggtgtttgactgatgtagaagataattgcacaacatgtgacattggcatattttatagacttgatgattaattggtgtgtgaccttgtgggttcgtaatttatgagggcgaattcgatgattatattcaattaattggcttggttgatttgggatgtttattaaaaaaa

SEQ ID NO: 4642 - DNA, 1167 bp, Pinus taeda
atatctagatcctccattatttatcggaactaagaacccatagttcaaacctcagtttgatgagaaatccatgggacttctgtgtcgcctgacaactctattctaccgggagcttcacggattagggctttccgaagcttgtcattcgaatggaaagtttaatccggccaattattcatttgatcagtttagggtttggagaatggggacttccaaagcatttcaaatgcagccatttgcacccgaaagacgttcttacgaggaaacgatgaaagaacgcttgccgcagccactgtccttcgatttatacaggtcaagatgctcgtcggatcaccggggcagggcggttgcgtcgtcggagaggtgctggttaaacgaaggccggaaggcctcaaaatgggagccaaaccgtattattagtgaccagatgaagtataagagaaacatccattctctccagaggaggaatttcgcatcagagtcggataaagccaatgaaaaccagcaagaagctaacaccgaaacaatcttggtaacatttgttgacaaggatggtgaagaaaagactgtcaaagtgccagttggaatgtcgatgcttgaagctgctcacgagaatgacatagaccttgaaggggcatgcgaaggatcacttgcctgttctacttgtcatattattgtcatggatgaggattactataacaagctaccggagccaacagatgaagagaatgacatgttagatcttgcttttggccttacagagacgtctcggttgggttgtcaagtcattgctaagccggagcttgatgggatgaaagttgctttgccagctgccacaaggaattttgctgtagatggatatgttcccaagccccattaggatgcagttttgaagatgatattatcttgatcatcgttcttattcttgtaacaacaatccacattacttttatatggagacattgcaacttttgtaatgagagcaataatgatttttgcttcgttctgcccaagcatttttgtggattgtttaataagtctgaaaattattggttctagcaaaagttgatattgcccgctgctagaccctttcctctcaactaaggtcatatatatataatgccagctgttttccttcggatcaaattacattgacggtcatatata

SEQ ID NO: 4643 - DNA, 1164 bp, Pseudotsuga menziesii
cttctgtgtcgcctgaaaactctagtctaccgggaacttcaaggactagggctccgtgaaacttgtttattcaaatgggaagtttaatagggccaatcattcatctgatcagtttagtagggtttgcagaacggggttttccagaggagttcgattgcagccatttgcggctgaaaaaccctctcacaaggaaacgacgaaagaacccttaccagagccacgggcatttgatttgtacaggtcaatatactgctcgtcggatcgtcagggcagtgcagttgcagcgttggtggggtgtttaaataaaggccggaaggccgtgaaatgggagccaaaccgtattattagctacccgatgaattatatgagagacatccatgttctccagaagaggaattttgcatcagagtcggataaagtcaatgaaaaccaggaagaagctaacacggaaacaatctcagtgacatttgttgacaagtatggtgaggaaaagattatcaaagtgccagttggaatgtcgatgcttgaagctgctcatgagaatgacatagaccttgaaggggcgtgtgaaggatcacttgcctgttctacatgtcatgttattgtcatggatgtgggttactataacaagctaccggagccaacagatgaagagaatgacatgttagatcttgcttttggccttacagaaatgtctcgattgggttgtcaagttattgctgagccggagcttgatgggatgagagttgctttgcctgctgccacaaggaattttgctgtagatggatatgttcccaagcctcattaagatgcagatttgaagatgatattatcttgatcttcgttcttattcttgtaacaaccatccacagtgcttttatatggagtcatggcaatttttggtagtctttattttggagtcagtgagcaataatgatttttggtaggatttattttggagtcagtgagcaataatgatttttggtaggcttttatcatacctgcctggttcgttctgcccaggctattttttatttgttaaaagtccgaaaaatatttgttctaacaaagttgatctagcctattacgagaactctttttctctactgaggtcatatatatattcaaatcttattcttccgaggttcaaaatacattgacaat

SEQ ID NO: 4644 - DNA, 1487 bp, Eucalyptus grandis
atggaccactgccagcaagtcggggatgtagctcacatggtagagcgctcgctttgcatgcgagaggaagaagcagcagcatcgggaacgattcccttcttctctctcgccgccgtcgacgtctgctttcatctccttctcaaactctctctctctctctcagcaaggtcggtccgtcctcttcctcttcctttccgtcccctccgaccgttcgtcgccggcttcgccgagcctttcgtcttctggaggcctgactctctctctctctcattttggtcgcaggtaggactcgttgaggcggcgccgagtatggtgatctccagggcatccagaatcggagctcgcgtcgtcagggagctcctctcgcgacgaggtccgtccgcgcctctctctctcggcgcgagtacgtccctcgcaagaagacatctaggggcgcgaagacaatctagtcctgcaatgcagccttcggataagctgttccagggtgccctacttcagaagcatttcttttgttctacaaccactgctgatggtgctcatgggggatgcgatgaagagaaagacaagatatctgtgacgtttattgataaggatggtgaagaaaagcaaattaaggttcccattggaatgtcaatgttggaagcagctcatgaaaatgatatagaacttgaaggagcatgtgaaggttcacttgcatgttcaacatgtcatgtcgttgtgatggacgtggagtactataataaactggacgatccaactgacgaggaaaatgacatgttggatttagctttcgggcttacagaaacgtctcgtcttggttgtcaggtgattgctagacctgaattagatggagtgcgcttggcgattccagcagccactcgaaactttgctgttgatggatacgttccaaagcctcattaacatgatataactttggaaagttttttctgtgtaaaggatgcagtcatcccgattttgtagcagaggacgtgcaatttgctccgagcctaacttgttactcatgataaatcaacaaggtaagagatccttcattcttgtgactgagagagcggaaatcccaagtagttttagtttgttgagtggaatttataggtgaaatgataatttatctagacatgcatggagcatctattgaccaaggcttgggtgttccaatgctctgataactatccattggaacttttatccagtgtatgcattgctagaacttgttacaagtgcataacgtgatgctactctgtgtcaaactgcatttggtcacattattggggagcgaaagttcgaataaacttgtaaatcttgactaatctctactttttaatcattttcatcattttcgttcttcatgtaagttatttatgggtggcttcaatgaagttgatgacagtctaccaatgctaatgctttgaatatgtgacaacttgtatttctcctttgcccattataaaagatatggtcttctaact

SEQ ID NO: 4645 - DNA, 1047 bp, Brachypodium distachyon
cggtgctggttccagactctgccacggctcagccttccccaccccactcgtcgtctctccccttccttcccgccgtcgtcgaaagagaccggcggctggctcgggcggcgcttacggaagggttaggaggtactaggctcggctgctgccatgttctcaaggatctttcagctcggaacgcggcttctgcgcgagactagagctgggggcaacttgacaagcaatagcattaacagcagttactaccaaggtcaactcagtaggcattcagctccagcgaagagcatcctcttctctactgcgacaagtagtcatgaaggaagcgaggacaaggagaaaatctctgtaacatttgtcaacaaggatggcagcgagcagacgatcagtgttcctgttggaatgtccatgttagaagctgctcatgaaaatgacatagaacttgaaggggcatgtgaaggatcgctagcctgttctacttgtcatgtcattgtaatggatgtaaaacactataacaagctagaagatccaacagatgaggaaaatgatatgcttgaccttgcttttgggctcacagaaacgtctcgtcttggctgtcaagtaatagcaaagcctgaactcgacggtgtccgactcgcattacctgcagctacacgaaactttgcagtagatggctttgtaccaaaaccacactgaagaaggcatacgaattcttagagcaccaacaattttgtaccttaacatgtaacttcactgcagaatggtctccaaaaactcatgatgtttccggacattttgttacttacaagatcattgtttgtctttgcaacgggctcaggtgaataaacaatgcttaggcatgtgtacaccagactgctagtgtcgtctgttctcccccattctcggtatacatgtatgcctgctgccacgcctgaaaatgccgggttcattgctaagagtttgtggtcatattcgtgattgacgcaatttacagtttgcatgcactttcatgagaaattgagaatgacgtggaagaaagccgtttgttgt

SEQ ID NO: 4646 - DNA, 1090 bp, Brachypodium distachyon
accaataggcggtgctggttccagactctgccacggctcagccttccccaccccactcgtcgtctctccccttccttcccgccgtcgtcgaaagagaccggcggctggctcgggcggcgcttacggaagggttaggaggtactaggctcggctgctgccatgttctcaaggatctttcagctcggaacgcggcttctgcgcgagactagagctgggggcaacttgacaagcaatagcattaacagcagttactaccaaggtcaactcagtaggcattcagctccagcgaagagcatcctcttctctactgcgacaagtagtcatgaaggaagcgaggacaaggagaaaatctctgtaacatttgtcaacaaggatggcagcgagcagacgatcagtgttcctgttggaatgtccatgttagaagctgctcatgaaaatgacatagaacttgaaggggcatgtgaaggatcgctagcctgttctacttgtcatgtcattgtaatggatgtaaaacactataacaagctagaagatccaacagatgaggaaaatgatatgcttgaccttgcttttgggctcacagaaacgtctcgtcttggctgtcaagtaatagcaaagcctgaactcgacggtgtccgactcgcattacctgcagctacacgaaactttgcagtagatggctttgtaccaaaaccacactgaagaaggcatacgaattcttagagcaccaacaattttgtaccttaacatgtaacttcactgcagaatggtctccaaaaactcatgatgtttccggacattttgttacttacaagatcattgtttgtctttgcaacgggctcaggtgaataaacaatgcttaggcatgtgtacaccagactgctagtgtcgtctgttctcccccattctcggtatacatgtatgcctgctgccacgcctgaaaatgccgggttcattgctaagagtttgtggtcatattcgtgattgacgcaatttacagtttgcatgcactttcatgagaaattgagaatgacgtggaagaaagccgtttgttgtaaatcagtcactgaattgctgaaatgttgtttgg

SEQ ID NO: 4647 - DNA, 974 bp, Carica papaya
acgtctacttctctacggcaatagccatccattttatatattcttcgtctccatcaatcaccagtttcttctctgcttcgtttctcccgaccctactccttcccttaatcatttcctttcataaatatatatataaagaatccccaaatccatatcaaaaccctatactctgcaactcctcttcactgcgcattatcgcacagccgtcgccaaacagcctcggcggacgcagacatactctcccgacaagtgtcccagcgaacaacctgttcctgggtgtcatctgaaagcttgaagcttggggtttaattggttgcttcgattatgctaatctctaggctctcaaagattggttttaggatcgttaaagagctcccgagagtaggaacatgtacatcccttaatagaggagcattaatccagaggaaatgtggtcaatacttgcaacctcagaatggattatggggagcagaaaaggtattccagattgctgcatgtcagaggcatcggtatttttcgaccacacctagtaataatggtttgactcaggaagggaatcaagagaaggaaatgatatctgtgacttttgttgacaaggaaggagaggaaaagaatatcaaggttccagttggaacgtctatgttagaagctgctcatgaaaatgatatagaacttgaaggagcatgtgaaggctcacttgcctgttcaacatgtcatgtgattgttatggatgtagaatactacaataagttagatgacccaactgatgaggagaatgacatgttggatcttgctttcggccttacagaaacgtctcggcttggatgccaaattgttgcacggcctgagcttgatggcattcgcttagcaatccctgccgccacccggaactttgcagttgatggatatgttccgaaaccacactagacaacaaaatttttttatttgagtaaaagaacacacggccatcccca

SEQ ID NO: 4648 - DNA, 1039 bp, Phaseolus coccineus
gagttgtgtctttttttgttctggagtgaacatttttttatatcaatttttttcctctgcaatttcttattaaaccctaaaaccactatgctaaattccaaactagctagagtcggagcttcgatcgctaaacacctctttacaaggaactgcacatccttgtgtggagtaagatatgttcgaacgggaagatgtcatcccctgcaatctcagcggcattcatttactaagttatacaagggagccatgatggaaagacataaattcctttcaacaatgactactaacaacactattgaggaggggagtgaacaaaaagaaacgatatctgtaacttttattgataaggatggtgaggaaaaccatatcaaagtccctgttggaatgtcaatgttagaagctgctcatgaaaatgacattgaactagaaggagcatgcgaggcctcacttgcgtgttcaacttgccatgttatagtcatggacgtagaacattacaataaattggaagatccaaccgatgaggaaaatgacatgttagatctagcttttgggcttagtgaaacatcgcgtctgggttgccaagttattgcaaaacccgaacttgatggaattcggttagccattcctgctgctactcggaacttcgctgttgatggttttgtgccgaagccacattagtaaatgacttgggttcaatgcaaagagggcagctgtctcagttttgtagcctcactgatttagataaattaccatttattgatcacaggcattataaattagtattttccgtgatcacagagtacctctatttatcaattacagagagaacatggtgtaattttcgacgggctacattttggatgtcaataaattctttgtacatttttttacctataacaagtgactgtgcgagcacctccaaaatatatgaatttataatagatatggaggaaaacaaggatatggagtcttcactgacgagtgttgattcaaaccaaaccgattgtagttttcttgttttggttaagttgcaacctga

SEQ ID NO: 4649 - DNA, 1161 bp, Fagus grandifolia
tcctcctattcttctttgtccatactatggttggcgtcaatatgtcacgagcagcaagaggttatcataatatatttgaaacaacttttagacataaatcagtattataaaaattcacttaaaacattaatttaagataatacgacactattaaaaactcatgtaaaaagcaactggtacatgcttcaccttatgttcagtaaagaccactatataatggattaaaaccaaaatatcttcaagttatcaccttatgtgtaagcttgagtgtttgactcctcttccaaattcaagcccaaacccatcagtttttaaagtaatccacccaaatctgatctaaaatcccaaattctcaaactcaaactcaccgtgcgtgaccgacgacaagggctcatgacccagccgcggcctgcttgaatcgccgtcgccgccacctcaccgctcggtcgcacctccttcgcgcctgttatctatttaatttttcagagttgggacagtgtttattgtgtcgcaacaaatgattatgttggtatctaaagtttcaagagctggactttggatgctcagacaactctcaagagggaaatcgacaccaataactagggcaggatatatacaaaggccatacggcttatatttgcagccgctgtttgatcaacagacaaaaactaaggtgttcgggggtgccatacaacatcatttttctaccactactactgacaatgcatctgaggaagggagtgaaaccaaagaagcgatatccgtcacatttgttgacaaggatggagaggaacagcacattaaggtccccatcggaatgtctatgttggaagttgctcatgaaaatgatatagagcttgaaggagcatgtgaaggctcacttgcctgttccacgtgtcatgtaattgtgatggacatggagtattacaataagttagaagaccctgctgatgaggaaaatgatatgttggatctggcctttgggcttacagaaacatctcgtttgggttgtcaagtgattgcaagtcctgaacttgatggaattcgattagctattccggctgccacccgaaactttgcagttgatgggtatgtaccaaaaccgcactagagtacaagggttctggagactttttgccgatagtaaaggatgcaattatc

SEQ ID NO: 4650 - DNA, 761 bp, Lactuca sativa
cacatctttgttagcatctccttacaatcacaaagatcgtgtggctcttctagtattatgttcatttctaaattctccagacttggagctcaggcgttcaagggattatctaaagccccactaagaattccatcacctaggtcattcttccctaattttcagaatgactattcgagtcataaactattctccacaacaaccactagcaattcacaaggagaaaacgaagacaacaaccaaaaaaatctctgtgacattctttgacaaagatggagaagaacaagaaatcaaagttccaataggaatgtcaatgttagaagctgctcacgagaatgacatagaacttgaaggagcatgtgaaggatctctcgcttgttccacctgtcatgtcattgtcatggatgtggaacagtacaataagctagaagatcctactgacgaggagaatgacatgctagaccttgcttttggactgacagaaacgtcgagacttgggtgtcaagtaattgcgaaacctgaacttgatgggcttcggcttgctcttcctgctgccactagaaattttgctgttgatggatataaaccaaaaccacattaattatatatttatttaatttcggatcatttttgtagcatttgtatgcgagtggagtggattatatcggtgtttgtttgactgattgatgtaggagatgattgcataaacatgtgatgtgacattggcaaatttatagacttgattaggcctggggtcaaaaatt

SEQ ID NO: 4651 - DNA, 1162 bp, Cucumis melo
gccgccacgccaacccccatcaaatgctttttcttctctttgttgcttcttttttgttttccccattcaaccgagggttaagttcttgattcggcttgcccactctaacttgaaacccgacttatattggacgcaaaatttgattcttaccttgcggaggccctgaagcgcacctccgtctctctcgaaagcgagaccttctttcaatcgattgaaagccatcgccagtctctgtttcagcttccagctgacgtttcggagatacccaacaaaaccctgtttcttttctctgccattcgtgattcgcaggaattattatgtcgctttttaaactttcaagaaatggtgttcggatgttaaaagagctcttcacagggaattcattactagtgactaaagcaagtcacgttcgaggcccttttttcaaatacttgcgtactctgccacagccacaagttcaggtgcttcaaggtttcaaatggcaggaacagcgactgtattctacctcaggtccccagaatggctgtaatgaagagaatgaaccaaaagaaacgatatctgtcacgtttgtccttaaggatggagaagagcaacaaattgaagttcctgttggaatgtccatgttagaagctgctcatcaaaacgatatagaacttgaaggagcatgcgaaggttcactagcttgttcaacttgtcatgttatagtgatggatatggactactacaataaaatagaagaaccagttgacgaggagaatgacatgttggatctggcattcgggcttacagaaacgtctcgtttgggatgtcaagttattgcaaagcctgaacttgatggaattcgtttagccattcctgcagctaccagaaattttgctgttgatggctttactccaaagccacactaagcattttgccataatcagaggaggatcaaacaaaaggtttaacccactagttttgcctcatgagtcaatttatctctgctttcatggttcaaaatatgttagaatctgttttaagaattgactacacttatcttctattcttttggaaatgtagctgatatgtcatgatcaaattccataaaagagagaaatatttaaaatttttgactaagctctggctacaggtcaataatttatttaaaagttcttggtga

SEQ ID NO: 4652 - DNA, 1118 bp, Cucurbita pepo
tcagctgcaacctcacgccgtcacgccaactaccgattgtttttttcttctctctttcttcgttgttcttcgattcaaccatggcttaatttgtggaatcagctcgatcttagtttcgatcctaccaaaatccgacgtattttgaacggaaaattctgaatctctacctcgcagagggaagcgcacctccgtctccttcccgaaactgaggtcttctccctaaagcactcctctcaatcgattgaaagccattatcagtctctgatagtttgcagacaccaaataaaacccaagtttgttttgtcggcttctcgtattctgtggtgttgtaatagcaggaattatcatgtcgctttttaaactttcaaggaatggagttcggatgatgaaagagctcttcgtagggcagtctttactggtggctaaagcaagttgcattcgggggccctttttcaaatactggcgacctctgccacaagcacaagttcaggtgcttcaaggtttgaaatggcaggggcagcgtctgtattcaacctcaggtcctcagaatagctgtattgaagagagtgagccagaaacgatatctgtcacatttgtccttaaagatggagaggaacagcaaattagtgttcccattggaatgactatgttagaagctgctcatttaaatgatatagaacttgaaggagcatgtgaaggttcattagcttgttcaacttgtcatcttattgtgatggatatgggctactacaataagctagaagaaccagtggatgaggagaatgacatgttggatctggcgttcgggcttacagaaacgtctcgtctgggatgtcaagtaattgcaaaacctgaacttgatggaattcgtttagccattccttcagctaccagaaactttgctgttgatggctatactccaaaaccacactaaacattttgccacgaggagaagaggatcaatcaaggttttaacccattagttttgcctcatgagataatttatctctgctttcatggttcaaagtatgttagaaactgttaagaaaattggctaatttatcttctattcttttgaaatgcatctgatatgtgataatcaaaaaagggacatttac

SEQ ID NO: 4653 - DNA, 1850 bp, Oryza sativa
agccgagcaaaagccgcacctcgtctcctccgcctcgcgacttcgcctcgccggcgccgcggcgattcccccacacggcaccaccaaatccgccgccgccgccgccgtcgccgtcgccgccgccgcttgcaccggttgctccgggcgggtgtcgggatgctggcgagggtctcccgcctggggctccatgccctgcgccgcgccactgcgccaggtcaaaattcactcgcttcaaggaggcacgaagcagaagctgttacctctcatgtgaaccatttggggaagactttcttctgttcgaacacaaatgctacatccagtgataggagcagcgagtcagaagctaagatatctgtgacttttgttgataaggatggcgaggaaaagcttgttaaagtacctataggaatgtcaatgctagaggcagcacatgagaatgacatagaacttgaaggggcatgtgagggctctcttgcatgttcgacatgccatgtgattgtaacggatgttgactactacaacaaattggaagatcctgtggatgaggagaacgatatgctggaccttgcatttgggcttacagagacatcccgtcttggttgccaagtgattgcaagccctgagcttgatggaatgcgattggcactgccatcagctacgagaaattttgcagttgatgggtatgttgcgaaatcacactgatttcaacaaaatcatgaaaggtggatgttggatgactccagttttgtagaatacgagatatagttattggcgtatcctcaatcttgaatttctattctacagaaaacaaacacttaatatctatgataattgataacttcccttctctcttttttcgatggcaaatatgccaaattgctttgtaaaacaacacaagtaaaatcaattagaaatatggattattcattgaaaccttttgtggtgaaaaatatggctacttattccattttttgttcttcatttatgcatggaaaaggctaaaatttaaccctgaactctgtcagctatacacttttcaaccctgagttttgaaaccttccaatctacaactttaaactgttgaatcttttcacttttgccctttgtctcaagttaggatggtgttcctattacatgtcatctgtgtggcactgtggcatatctaggttaatacttgaatatatagtggaatcagctgttatatgtacctattatgtataggttatttttttttgcggggatattatgtataggttgttggcagtaaatgatatttttatttcaataatttgagcctgacctgtcagaagtctatttttgtcgtcatgtttgtgttacgaaacatgattctgtttggaaacatcaccttttgctgaacatatgttgttgatgttatgagatgacgaaagccacaccacgaggcagttgagggtaagtgtgcatatagcaaaccattatccaaaagagtaggttgccatcttatccaggatcctagaaagaagatatggtttatttgttcttaaattaatttcctaacttttgtcattgaccatccaatttaaggtcccatttggaagaggacttccatatgaaaccgatcagttccagaaagaattggtaaaactccccaaaagaggctgaaaagataggtccaatggttattgaatagtgtggtgcaccatataaattaaagtccattaaattgtttgcatcaccattatttggtgacttttacaaatgcaacattctgacctggagatgagttgttttaataacttaactacgtgagggatccaaggaagtgaaaagagtaagtttataactgaaacagctatctagtacttccccag

SEQ ID NO: 4654 - DNA, 963 bp, Oryza sativa
gagcaaaacccgcacctcgtctcctccgcctcgcgacttcgcctcgccggcgccgcggcgattcccccacacggcaccaccaaatccgccgccgccgccgccgtcgccgtcgccgccgccgcttgcaccggttgctccgggcgggtgtcgggatgctggcgagggtctcccgcctggggctccatgccctgcgccgcgccactgcgccaggtcaaaattcactcgcttcaaggaggcacgaagcagaagctgttacctctcatgtgaaccatttggggaagactttcttctgttcgaacacaaatgctacatccagtgataggagcagcgagtcagaagctaagatatctgtgacttttgttgataaggatggcgaggaaaagcttgttaaagtacctataggaatgtcaatgctagaggcagcacatgagaatgacatagaacttgaaggggcatgtgagggctctcttgcatgttcgacatgccatgtgattgtaacggatgttgactactacaacaaattggaagatcctgtggatgaggagaacgatatgctggaccttgcatttgggcttacagagacatcccgtcttggttgccaagtgattgcaagccctgagcttgatggaatgcgattggcactgccatcagctacgagaaattttgcagttgatgggtatgttgcgaaatcacactgatttcaacaaaatcatgaaaggtggatgttggatgactccagttttgtagaatacgagatatagttattggcgtatcctcaatcttgaatttctattctacagaaaacaaacacttaatatctatgataattgataacttcccttctctcttttttcgatggcaaatatgccaaattgctttgtaaaacaacacaagtaaaatcaattagaaatatggattattcattgaaaccttttgtggtgaaaaatatggctacttattcca

SEQ ID NO: 4655 - DNA, 1014 bp, Euonymus alatus
gacagcccatacaaattttattttctccctttggctgataaaccctcctctgcttgcgcaacaaaaaccccgacctctccaatcttgcacggctcaatttctctccgttcttgcagttccagctcgcatttgttgctatagcaaggggttactttggtggcaaatgctaatttctagactttcgagagttggattcccaataatcagatctctttcaagagggctttctagacatgtatacagaacaggatataaccaaagctcctattgcggccgaagacattggtatgaattgcagccacaaacacggtggttccatggtgccatatttgagaggaatcgctgttgtttcactacagcagctgatgccaacgctgcagataaaggagaacaacaagaaatatctgtgacatttgtcgacaaggatggagaggaagaacacattaaggtcccagttggaatgtctatgttagaagctgcacatcaaaatgatatagagcttgaaggagcatgcgaagcctcacttgcctgttcaacatgccatgtgatcgttatggatatggaatactacaataaattagaagacccaactgatgaggaaaacgatatgttggatcttgcttttgggctcactgaaacatctcgtctgggttgccaagtgattgcaaaaccggaactggatggggttcgcttggcaattccttccgccactcgaaattttgctgttgatgggcatgttccaaaaccacactagagatggtacaaagttgggaagtgtttgctgagtgtaaaggtcctaaaggattatgagatcatcccagttttgtagctgttgtatttattggctttatgagcttctattccaacataattaatggctcctttgaagtcggtgatacctaaagcgtttttatttccttgggataatattcgcgctacaattattgaatggaattgaattgaatacttgatgacaaggggaataggtgattaaggctttgttgagccatgacc

SEQ ID NO: 4656 - DNA, 739 bp, Olea europaea
ccgttcgtaccgtaacgacgacggtcccttaacctaagttacggtaacctaaacgtaaccggtaaagggttaaggttttacgggttaacgaaacgacctacctactttcctttacctaacctaaggtaggggaacgggaactaacttacgttagttggtccgtcccgttaggttaggttatttaacgaacgaaacgtaagtttagtcgaccaaccgaaccgtcccgtaggaacgaaaacttaaaaattactttagttttcgacctaacctacgaaccgaaccaaaggtaaaggttcgtcaaggaagggaggcagtagaaagaagagaaaagtatcggtaacatttgtagacaaggatggagaagagatacacgtcaaggtcccttttggaatgtcgatgctggaagctgcgcatgaaaatgacgtagagctagaaggagcatgtgaagggtcacttgcttgttcaacttgtcatgttattgtgatggacgtggactattacaacaaactagaagatccagctgatgaagagaacgacatgttagatcttgcttttgggctgactgacacgtctcgtcttggttgtcaaataattgcaaaacctgaaattgatggaattcgtttagcgcttcctgttgccacacggaactttgccgttgatggatacaagccaaaacctcactaaaggaagatactgttcgagaatggatgatgcaattcagccacagttttgtaggata

SEQ ID NO: 4657 - DNA, 411 bp, Vinca minor
cggaaaagaaaacaaagacacccaaaaaatatctgtaacattcgtagataaggatggagaggagaatcaaataaaggttcctgtaggaatgtctatgttagaagctgcacatgaaaatgatattgatcttgaaggggcatgcgaaggatcccttgcctgttccacttgccatgtgatcgttatggatgtggaacagtataacaagcttgaagatccaactgatgaggagaatgacatgttagatcttgcgtttggcctgactgagacgtcacggctgggctgccaaataatcgcgagtcctgaaatgatggaattcgactagctttacctgctgccacacgaaattttgctgttgatggtttcaagccaaaaccacattagatagattttatcaggaagaaaaatctctgt

SEQ ID NO: 4658 - DNA, 1048 bp, Arabidopsis thaliana
gaagagagaaagtaatcagctgagactttgcgacggagtaggtttggtctttcttcgccacgtacgaaccctaaatcctcttttactcattttcctccatcttcgagctccccaaaaacctctgcttttgtcgaacctttcaaaaagtttaattttgaattgcttcgaggtttaaagcttatacctttggacggcgccaaaaacatggtcttccataggctatcaagattaggttctcgcattgttaaagagctcccaagagagagacatttgtcaatgtgtggaaagaggattcttcaaaggtcttatggccagtatcttcaatcttcgccaatgctgcaaaggcaaactaggagttttaaggaagcattattctcgaataatcataagttttgtacatctttcagcactacctctgagaaaggtggcgaaaaaacagaaaagataaacgttacctttgttgataaagatggagaggaaattcatatcaaggttccagtaggaatgaacatccttgaagctgctcatgaaaatgatatagaactcgaaggggcatgtgaaggttctctagcgtgttcaacctgccatgtgattgttatggacaccaaatactacaacaaactcgaagaaccaacagatgaagagaatgatatgctagatctcgctttcgggttaacagcaacgtcgcgattgggatgtcaagtcatcgcaaaaccagagctagatggagtacgcctagccattccttcagctactagaaattttgcggttgatgggtttgttccaaaacctcactagtcacttaatagtctcagagcaaatgatttttcgaaaaaaaacccattacataaaaattacccttacggagagtcatacaaatgtaattcagacggtgagatttcaactcagcttttttttgcagcattgttttattgtgtcttgagtttaatatatatttcatgaaaaagctataaaaccatgttgtattctagatagttaaaagatttgcctgacttggttctgatcagaaatttgaaatcgctttagt

SEQ ID NO: 4659 - DNA, 962 bp, Cucumis sativus
accttacgccgccacgctaacgcccatcaaatgctttttcttctctttgttgcttcttttttgtttctccattcaaccgagggttaagttcttgattcggcttggccattccaacttgaaacccgacttatattggacgcaaaatttgattcctaccttgcggaggccctgaaacgcacctccgtctctctcgaaagcgaggccttcttccaatcgattgaaagccatcgccagtctctgtttcagcttccagctgacatttcggaggtacccaacaaaacccagtttcttttctctgccattcgtgtttccaggaattattatgtcgctttttaaactttcaagaaatggtgttcggatgataaaaggtctcttcatagggaaatcattactagtgactaaagcaagtcaagttcgaggcccttttttcaaatacttacgaactctgccacaggcacaagttcaggtgcttcaaggtttcaaatggcaggaacaacgtctgtattctacctcaggtccccagaatggctctaatgaagagaatgaatcaaaagaaacaaactgtgatttgcaggatatctgtcacgtttgtccttaaggatggagaagagcaacaaattagagttcctgttggaatgtccatgttagaagctgctcatcaaaacgatatagaacttgaaggagcttgcgaaggttcactagcttgttcaacttgtcatgttatagtgatggatatggactactacaataaaatagaagaaccagttgatgaggagaatgacatgttggatctagcattcgggcttacagaaacgtctcgtttgggatgtcaagttattgcaaagcctgaacttgatggaattcgtttagccattcctgcagctaccagaaattttgctgttgatggctttactccaaagccacactaagcattttgccacaatcagaggaggagcaaacaa

SEQ ID NO: 4660 - DNA, 1008 bp, Pennisetum glaucum
caggaccacccatcatcgattcatcgtcttcgcagcgtccttcccaaaaccagcgcaaccacgcaccgccggcgccgctcgccgccttcactcccctccaccggcatcggggctcccgggcgaggcccgctactaccacagcgtccgcttcggttcgcctcggcggatccagatgctgtcgaggttctcccgcgccggcctccaggccctgaaccgggcgagaccaggtcaaaagtcagtcccttcatggaaccatgaagtagaggcaattagcacttatatgatccgtgcggggaggaatctcttctgttcttccacaaactctacaacaggtgacagtaacaacaaaccagaagctagaatatctgtgacttttgtcgataaggatggtgaggaaaagctggttaaagttcctattggaatgtcaatgctagaggctgcccatgagaatgatatagaacttgaaggagcatgtgagggctctcttgcatgttcgacatgccatgtgattgtaacggatgtaaactactacaacaaaatggaagatcctgtggatgaagaaaatgatatgctggaccttgcttttgggcttacagagacatctcggcttggttgccaaataatcgcaagccctgagcttgacggcatacgcttggcactgccaacagcaaccagaaattttgctgttgatgggtatgttgcgaaatcacattgactgacagagcatttagttcatgaatgtcccatgttggaatttcgatgccagctcagtttgacagaataagagaatgagatatagtgtttattacactcgtcttgttatatcttcaattttggatttcacattaaactggtttccttctctaattttggtgagatggaaaatccgtcagtttactatttcagtagcttcttgaggacacagaagtcatacattgatgatcaattgatcgtactgttgattatatagaattcaaatggttagaaaacatcattctttgttgaact

SEQ ID NO: 4661 - DNA, 1290 bp, Physcomitrella patens
aaatgcttgcaaaggcttcaggccatggtcttgccacaaccttcagcaaacttcatgacccaacgcccgatgacgctcctcctttgtgggttctggctctagggttcgctctctggttagcacgttgttctcgtttgaggtcttcatcagaccccaacgccctctgctgtgaacccgaacctatttgttggagcttgtacctcagcggtccatgagttgctctaattagggtttcaaaatgaggggattgagagtagcaacagggttggcagctcgattgctacagcatggaagagttgcggaattgaggacgggttcagtagggattttcaggtcacttgtctgcaacaatccgagcgcaacatatgacagctctttaaattctagggtttcggatacgtgcggcttttcttctagagtgtctattcagggcagctcttgtgctcctcggcacgaacccggtttcgtttcgaacgtctctttgggggcttcgggagaaatcgttgaacctaacaaatttatactttcatatctgggctcttctcagttgtttccaccgggaaggtcgaatgggttctcgacttcagcagctgcgacgccagaagcggacgcggagaagatttcagttacatttgtgaacaaagacggcgaggaaacagagatcaaggttccggtaggtatgtcgatgctggaagctgcacatgagaatgacattgaacttgaaggtgcttgtgagggatcgttggcatgttccacttgtcatgtgatcatcacagacgaggagctatacaacaaacttccagagcctacagacgaagagaatgatatgttggatcttgcgtttggcttgacggagacttcccgattaggatgccaagtgattgctaagcctgagctggatggtttgcggcttgctctccctgccgctacccgcaattttgcagttgatggtcatgttccgaagccacactaactggaacactgctgcaatgtcacagcaggatggatttctgctgtgcaaatcctccaaaggaagttgcaggcttatcttctaatctgcgtcttaggttcggatttactcctctgtgattatcgatagcctttctcgatgtttctccttggcgatgactccttcctttttcccgttcctttcttgcacctggagcaagttgcgttccttgcaggtccttgggcgcgacagagcatgcaattagaatcctcttaaaatatttgagattgattcagctggaagctgaagctgaatgtcataagatccattgttccactgaa

SEQ ID NO: 4662 - DNA, 502 bp, Rosa hybrid cultivar
gcacgagacgatatctgtgacctttgttgacaaggatggagacgaaaaacatataaaggttccaattgggatgtctatgctagaagctgctcatcaaaatgatatagaacttgaaggagcctgtgaaggttcacttgcctgttcaacatgtcatgtgattttaatggacgtggaatattacaacaaattagaagacccaactgatgaggaaaatgatatgttggacttggcatttggacttacagaaacgtctcgtctgggttgccaagtcattgcaagccctgaacttgatggagttcatttagctattcctgctgccacccgaaattttgctgttgatggctatgtaccaaaaccacactagagatataggacagttcaggaagagttggttagggatgtaactcggtatttatcccatttttgtagcttctctcattttattggcccaaagcaccaattgagtttaaccttcgttcttttagcggctactgctatcatt

SEQ ID NO: 4663 - DNA, 555 bp, Rosa hybrid cultivar
gcacgagacgatatctgtgacctttgttgacaaggatggagacgaaaaacatataaaggttccaattgggatgtctatgctagaagctgctcatcaaaatgatatagaacttgaaggagcctgtgaaggttcacttgcctgttcaacatgtcatgtgattttaatggacgtggaatattacaacaaattagaagacccaactgatgaggaaaatgatatgttggacttggcatttggacttacagaaacgtctcgtctgggttgccaagtcattgcaagccctgaacttgatggagttcatttagctattcctgctgccacccgaaattttgctgttgatggctatgtaccaaaaccacactagagatataggacagttcaggaagagttggttagggatgtaactcggtatttatcccatttttgtagcttctctaattttattggcccaaagcaccaattgagtttaaccttcgttcttttagtggttattgctatcattatgattgctgctatttttgtaagtgcagtagttagataatttataccatattg

SEQ ID NO: 4664 - DNA, 975 bp, Zea mays
attcaaatgctccggaatggaaatgagggaatgtccacaatacccggatttagtcagatccaattcgagggattttgtagattcattaatcaaggcttggcggaagaacttgagaagtttcccacaattaaagatccagatcacgaaattgcatttcaattatttgcgaaaggatatcaattgctagaaccctcgataaaaagaaaggaatgctgtgtatgaatcactcacctattcttccgaattatatgtatccgcgagattaatttttggtttcgatgtgcaaaaggaaaccatttctattggaaacattcctataatgaattccttaggaacctttataataaatggaatataccgaattgtgatcaatcaaatattgctaagtcctggtatttactaccgctcggaattagaccataagggaatttctatatataccgggactataatatcagattggggaggaaggtcggaattagcaattgataaaaaagaaaggatatgggctcgcgtgagtagaaaacaaaagatatctattttagttctatcatcagctatgggttcgaatctaagagaaattttagataatgtttcctaccccgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaagagttggtcgacgaaatatgaatcggagactgaatcttgatatccctcagaacaatacattcttgttaccacgagatgtattggccgctacggatcatttgattggaatgaaatttggaacgggtatacttgacgatgacgatatgaatcacttgaaaaataaacgtattcgtaacgaattcaagcttgattcatc

SEQ ID NO: 4665 - DNA, 539 bp, Saccharum officinarum
  misc_feature (490)..(490): n is a, c, g, or t
  misc_feature (503)..(503): n is a, c, g, or t
gagttccctagaatttcatgtgattcagtaaacagaatatggattccatgattgctagattgatccgtagggattgatgaagagtgagctgataatggaatttttcttctataaataggaaacttaagattcaaatgctccggaatggaaatgagggaatgtccacaatacccggatttagtcagatccaattcgagggattttgtagattcattaatcaaggcttggcggaagaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagattaatttttggtttcgatgtgcaaaagcaaaccatttctattggaaacattcctataatgaattccttaggaacctttataataaatggaatataccgaantgtgatcaatcanatattgctaagtcctggtatttactaccggctcgaa

SEQ ID NO: 4666 - DNA, 1818 bp, Saccharum officinarum
ccactccgcactccgcagacggaccacgggctgctgctgctgctccttcgcttggaaccaggctaccagccgagggcgagagcgtcgctgtcctcctccagcaggcgtccaccctccccgagctcgtcgtcgccacaccaggcgaggccgggcttcgctcggcgagggagggcggaatggggccgtccatggaggggatggaggaggccaacaggacggcagtgcagagctgccaccgggtgctggcgctcctctccaacccgcacggccagctcgtccccagcaaggacctcgtggccgccaccggggatgccgtcgccaagttcggctccctgacggccaagctctccaactccaacggcaatggcctgcagctgcagggccacgctagggtcaggaagatcaagaagcccctgcccatcttcgacagcaacctcttcctcgagagctctgcggtagccgccgccgccactgtggccaagacgcccagcccgagcccgatcactgggctccagttgttcccgaggtaccaccagatggagggctcgtcgtctaaggatcctatcaggatccctgcccagttccccaagaggttgctgctagagaacccggctgccggtctggaggggccgtcgtccaaggcccctccggtccagatggtccagccggtgtccgttgcgcctcctgcagggacgcccaccccggcattgcccgccgctcaccttcatttcctccagcagcaccagagctaccagaggtttcagctcatgcaccagatgaagtttcagaatgagatgatgaagaggaacaatcttggtgatcagggtggtagcttaagcggtggcagtggcggtggcggtaagggtgtgaatctcaagtttgacagctcaaattgcacggcgtcatcatctcgctcgttcctttcgtctctgagcatggaagggagtcttgtgagtttggacagaaaccgggccagcaggccgttccagctagttagtggctctcagacatctagcacaccagagctgggcctggtgcacaggagaaggtgtgctggtagggaggatggcagtggtcggtgcacaaccgggagccggtgccattgttcaaagaaaaggaagctaaggataaggaggtccatcaaagtccctgcaataagcaacaaggttgcagacatcccatctgatgagttctcatggaggaagtatgggcagaagccaattaagggatccccacatcctaggggttattacaagtgtagcagcgtgagagggtgccccgcgaggaagcatgtcgagaggtgcgtggacgacccctcgatgctgattgttacctatgaaggtgaccacaaccacaaccgagttctagcccagccagcctgatctttcaggttatcaattcaagatcgcttctacagtcaccccccttccctagaggaagggaggacaagaagaagaagaagaagaagaagagcttagtgtctgtacatatgttctgcttctaacagttggggggagagagtcagttagctagctctttcagaagaatcaaatgaatggtgacagaaggaaacttatcgcgtcgatggagaaagggagagttcctcatcaaatactctagttttgtagtttcgatttctcttttgcgttcatcctgtgctagggcccatcctgtggttgcagtgtagtaacattgagctgcagttgtatgtctgagaatggtgttaggggattggatcggagaagaaggcataaggcaggaaagtgcctgtaaaagtggctacacctaggaacagaatgtacaatcgtcttcagtcca

SEQ ID NO: 4667 - DNA, 2208 bp, Zea mays
gacgacagggggagcgagcacaaagcggaataaagaaaaggccgggaaaagcgagggcactgcgcctccgctgcggcctgcggcgccagcgccagccaacccctccctcctaccagtaccagtatttgtttgtttatttatatgtatatataaaaccgtcgctcactccaccactgaccactctaccgagccgagcgccgggcggcctttggagtttggactcgtaccactccgtctgcgcaggcggaacggaacacgggcgagggcgcgagagcgtctccacctccaccctcccgagctcgtcgtcaccgcaccaccggggccgggcttcgctcggcgaggcaggcccgtccatggaggggatggaggaggccaacaggacggcagtggagagctgccaccgggtgctggcgctcctctccaacccgcacggccagctcgtccccagcaaggagctcgtggccgccaccggggaggccgtcgccaagttcggctcactgacggccaagctctccaactccaacggcgatggcctactgcagggccacgctagggtcaggaaggtcaagaagcccctgcacatcttcgacagcaacctcttcctcgagagctctgcggtggccgccgccgctgctccggccaagacgcccagcccgagcccgatccttggcctccagctgttcccgaggtaccaccagtttgagggctcgtcgtctaaggatcctgtcaggatccctacccagttccccaagaggttgctgctagagaagccgactgccggtatggaggggtcgacgtcgcagtcccctccgatcgtccagatggtccagccggtgtccgttgcgccccccgcagggacgcccaccccggcattgccccccgctcaccttcatttcatccagcagcagcaaagctaccagaggtttcagctcatgcagcagatgaagatccagagcgagatgatgaagaggagcaatcttggtgatcagggtggtagcttaagtggcggcggcggcggcggtcgtaagggtgtgaatctcaagtttgacagctctaattgcacggcgtcatcgtctcgctcgttcctttcgtctctgagcatggaagggagtcttgcgagtttggatggaagccggaccagcaggccgttccagctacttagtggctctcagacagctagcacgccggagctgggcctggtgcaaaggagaaggtgcgctggcagggaggatgggactggtcggtgtgcaaccgggagccggtgccattgttcaaagaaaaggaagctaaggataaggaggtccatcaaagtccctgcaataagcaacaaggttgcagacatcccagctgatgaattctcatggaggaagtatgggcagaagccaattaagggatccccacatcctaggggttattacaagtgtagcagtgtgagaggctgccccgcgaggaagcatgtcgagaggtgcgtggacgacccctcgatgctgattgttacctatgaaggtgaccacaaccacaaccgagttctagcccagccagcctgatctttcaggctatcaattcaagatcgcttctacagtcaccctccctccctccctagagaagggatgacaacgacgacagtagcaataacaagagcctagtgcctgtacatatgttctgcttctaacagttggaggagagagtcagttagctagctctttcagaaaaatcaatggtgacaggggggaaacttgtcatgtcgatggagaaagggggaggagggttcctcatcaaatactctagttttgtagttttggtttctcttttgtgttcgtcctgtgctagggcccatcttgtggttgcagtgtgacattgagccgcagttgtatgtctggtaatggtgttaggggattggatcgagaagaagagcacaaggcaggaaaagtgcctgtaaaagtggctacacctaggaacagaatgtacaatcgtcttcagtccagtggtacaatcttgttgacgcagtggtttgggtctgtggcgtgttgtttgttagcgccagtgatgctgcgaggcatgggggttgccggctccggctctcagcgtgccgcatccgtgcagtggcatttgtactggggcgtctgccgtttgagaggccggtttgctgcggtctgcgtgtcgccactgtctgaactctgacgctgcttttgacagtttggcatcttc

SEQ ID NO: 4668 - DNA, 2079 bp, Setaria italica
ccttggactcacatatcactccgtccccgcagactgccaccgctgctcctccctgctgcttcttcgtcgcctgtaccagccgagtgcgggggcgtccctgccctcctccaccccacctctccagttcgtcgtctccagtctccaccgaggcgggggcggcgcggccgggggcttcgctccgcgagggagggggaaggggatggaggggatggaggaggccaacagggcggcggtggagagctgccaccgggtgctggcgctcctctccaacccgcgcggccagctcgtccccaacaaggatctcgtcgcggcgacgggggaggccgtcggcaagttcggctccctcaccgccaagctctccaactccaacggcaatggcctccagggccacgccagggtcaggaagatcaagaagcccctgcccatcttcgacagcaacctcttcctggagagctctgcggtggccgtcgccgctgccactccagccaaggcgcccagcgcgagcccgatcactggcctccagctgttcccgaggtaccagatggagggctcgtcgtcaaaggatcctatcaggatccatacccagttccccaagaggttgatgctagagaacccggctgctgctttggaggggccatcttcgcaggcccctccggtccatatggtccagccggtgtccgtcgcgcccccagcggggacgccgacaccggcattgcctgcagcacaccttcatttcatccagcagcagcagagctaccagaggtttcagctcatgcagcagatgaagattcagaacgagatgatgaagaggagcattggggatcagggtggtagcttaagtggcggtggcgggggtggtgctaagggggtgaatctcaagtttgacacctcgaattgcacggcgtcatcgtctcgctcgttcctttcatctctgagcatggaagggagccttgcgagtttggatggaagccgggccaacaggcctttccagctagttagtggctctcaggcatctagcacgcctgagctgggccttgtgcagaggaagaggtgcactggtagggaggatgggagtggtcggtgcgcaactgggagccggtgccattgctcgaagaaaaggaagctgaggataaggaggtccatcaaagtccctgcaataagcaacaaggttgcagatataccagctgatgagttctcatggaggaagtatgggcagaagcccataaagggatccccacatcctaggggttactacaagtgtagcagtgtgagaggctgcccagcaaggaagcacgtcgagaggtgcgtcgacgacccctcgatgctgattgttacctatgaaggcgatcacaaccacaaccgagtggtagcccagccagcctgatctttcaggctatcagttgaagacctgcttctatagccatcctccctacctagacaagggaggacaaaaacaacaacaaccagaagaagagactagtgtctgtacatatgttctgcttctaacagttggggagggggggagagtcagttagctagctctttcagaagaaccaatggcgaaagaaggaaacttatggtgcaggtggtcggtggcgaaagccgaaaggagtgttagttcctcatcaaagactcatagttttgtagctttgatttcccttttgtgttaaaatgctgtgctaggagggcccatcctgtggttttgcagcgcgacattgagctgcagttgtatgtctggggatggtgttactgtgttaggggattggatccgagaagaaggcataaggcagggaagtgcctgtaaaagttgctacacctaggaacagaatgtaccctcatcttcagtcggtggtacaatctttgttgaggcagtgggtttggtttggtctgtctgtggtgcgttgtttgttagcgcgatcgtgatgctgcgatgcgtgggactgccgcctctgatcgtgcggcagtcgcagcggcactcgtactggggcgtcctgccgtttgagttccctgcgatctgcctgtacgtggtggtgtctcggctgtcttgagttctgacgatgcttagacagttcgacatct

SEQ ID NO: 4669 - DNA, 1811 bp, Zea mays
gtctcgcagacggaccacggtccacgggttgtaaaaccaaccaggctaccagccgagggcgagtgcgtcgctttcctcctccaggcctccaccctcgctctcgctcgctcgtcgtcaccaccacaccagcgaggcgcggcgcggcgggcttcgctcgtcgagagaggcgcgccgtccatggaggcgatggaggaggccaacaggacggcagtggagagctgccaccgggtgctggcgctcctctccaacccgcacggccagctcgtccccagcagggagctcgtggccaccaccggggaggccgtagccaggttcggctccctggcggccaagctctccagctccaacggcaatggcctgcagggccacgctagggtcaggaagaccaagaagcccctgcccatcttctacagcaacctcttcctcgagagcagctctgcggtggccgccgccgcgactgtggccaagacgcccagtccgagcccgaccactggcctccagctgttcccgaggtaccaccagatggagggctcgtcgtgtaaggatcctgtcaggatccctgcgcagttccccaagaggttgctgctggagaacctggctgccggtctggaggggtcgtcgccgcctgcccctccggtccggatggtgcagccggtgtccgttgcgcctcccgcagggatgcccaccccggcattgcccgccgcacacctccatttcatccagcagcagcagagctaccagaggtttcagctcatgcagcagatgaagattcagagcgagatggttaagaggagcaatcttggtgagcagggtggtagcttaagtggcggcgggggcggtggtaagggtgtgaacctcaagtttgacagctccaattgcacggcgtcatcgtctcgctcgttcctttcgtctctgagcatggaaggaagtcttgcgagcttggatggaagccgggccagcaggccgttccagctagttagtggctctcagacatctagcacaccggagctgggcctggtgcaaaggagaaggtgtgctgggaaggaggatgggagtggtcagtgcgcaaccgggagccggtgccattgttcaaagaaaaggaagctaaggataaggaggtccatcaaagtccctgcagtaagcaacaaggttgcagacatcccagctgatgagttctcgtggaggaagtatgggcagaagccaatcaagggatccccacatcctaggggttactacaagtgtagcagcgtgagaggctgccccgcgaggaagcacgtcgagaggtgcgtggacgacccttcgatgctgatcgttacctacgagggtgaccacaaccacagccgagttctagcccagccagcctgatctctctggctatcgattattcaagatcgcttccgtagtagtcaccctccctctctagagaagggaggacagcaacagcaacaatgagagcctagtgtctgtacataagttctgcttctaacagttggaggagtgattcggttagctagctctttcagaagaatcagtggtgacagaagggaacttatcgcgtcgatggatggaagaaagggagagagagagttcctcatcagatactcatactctatttttgtagcttcggtttatctctcttttttgttcatcctgtgctagggcccatcctgtgggttgtatgtctgggaatggtgttgggggggattggatcggagaagaaggcatgtggcaggaaattgcctgtaaaagtggctacacctaggaacagaatgtactatcgtcttcagcagtggtacagccttgttgacgca

SEQ ID NO: 4670 - DNA, 2171 bp, Oryza sativa
taatccgcccgaggaggaataccagagagcacaaagggagaaaagaaaattaaagaaaagaaggggcaaaaaagcgagagcactgccctggccccaccctcttccccaccaatttgtttatttattcatttatttattttcttcttcgttcactcagtggcttgcttggactagtactggactctacttctactgctgctgcgcttccctgcttgtaccagccgagggagagagagagagagagagagagaggggcagccactccctctcctcctcgtcgtcgtcgtctccaccggtggaggtctcagccctggctccagcgaggtagggtgggaggggagtgattcatggaggggatggaggaagcaaacagggaggcagtgcagagctgtcacagggtgctcaccctcctctccagcccccatagccagcttgtccctaacaaggatctcgcggcggctacgggagaggctgttgcaaagttctgctccgtggcatccaggctgaacaatggcaatggcctccagggccatgcccgggttagaaagatcaagaagcccttgcctatctttgatagcaacctctttttggagagccctgcactggctgtggcgatggcagccaagacacctaactcgagtccgatcactagcctccagctgtttccgaggtaccatcagatggagggctcttcttcaaaggatcctgttaggatccctgcccaattccccaaaaggttgcttctagataaccctgcggttgattcggatgggccatcacgggggccaccgctccagctcatccagccggtgtctgttgcgcccccagctggaacgcctcacccggcattgccttcggcgcatcttcatttcatccagcagcatcagagctaccagaggtttcagctcatgcagcagatgaagatgcagagtgagatgataaagaggagtggccttggtgaacagggtggtagcaatggtggtggtaagggtgttaatctcaagtttgacagttctaattgcacggcatcatcctcccgttcattcttgtcgtctctgagtatggaggggagcattgcgagtttggacggtagccgctccagtcgtccattccagctagttagtgggtcacagacgtcaagcactccagagttaggcctcatgcagaggaggaggtgcactggtagggaggatggtagtggacgatgcacaactgggagccgatgtcactgtgcgaagaaaaggaagctgaggataaggaggtctatcaaagtccctgcaatcagtaataaggttgctgacattccagctgatgagttctcatggaggaagtatggacagaagccaataaaaggatccccacatcctaggggttactataagtgtagcagtgtaagaggatgcccagccaggaagcatgttgagaggtgcgtcgacgacccctcgatgttgattgttacctatgaaggtgatcacaatcacaaccgggtcctagctgcccagccagcctgatcgacatttcaggctttcagtcgccggatcacttcgatagcatccctttctagacaagagattaaaaagtaaaaaaaaaaagaacaagaggagcctagtttgtacatactgctctgttcctaactgttgggtggtagagacagctcttgcagaagaatccatggcgaaaggaatttaccgcatagatggagtattttctcatcggagactcgtaattttgtagccttttctctcctttttattttgccctcttcatgttggtcctagaaactatcttgtgttgcagtgtgacattcagctgctgcagttatatgtctgggggtgtggtggtggtgaaggtgatttactgtttagaggattggagaggacagtgcctgtaaaagtggcaacacctaggaacaaaatgtaccctcatcttcagtctggaatggtagtacaatctttgttgtgatgggaagcatcgggttgtttgtgatgtgtttgctagcacaagtgtgatcctgcgacgggatcgtcaggctttaaaattctgaccgtgttttgtcctgcgaaattcagatttcagaggccagtttctgggcgatctgaaaacgcatgcagccattgtacctagtgcctctcttgtcccttgattctttgacatgtccatgtagcgattca

SEQ ID NO: 4671 - DNA, 1951 bp, Oryza sativa
agtactggactctacttctactgctgctgcgcttccctgcttgtaccagccgagggagagagagagagagagagagagaggggcagccactccctctcctcctcgtcgtcgtcgtctccaccggtggaggtctcagccctggctccagcgaggtagggtgggaggggagtgattcatggaggggatggaggaagcaaacagggaggcagtgcagagctgtcacagggtgctcaccctcctctccagcccccatagccagcttgtccctaacaaggatctcgcggcggctacgggagaggctgttgcaaagttctgctccgtggcatccaggctgaacaatggcaatggcctccagggccatgcccgggttagaaagatcaagaagcccttgcctatctttgatagcaacctctttttggagagccctgcactggctgtggcgatggcagccaagacacctaactcgagtccgatcactagcctccagctgtttccgaggtaccatcagatggagggctcttcttcaaaggatcctgttaggatccctgcccaattccccaaaaggttgcttctagataaccctgcggttgattcggatgggccatcacgggggccaccgctccagctcatccagccggtgtctgttgcgcccccagctggaacgcctcacccggcattgccttcggcgcatcttcatttcatccagcagcatcagagctaccagaggtttcagctcatgcagcagatgaagatgcagagtgagatgataaagaggagtggccttggtgaacagggtggtagcaatggtggtggtaagggtgttaatctcaagtttgacagttctaattgcacggcatcatcctcccgttcattcttgtcgtctctgagtatggaggggagcattgcgagtttggacggtagccgctccagtcgtccattccagctagttagtgggtcacagacgtcaagcactccagagttaggcctcatgcagaggaggaggtgcactggtagggaggatggtagtggacgatgcacaactgggagccgatgtcactgtgcgaagaaaaggaagctgaggataaggaggtctatcaaagtccctgcaatcagtaataaggttgctgacattccagctgatgagttctcatggaggaagtatggacagaagccaataaaaggatccccacatcctaggggttactataagtgtagcagtgtaagaggatgcccagccaggaagcatgttgagaggtgcgtcgacgacccctcgatgttgattgttacctatgaaggtgatcacaatcacaaccgggtcctagctgcccagccagcctgatcgacatttcaggctttcagtcgccggatcacttcgatagcatccctttctagacaagagattaaaaagtaaaaaaaaaaagaacaagaggagcctagtttgtacatactgctctgttcctaactgttgggtggtagagacagctcttgcagaagaatccatggcgaaaggaatttaccgcatagatggagtattttctcatcggagactcgtaattttgtagccttttctctcctttttattttgccctcttcatgttggtcctagaaactatcttgtgttgcagtgtgacattcagctgctgcagttatatgtctgggggtgtggtggtggtgaaggtgatttactgtttagaggattggagaggacagtgcctgtaaaagtggcaacacctaggaacaaaatgtaccctcatcttcagtctggaatggtagtacaatctttgttgtgatgggaagcatcgggttgtttgtgatgtgtttgctagcacaagtgtgatcctgcgacgggatcgtcaggctttaaaattctgaccgtgttttgtcctgcgaaattcagatttcagaggccagtttctgggcgatctgaaaacgcatgcagccattgtaccta

SEQ ID NO: 4672 - DNA, 1813 bp, Sorghum bicolor
ggggaccgaaccaaaccaactcgtccacagctcgcgcgcgcagccaatccctctccctctccctctccggctccggcggcctcgagatcgagcccaaaaccacctcggtctctgtctctctctcgtctcgccccctgtttagtttgtgtttgcccatccatcccatcccccatggcgaccgacggcggcgagaagggcagcagcggccacgcggcggcggagtggcggttcgcgcgggcggcggcggccaaggaggagggcgcgctggccgtggccggggacaagatgagcatccgggcggcgcggttcaagatcagcgcgagcgtggacgcgcgcgacccgcggcccgtgctgccgctggcgcacggggacccctcggtgttcccggccttccgcaccgccgccgaggccgaggacgccgtggccgccgcgctccggaccggcaagttcaactgctaccccgccggcgtcggcctccccgacgcccgccgtgctctggcggagcacctgtcaagtgatcttccatacaagctgtcaactgatgacatcttcctcactgctggaggcactcaagcaattgaggttgtcgtctcagtgcttgctcaaccgggcaccaacatattgctcccaagaccaggctatccaaattatgaggcgcgtgcagggctgcacaacttagaagttcgtcgtttcgatctgattcctgaaagaggctgggaaattgatatcgactctctcgagtcgattgctgacaagaacaccactgcaatggtcatcataaaccccaacaatccttgcgggagtgtctatacccatgaacatttagccaaggtcgcggaggtagcaaggaagcttggaatcctagtcatcgctgatgaagtatatggaaatctggtgtttggggacacccctttcgtccccatgggtgtctttggccacattgcccctgtgttgagcataggatcactatcaaagagatggatagtgcctgggtggcgacttggttgggtagctgtatgtgatcccaacaagattctgctaaacacaaagatcattgcatcgatcacaaacttccttaacatttcaactgatccagcaacttttattcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttctggaagggatccatgatgatattgatttttgctgcaagctggcaaaagaagagtccgtgattttgtgtccagggagtgttttgggaatggaaaactggatccgtatcactttcgccattgattcatcttctcttcttgatggtcttgagaggatcaaatctttctgccaaaggcataagaagaagaatttgcttaatggtcattaactgtatctgagttcaaaaattgttacccagttccatcgtttttcattgtatcatcaacaaatgtggaactttgaaatccttcagaaataataaatttaatgcttgcacatcagcatatgcaagtcagtgtacatttttagccaccttaatcctatgctttgagatcttttgattttgcgtttgtttcagtttgcaatgttctttttttttctaatttgacatcatttatatgtgtggtaatggtgaaatacatgttcccatgtattatgtactatgtgagctgtgaagctttttgtgttgacaaaaaaattacaacacc

SEQ ID NO: 4673 - DNA, 1669 bp, Sorghum bicolor
cttcggggaccgaaccaaaccaactcgtccacagctcgcgcgcgcagccaatccctctccctctccctctccggctccggcggcctcgagatcgagcccaaaaccacctcggtctctgtctctctctcgtctcgccccctgtttagtttgtgtttgcccatccatcccatcccccatggcgaccgacggcggcgagaagggcagcagcggccacgcggcggcggagtggcggttcgcgcgggcggcggcggccaaggaggagggcgcgctggccgtggccggggacaagatgagcatccgggcggcgcggttcaagatcagcgcgagcgtggacgcgcgcgacccgcggcccgtgctgccgctggcgcacggggacccctcggtgttcccggccttccgcaccgccgccgaggccgaggacgccgtggccgccgcgctccggaccggcaagttcaactgctaccccgccggcgtcggcctccccgacgcccgccgtgctctggcggagcacctgtcaagtgatcttccatacaagctgtcaactgatgacatcttcctcactgctggaggcactcaagcaattgaggttgtcgtctcagtgcttgctcaaccgggcaccaacatattgctcccaagaccaggctatccaaattatgaggcgcgtgcagggctgcacaacttagaagttcgtcgtttcgatctgattcctgaaagaggctgggaaattgatatcgactctctcgagtcgattgctgacaagaacaccactgcaatggtcatcataaaccccaacaatccttgcgggagtgtctatacccatgaacatttagccaaggtcgcggaggtagcaaggaagcttggaatcctagtcatcgctgatgaagtatatggaaatctggtgtttggggacacccctttcgtccccatgggtgtctttggccacattgcccctgtgttgagcataggatcactatcaaagagatggatagtgcctgggtggcgacttggttgggtagctgtatgtgatcccaacaagattctgctaaacacaaagatcattgcatcgatcacaaacttccttaacatttcaactgatccagcaacttttattcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttctggaagggatccatgatgatattgatttttgctgcaagctggcaaaagaagagtccgtgattttgtgtccagggagtgttttgggaatggaaaactggatccgtatcactttcgccattgattcatcttctcttcttgatggtcttgagaggatcaaatctttctgccaaaggcataagaagaagaatttgcttaatggtcattaactgtatctgagttcaaaaattgttacccagttccatcgtttttcattgtatcatcaacaaatgtggaactttgaaatccttcagaaataataaatttaatgcttgcacatcagcatatgcaagtcagtgtacatttttagccaccttaatcctatgctttgagatcttttg

SEQ ID NO: 4674 - DNA, 1489 bp, Saccharum officinarum
catcgatcgagtccacagctcgcgcgcgcagccaagccaatccctctccctccagagcccaaaaccacctcggtctctctcgccccctgtttgcccatcccatcccatggcgacccacggcggcgagaacggcagcgggcacgcggcggagtggcggttcgcgcgggtggccaaggagggggagggcgcgctggccgtggccggggacaagctgagcatccgggcggcgcggttcaagatcagcgcgagcgtggacgcgcgcgacccgcggcccgtgctgccgctggcgcacggggacccctcggtgttcccggccttccgcaccgccgccgaggccgaggacgccgtggccgccgcgctccggacgggcaagttcaactgctaccccgccggcgtcggcctccctgacgcccgccgtgctctggcggagcacctgtcaagtgatcttccatacgagctctcaactgatgacatcttcctcactgctggaggcactcaagccattgaggttgtcgtctcagtccttgcccaaccgggcaccaacatattgctcccgagaccaggctatccaaactatgaggcgcgtgcaggactgcacaacttagaagttcgccgtttcgatctgattcctgaaagagggtgggaaattgatatcgactctctggagtcgattgctgacaacaacaccaccgcaatggtcatcataaaccccaacaatccttgcgggagtgtctatacccgtgaacatttagccaaggtcgcggaggcagcaaggaagcttggaatactagtcatcgctgatgaagtatatggaaatctggtgtttggggacacccctttcgtccccatgggtgtctttggccacattgcccctgtgttgagcataggatcactatcaaagagatggatagtgcctgggtggcgacttggttgggtagctgtatgtgatcccaacaagattctgcaaaaaacaaagatcattgcatcgatcacaaacttccttaacgtttcgactgatccagcaacttttattcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttttggaagggatccatgatgatattgatttttgctgcaagctggcaaaagaagagtccgtgattttgtgtccagggagtgttttgggaatgaaaaactggatccgtatcactttcgccattgattcatcttctcttcttgatggccttgaaaggatcaaatctttctgccaaaggcataagaagaggaatttgcttaatggccattaactctatctgagttcaaagttgttacccagttccatcgtttccattgtattaataacaaatgtggaactt

SEQ ID NO: 4675 - DNA, 1700 bp, Zea mays
cgcaaggacaaaacggagtagtgagtgaggacgaggggatgccgtctcggctgccaaagcggcctggcagactcccggccggggcgcgtgaatcgtgccgcccggcccgaggcccaaacctgctggcggccgcgtataaaaaggtggagtggaggcacacttgactagccagggaccaaatcaactcaagtcatcgagtccacagctcgcgcgcgcagccaatcgctctccctccggcctccacagcccaaaaccacctcggccccacttcttctctccgtcgccccctgtttgtccaacccatggcgacccacgccagcgacaatggcagcgggcacgcggagtggcggttcgctcgggcggcgaaggagggtgcgctggccgtggccggggacaagatgagcatccgggcggcgcggttcaagatcagcgcgagcgtggacgggcgcgacccgcggcccgtgctgccgcttgcgcacggggacccctcggtgttcccggccttccgcaccgccgccgaggccgaggacgccgtggccgccgcgctccggacgggcaagttcaactgctaccccgccggcgtgggcctccccgaagcccgccgtgctctggcggagcacctgtcaagtgatcttccatacaagctgtcaactgatgacatcttcctcaccgctggaggcactcaagccattgaggttgtcgtctcagtccttgcccaaccgggcgccaacatattgctcccaagaccaggctatccaaattatgaggcgcgtgcaggactgcacaacttacaagttcgccatttcgatctgattcctgagagagggtgggaaatcgatatcgactctctggagtcgattgctgacaagaacaccaccgcaatggtcatcataaaccccaacaatccttgcggcagtgtctacacccgtgaacatttagccaaggtcgcggaggtagcaaggaagcttggaatactagtcatcgctgatgaagtgtatggaaacctggtgtttggggacaccccttacgtcccaatgggtgtctttggccacattgcccctgtcttgagcataggatcactatcgaagaggtggatagtgcctgggtggcgacttggttgggtagctgtatgtgatcccaacaagattctgcaagaaaccaagatcattgcatcaataacaaacttccttaacgtttcaactgatccggcaacttttgttcagggagcacttccccatattcttgagaacacaaaggaagattttttcaggaggatcattggtctgctagcagaaacctcagagatatgttacagagaaataaaggacatcaagtgcatcacctgccctcacaagccagaaggttccatgtttgtcatggtgaaattaaatttgtatcttttggaggggattcatgacgatattgatttttgctgcaagctggcaaaagaagagtctgtgattttgtgtccagggagtgttttgggaatggaaaactggatccgcatcactttcgccattgattcatcttctcttcttgatggtcttgagaggatcaaatctttctgccaaaggcataagaagaagaatttgcttaatggccattaactgtatctacgttcaaagttacctagttccattgtattatcaacaaatgtggaactttgaaatccctctgaattaataaagttttccttgaat

SEQ ID NO: 4676 - DNA, 1670 bp, Zea mays
tgccagtgccagtgccacccgccccgcagccctaacttgctggcggccgcctataaaatgctggaacactcgcctcgccgtcgccggggaccaaaccaactcgagtcatcgagttccacagctctcgcgtcgcgcgcagccaatccctctccctccggcctacacagcccacaactcccttctccatctctctctctctctctcgcccgtgtcgccccctgtttgtgtacaaccccatggcgacccacgccggcgagaacggcagcgggcacgagaacggcggcgggcacgcggagtggcggttcgcgcgggcggcgaaggagggcgcgctggccgttgcgggggacaagatgagcatccgggcggtgcggttcaagatcagcgcgagcctggacgcgcgcgacccgcggcccgtgctgccgctggcgcacggggacccctcggtgttcccggccttccgcaccgccgccgaggccgaggacgccgtggccgccgcgctccggaccggcaagttcaactgctaccccgccggcgtcggcctccccgaagcccgccgtgctctggcggagcacctgtcgagcgaccttccatacaagctgtcgagcgacgacatcttcgtcaccgccggaggcacgcaagccatcgaggtggtggtctcagtcctcgcgcagccgggcaccaacatactgctcccgaggccgggctatccgaactacgaggcgcgcgcagggctgcacaacctggaagttcgccggttcaatctgatccccgagagagggtgggagattgacatcgacggtctggagtcgatcgccgacaagaacaccaccgccatggtcatcataaaccccaacaacccttgcgggagtgtctacacccgagagcatttggccaaggtcgcggaggtggcaaggaagcttggaatactggtcatcgctgatgaggtgtacggaaatctggtgtttggggacacccctttcgtccccatgggtgtctttggccacattgcccctgtgttgaccataggatcactgtccaagagatggatagtgcctgggtggcgacttggttgggtggccgtatgtgatcccaacaaggttctgcaagaaaccaagatcattgcatcgatcacaaacttccttaacgtttcaacagatccggcaacttttgttcagggagcgcttccccatattcttaagaacacaaaggaagattttttcaagaggatcattggtctgctagcggaaacatcagagatatgtttcagcggaataaaggacatcaagtgcatcacatgccctcacaagccagaaggttccatgtttgtcatggtgaaactaaatttgtatcttttggagagcatccatgatgatattgatttttgttgcaagctggcaaaagaagagtccgtgattttgtgtccagggagtgttttgggaatggaaaactggatccgtatcactttcgccattgattcatcttctcttcttgatggtcttgagaggctgaaatctttctgccaaaggcataagaagaagaatttgcttaatggccattaactatattcgacttcaaagttgttacccacttccatcgttttccactgtatcatcaacaaaagtgtaacattgaaatccctcagaagtaataaagttaatgtttacatatga

SEQ ID NO: 4677 - DNA, 1432 bp, Pennisetum glaucum
ccgccagagcggcggcgcccgtgccgccgaggacatcaacggcaacgggcacgcgaaggcgccggcggcggattggcagttcgcgcgggcggtgaaggatagcccgctggcgggggcgggggaccggatgagcatccgcgcggtgcggttcaagatcagcgcgagcgtggacgcgcgcgacccgcggcccgtgctgccgctcgcgcacggggacccctccacgttcccggcgttccgcacggccgctgaggccgaggccgccgtcgccgccgcgctccggacgggcaagctcaactgctaccccgccggcgttggcctgcccgacgcccgccgcgctttggcgaagcacctgtctagtgatcttccatacgagctatcatcagacgacatcttcctcacagcaggaggaactcaggccatcgaggttgtgatctcagtcctggcccacccgggcaccaacatattgcttccaaggccggggtatcctaactatgaggcgcgtgccgcgttgaacaacttagaagttcgccattttgatttgattcctgagagaggttgggaaatagatattgactctctggagtctgttgctgacaagaacaccaccgcaatggtcatcataaaccccaacaacccttgtgggagtgtgtacacccatgaacatttggccaaggttgcagaggtagcaaggaagcttggaatattagtcattgcagatgaagtatacggcaatctagtttttggggattcccagtttatcccaatgggtgtctttgggcacattgcccctgtgttgaccataggatcactctcaaagagatggatagtgcctggatggcgacttggctgggttgctgcatgtgatcccaagaagattcttcaagatactaaaattcttatgtcgatcacaaacttccttaatgtttcaactgatccggcaactttcattcagggcgcacttccacaaattcttgagaacacaaaggaagatttctttaagagggtcattggtttgctagaggaaacatcagagctatgttatagagaaataaaggacatcaagtgcatcacctgtcctcacaagccagaaggttccatgtttgtgatggtgaagctgaatttatatcttttggaggggatccatgatgacattgacttttgctgcaagctggcaaaagaagagtcagtgattttgtgcccagggagtgttctgggaatggaaaactgggttcgcataacgtttgccattgattcatcctctcttctagacggtcttgagaggatcaaatctttctgccaaaggcacaagaacaaaaatctgcttagtggcttttaagtgtatctcgatcaaagttgtttttcagttccggtgtcccactgtaccgtctacataaatatggaactctaagtttcctaataaagtgctaatatt

SEQ ID NO: 4678 - DNA, 1624 bp, Setaria italica
ccgaggctaccgcgcgcaagggaaggaaacccggtggccgcctatataactggccgccggtgaccaagtcgccaaatccaatcagcccatagcaagcgcacccaccaccaatctcccagcccaaagcaaacaccacctcggtctctctcgtctcctcgtttgcccatggcgaccctccaccagaacggcggcgcccgtgccgccgaggacgtcaacggcaacggcaacgggcacgcggcggcgccggcggcggagtggcagttcgcgcgggcggtgaaggatggcgcgctggcggcggcgggggaccggatgagcatccgcgcggtgcggttcaagatcagcgccagcgtggacgcgcgcgacccgcggcccgtgctgccgctcgctcacggggacccctccacgttcccggcgttccgcacggccgccgaggccgaggccgccgtcgccgccgcgctccggacgggcaagctcaactgctaccccgccggcgtcggcctgcccgacgcccgccgcgctttggcgaagcacctgtcgagtgatcttccatacgagctatcatccgacgacatctttctcacggcaggaggcactcaggccatcgaggttgtgatctcagtcctggcccagccgggcaccaacatattgcttccaagaccgggatatcctaactatgaggcgcgcgcggcgttgaacaacttagaagttcgccattttgatctgatccctgagagagggtgggaaatagatatcgactctttggagtctattgctgacaagaacaccaccgcaatggtcatcataaaccccaacaacccttgtgggagtgtgtacacccgtgaacatttagccaaggttgcagaggtagcaaggaagcttggaatattagtcattgctgatgaagtatatggcaatctggttttcggtgactccccgtttatcccaatgggtgtctttgggcacattgcccctgttttgaccataggatcactctcaaagagatggatagtgcctggatggcgacttggctgggttgctgcatgtgatcccaagaagattcttcaagaaactaagattcttacgtcaatcacaaacttccttaatgtttcaactgatccggcaactttcattcagggagcacttccacaaattcttgagaacacaaaggaagaattcttcaagaggatcattggtttgctagaggaaacatcagagatatgttatagagaaataaaggacatcaagtgcatcacctgtcctcacaagccagaaggttccatgtttgtgatggtgaagctgaatttatatcttttggaggggatccatgatgacattgatttttgctgcaagctggcaaaagaagagtcagtgattttgtgcccagggagtgttcttggaatggaaaactgggttcgcataacgtttgccattgattcatcttctcttctagatggccttgagaggatcaaatctttttgccaaaggcacaagaagaagaatctgcttagtggcttttaagtgtacctcaatcaaagttgttgctcagttccagtgttccattgtaccgtcgataaatgtggaactataagtttcctaataaagtgctaatgtttccacgtcacat

SEQ ID NO: 4679 - DNA, 1567 bp, Panicum virgatum
caagcacccaatccaccctccaagtccagagcagcaagctagcggtaaacaagccaccacctcggtcgtctcgtctccgcgctctgcccatggcgacgacccaccaccagaacggcggcgccaccgccgcccgtgctgcggaggacggcaacatcaacggcaacggccacgcggcggcggcggcggagtggcggttcgcgcgggcggcgaaggagggcgcgctggcggcggcggggggacaagatgagcatccgcgcggtgcggttcaagatcagcgcgagcgtggacgcgcgcgacccgcggcctgtgctgccgctggcgcacggggacccctccgtgctcccggccttccgcaccgccgccgaggccgaggaagccgtcgccgccgcgctccggacgggcaggctcaactgctaccccgccggcgtcggcctgcccgacgcccgccgtgctttggcgaagcacctgtcgcgtgatcttccatacgacctatcctccgacgacatcttcctcaccgctggaggcactcaagccatcgaggtggtgatctcagttctagcccaaccgggcaccaacatattgctgccaagacccgggtatccaaactacgaggcgcgcgccgcgctgaacaacttagaggttcgccacttcgatctgattcctgagaaagggtgggagatcgacatagactctctggagtctattgctgacaagaacaccgccgcaatggtcatcatcaaccccaacaacccttgtgggagtgtgtacacccgtgaacatttggccaaggttgccgaggcagcaaggaagcttgggatcttagtcattgctgacgaagtgtatggcaatttggttttcggggactcccagttcatcccaatgggcgtctttgggcacatcgccccagtgttgagcataggatcactctcaaagagatggatagtgcctggatggagacttggctgggttgctgcatgcgatcccaagaagatcctgcaagaaactaagattcttacgtcaatcacaaacttccttaatgtttcaactgatccagcaactttcattcagggagcacttccacaaattcttgagaacacaaaggaagatttcttcaagaggatcattggtttgctagaggaaacatcagatatatgttatagagaaataaaggacatcaaatacattacttgtccgcacaagccagaaggttccatgtttgtgatggtgaagctgaatttgtatcttctggaggggatccatgatgacattgatttttgctgcaagctggcaaaagaagaatcggtgattttgtgcccagggagtgttctgggaatgaaaaactgggttcggataacgtttgccattgattcatcttctcttctggatggccttgagaggatcaaatctttctgccaaaggcacaagaagaagaatctgcttaatggcatctaaagttttaagtgtatctgggatcaaagttgttgctcagttccagtgttttccgttgccccgtcgatgaatgtggaactttgagtttcgtaataaagtgttaatcttttcagaccag

SEQ ID NO: 4680 - DNA, 1734 bp, Oryza sativa
aggcgcgcatgcatgcttcatgctgctgtgccccacccgagtccgtgtcccacacccgtagaatctcctacaaatatagcggcactagctatccgacgcgcaccaccaccacctcctcctctgcaccggaattcaccaacaaaaaacagagcacggccatggcaccgacgacggcggcggcggcggcgagcagcaacggcggcggcgagagcgacggcagcagcaaggagtggaggctgacggcgccgacgaggggcggcgcgatggcggcggcgggggacaagatgagcatccgggcggtgcggtacaagatcagcgccagcgtcgacgaccgcggcccgcgccccgtcctgccgctcgcccacggcgacccctccgtgttccccgagttccgcaccgccgccgaggccgaggacgccgtcgccgacgcgctccgctccggcgacttcaactgctaccccgccggcgtcggcctccccgccgcgcgacgtgctgtggcagatcatttgtcacgcgacctcccatacaagctatcttctgatgacatcttcctaaccgctggaggaactcaggccatcgaggtcgtaatctcaatccttgcccaacctggcacaaacatattgcttcctagaccaggctacccaaactatgaagctcgagccgcgttcaacaaccttgaagttcgtcactttgatcttattcctgagaagggctgggagattgaccttaactccctagaatctattgcggacaagaacactactgcgatagtcatcataaatcccaataatccatgcgggaatgtgtacacttacgagcatttatccaaggtggcagaggtagcaaggaagcttgggatattggtaattactgatgaggtgtatggtaatttggtttttgggagttccccatttgtcccaatgggttgctttgggcacatcgtaccaatattaaccataggatcgctatcaaagaggtggatagtgccgggatggcgacttggttgggtagcaatatgtgaccccaagaagactctacaagaaaccaagattgcaacattaattactaatttccttaatgtttcaactgatccagcaactttcattcagggagctctaccgaatattcttaagaataccaaggaagaattctttaagaggataattgatttgcttacggaaacatcagatatttgctatagaggaataaaggatattaaatgcatcacttgtcctcacaagcccgaaggatccatgtttgtgatggtgaaattgaacctatatcttttggagggaatccatgatgatgttgatttttgttgccaacttgcgaaagaagagtcggtgattctttgcccagggagtgtgctgggaatgaagaattgggttcgcattacttttgctattgattcatcttctctcctggatggtcttgagaggatcaaatccttctgccaaaggcacaagaagaaaaaccctttaaattatatctagattgtactaggattggaatgatcagtactaattgtgatgtttgtgctttatacctgttgtcaccaaaatggaactattaatttgctatgaataaagcttacaaattcatatgtgtcaatgaactcatctataaaagttgcacatgtagtttacatagacttgacggttacttctcatcaaggacttttatttacctttgttacattttgaaggcccattatatgttatgggacctctaatt

SEQ ID NO: 4681 - DNA, 1609 bp, Oryza sativa
aggcgcgcatgcatgcttcatgctgctgtgccccacccgagtccgtgtcccacacccgtagaatctcctacaaatatagcggcactagctatccgacgcgcaccaccaccacctcctcctctgcaccggaattcaccaacaaaaaacagagcacggccatggcaccgacgacggcggcggcggcggcgagcagcaacggcggcggcgagagcgacggcagcagcaaggagtggaggctgacggcgccgacgaggggcggcgcgatggcggcggcgggggacaagatgagcatccgggcggtgcggtacaagatcagcgccagcgtcgacgaccgcggcccgcgccccgtcctgccgctcgcccacggcgacccctccgtgttccccgagttccgcaccgccgccgaggccgaggacgccgtcgccgacgcgctccgctccggcgacttcaactgctaccccgccggcgtcggcctccccgccgcgcgacgtgctgtggcagatcatttgtcacgcgacctcccatacaagctatcttctgatgacatcttcctaaccgctggaggaactcaggccatcgaggtcgtaatctcaatccttgcccaacctggcacaaacatattgcttcctagaccaggctacccaaactatgaagctcgagccgcgttcaacaaccttgaagttcgtcactttgatcttattcctgagaagggctgggagattgaccttaactccctagaatctattgcggacaagaacactactgcgatagtcatcataaatcccaataatccatgcgggaatgtgtacacttacgagcatttatccaaggtggcagaggtagcaaggaagcttgggatattggtaattactgatgaggtgtatggtaatttggtttttgggagttccccatttgtcccaatgggttgctttgggcacatcgtaccaatattaaccataggatcgctatcaaagaggtggatagtgccgggatggcgacttggttgggtagcaatatgtgaccccaagaagactctacaagaaaccaagattgcaacattaattactaatttccttaatgtttcaactgatccagcaactttcattcagggagctctaccgaatattcttaagaataccaaggaagaattctttaagaggataattgatttgcttacggaaacatcagatatttgctatagaggaataaaggatattaaatgcatcacttgtcctcacaagcccgaaggatccatgtttgtgatggtgaaattgaacctatatcttttggagggaatccatgatgatgttgatttttgttgccaacttgcgaaagaagagtcggtgattctttgcccagggagtgtgctgggaatgaagaattgggttcgcattacttttgctattgattcatcttctctcctggatggtcttgagaggatcaaatccttctgccaaaggcacaagaagaaaaaccctttaaattatatctagattgtactaggattggaatgatcagtactaattgtgatgtttgtgctttatacctgttgtcaccaaaatggaactattaatttgctatgaataaagcttacaaattcatatgtgtc

SEQ ID NO: 4682 - DNA, 1753 bp, Zea mays
gggacaggtacgctgaatatgactggggattttcctatgggtattggagcgggtccaagcagattaaagaggatgagttgtcagagactgctatttattcgaattatttctggtatatttatcataaaaagggggaggtgcaagagactgattcggacttcttgcagagtggaacaatgcagtaccagacacgagatatatctttcaaagaagaaggcttttttcgaataagccaattgatttgggaccttcggatccattctttttcctattcaaagatcaggcctttgtctctgtgttttcacgtcgagaattctttgcagatgaagatgaagagatggcaaagcggcttagtaccagtacctggagaaaaaagcctcctaaacatatggctagcaactggttcaccaggagtacgcaagaaaggcaaaagcactacgaattattgatttaggaatgggaatgggctagaaccctgggctcttccttatataattaatggtcttttcattctaatactctatccgagagttctcagtatttagcaaagctgttcctatctaacggaaggctcctggatcaaatgacaaagacattgtttgtggagaaagaggtggcttttcccggatgaaatgaaacatttcatttgtgtaacaggagaaagatttcccactccttagccgtaaagatatgtggccatgaaaaagggaggggattcagtggaacaggattggccgggcggtagagtcgtggaaacacttgttgattcctattttggaccctagctccatgggaacaatatgctactgcggaaacatggaagaattgcaatcttagatcaaaacactatgtatgggatgatatgaactgcctaaataagaattcttgagcgtcgaataacctgagtactaactacatcaaacaatttgcattaatgaaactgtgtaaatccaccggataatcaaaaatacgcatgtctgatgaaatggttgttgctatctgtttccataacgaatccttggtttaactgaataagtaaagaaaatgggccctttctcttcgtctcagatcgatggatcttctcgattggaagatctcccatatggataatacacattccagttgaccgagcctaatgctaattgttttgttccgaagcaaagatatccgcggaggccggttcgttcgtcctattctgatattcaggaccaagaggtcctggattctctttcggataggccctgaaaggagaagagaagctgaaatgccaacggacctctgtctattctctaattcacccgatccgatagtacccgtttttggaacgtccagtgccaaagtcactgaatgggtaagtcaccaatccaatccctttgacaaatcgggtgtcatattagatatcatattctatatatatagaaatatcatagaatagacatatagaatttttggttgggaaattcgaatgaatcattgagtgaaaaaggagcaaagaatgacaaaagatgagactctactagtcttcactcttgtggtttcctcggtttctattttcttattcgggatcttgcttttcatggttctcatctctgcaactcgcgattttcgcgagagaaccaaatccaagttggtgaagatcatgatttgggctggcatagtagttattacctttgcaattgcggttcgaatctatccgatctttatcttttgctcaaagaaacgaatcaagctgattctcgatcgttcatattaa

SEQ ID NO: 4683 - DNA, 912 bp, Zea mays
ctattttggaccctagctccatggaacaatatgctactgcggaaacatggaagaattgcaatcttcgatcaaaacactatgtatgggatgatatgaactacctaaataagaattcttgagcgtcgaataacctgagtactaactacgtcaaacaatttgcattaatgaaactgtgtaaatccaccggataatcaaaaatacgcatgtctgatgaaatggttgttgctatctgtttccataacgaatccttggtttaactgaataagtaaagaaaatgggccctttctcttcgtctcagatcgatggatcttctcgattggaagatctcccatatggataatacacattccagttgaccgagcctaatgctaattgttttgttccgaagcaaagatatccgcggaggccggttcgttcgtcctattctgatattcaggaccaagaggtcctggattctctttcggataggccctgaaaggagaagagaagctgaaatgccaacggacctctgtctattctctaattcacccgatctgatagtacccgtttttggaacgtccagtgccaaagtcactgaatgggtaagtcaccaatccaatccctttgacaaatcgggtgtcatattagatatcatattctatatttatagaaatatcatagaatagacatatagaatttttggttgggaaattcgaatgaatcattgagtgaaaaaggagcaaagaatgacaaaagatgagactctactagtcttcactcttgtggtttcctcggtttctattttcttattcgggatcttgcttttcatggttctcatctctgcaactcgcgattttcgcgagagaaccaaatccaagttggtgaagatcatgatttgggctggcatagtagttattacctttgcaattgcgg

SEQ ID NO: 4684 - DNA, 431 bp, Zea mays
gtgaaaaaggagcaaagaatgacaaaagatgagactctactagtcttcactcttgtggtttcctcggtttctattttcttattcgggatcttgcttttcatggttctcatctctgcaactcgcgattttcgcgagagaaccaaatccaagttggtgaagatcatgatttgggctggcatagtagttattacctttgcaattgcggttcgaatctatccgatctttatctttttgctcaaagaacgaataaaaccccttgttgaagccctttatgataagcttccctagatctgggaagtttctctttcacggtattgggatcatttgatcgatttcctcgatcgctaattatgggcgtgcgctccctcggtgcctgacaggcaggcctcgcctatcggcgccaaccagcgcgccctctctccccctctctc

SEQ ID NO: 4685 - DNA, 781 bp, Secale cereale
aatttttggtcggcaaattcgaaggaatcattgagtgaaaaaggagcaaagaatgacaaaagacgagactctactagtcttcactcttgtggtttcctcttcctcggtttctgttttcttattcgggatcttgcttttcatggttctcatctctgcaactctcgattttcgcgagagaaccaaatccaagttggtgaagatcatgatttgggctggcacggtattgggatcgtttgatcgatttccttgatttgatcgctacttaatgggcgtgcgctcaaaggatacaaacagggattcgcaaacaaaaaggggaattcgtagtcactttttcctgtcgcgtaaaaaaaaagtctttacgcgagagcaatagaggttgggatacatctatctcttctgagcaacctcttttggattcttaagaccacccttgcagtaggataccatctgctttgggttctttattatctccttcgagggtattttaggattcgttcaggctatatatatttagtctatttggtctttactgtctactttctcagggagattgggttaaggacccttcagaagatagaggagagcgccaggcccagtattccggaatacttcgtacgggatgctcagttgaatgagcattcgcatgtatcgcttgagggactcacctccgcgtctcttacacgcacgtaagtctttggtctcgcgtgtctacctgttcactacgtcaacggctagtctagaagtgtaatcgtatcatagatatagatatactatacgttaa

SEQ ID NO: 4686 - DNA, 576 bp, Setaria italica
atgacaaaagatgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagttattacctttgcaattgcggttcgaatctccgatctttatctttttgctcaagaacgaataaaaccccttgttgaagccctttatgataagcttcctggatctgggaagatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagggtttttaggatcgttcaggctatatttagtctattttggcttttactgtctacttttctcagggagatggttaaggacctcagaagatagaggagagcgccaggcgcagatttccggaatacttctacggggaatgctcattcaatga

SEQ ID NO: 4687 - DNA, 1983 bp, Setaria italica
atggaggtggaagtggcggcgaaggtggcggcgggcttgtgctgcgtcggggcgatcaccctggcgctctacctctaccacgccctgtggctggcgcccgagcgggtgcgcgccgcgctgcgggagcagggcatcgccggcccgcgcccttccttcccctacggcaaccgcgccgagatgaggcaggccgcggccgacgccaagcaggcagcggcggcggcttctcagcgcggcagcatcgtgcatgactaccgtccggccttgttcccccactacgagaggtggaggaaggagtacggcccggtcttcacctactcgatcgggaacatggtgttcctgcacgcgagccgggcggacgtggtccgggacctcggcctctgcgtgtcgctggacctcggcaagagctcctacatgaaggtgacgcaccggccgctcttcggcgacggcatcctcaagtccagcggcgaggcctgggcctaccagcggcggctcatcgcgcccgagttcttccccgacaaggtcaggggcatggtggacctcatggtcggctcggcaacggcgctggtggagtcctgggaggacaggattattagtagggataacaatggaggcggcggcggcttggagctcaagatcgacgacgacatcagggcctactccgcggacgtgatctcgaggacgtgcttcgggagcagctacgtgaaagggaaggagatcttcgcgatgatcagggagctgcagaagacggtgtccaagcccaacctgctggccgagatgaccggcctgagctctctcccgacgagggccaaccgggcggcgtggaggctcaaccggcaggtgagcaggctggtactggacgtcgtgcgggagagcgggaacgacgacaggaacctcctgagcgcgatgctccgcagcgcggcgagctctggcggcagcgtggcggcggaggacttcatcgtggacaactgcaagaacatctacttcgccgggtacgagaccacggcggtgaccgccgcctggtgcctgatgctcctggcgctgcacccggagtggcagtgccgggtccgtgacgaggtgcggcacgcgtgcgccggcgccggcgccgcaccggacttcacgtctctgcagagaatgaagaagctgacgatggtgatccaggagacgctgcggctgtacccggccggctcggtgctgtcgcggcaggcgctccgcggcgtcaccctcggcggcgtgcgcgtgccggcgggcgtcaacatctacgtgccggtctcgacggtgcacctggacccggcgctgtggggcgccgacgcgcgggagttccacccggaccggttcgcgggcgcgcggccgccgccgccgccgcacgcgtacctgcccttcggcgccggcgcgcgcacctgcctcgggcagagcttcgcgatggccgagctcaaggtcctgctggcgctcgtgctctccaagttcgagctgagcctttcgccggcgtacgtgcactcgccggcgctcaggctcatcgtggagccggagcacggcgtgcggctcgtgctcaagagcgtcgtcgagccaaggtcatcgtgatgcgggacctcccctcccctgtgtggatgggctggacctcgtttcttccactttgggcctcattgacacggaaatttcggcccaattattaataattggcttggtgtctcattcagttgtaaatcgaatcaacgtggcacacgcacgaacacaagtcctttgctgcgatctgcgaacgaagctaggcacttccaagctgacggcagcatattcatggcgcaaatgacagcgacttgagctaaacaatcaaggatcactaccggaaacagtaactttgccgagtgccccaggcactcggcgaagagccaaatacactcggcaaagggtttgccgagtgtaacactcggcgaaccttactcggcaaagtttttctcggcaaacagcgtgtttgctgagtgtcgacca

SEQ ID NO: 4688 - DNA, 5894 bp, Zea mays
ccggatcaatgctgattgacgactgaataaatagccggaagcaacaactgcacgagagagaaagagcggatccaactaaggaaatgcagtacctgttctgtcggagctaatcatgcaaagctagcgtagcgccagccgtcgaagtgaatgaattcgaaagaacgaagaaataaggaaatgagacgactctttcttgaacaatttcataagcagatcttcccctccacaccaatcacgagtttttttttattcctctcgtatatcgtcgtcacgcccttaatgataggttttgaaaaagatttttcatgtcattcccatttaggttcgattcggatctctctgttgtttccctttcctcccgaaccttttcctcgaaatgataaagaatctggtacactcgaattgtattatttaagtgcttattgcttgccaaaaatcctacttctacaattggtaggtcaccgggttattcaaataagtcgtgttttctgtgcttttcccatgttacaacttccgtaccaattcgatcgatccggaatggatcggttaaacattctattagggagcccggtcttgactcttctgtgtggtattcattctcgttcggctcttggagtcacatccagcagtggttggaacagctcgcaaaatccaaccacttcacctactttattgcccccaaccgtttcccgtacctctatagaaacagaagggtttcatgttctttcatcgattgggtattcctctccttttgtatctctttatccaatttcggtctcgattagttcacaagattgaatggccaagtcatggaaaagccgttattcgattgttttaaaagaatgtgttgagccgggcccgggtatgtaagttcagcgatgtacaaacaaggattgatttgacttccgcacctagggttctattttttaagaataaggaagaggaatagaatctcattcatgtgttcatgctaacagaagagcggatccaatacacatacataaggcatcggttgttcttaacagcgatggctattcatttaagtcttcgggtagcaccaccagatcttcaacaaggtggaaattctcgtatagtataatataatagtagtagacggcagtagatcctacaacggtacttccgtggagatacgatcctacaacgactatttccttgcaaagcaattcaaacagtaccggtactcctaagccatgaaaccaatgctaagggaaagacttctgctcgctggatcaaagaaaaggtaatatcctcgggaaaggctaagcacattcgaagactggctttcgattcgtatcctctgagcaaggcctattccggggaaacaactaaaccctgggctgtttatgatgtgaggctgattcctattccacaaaatggtacggttgttgtattccgattagcggtgcccaggaaagaacgggtacttaacggctgctataaaccattatggaattctgtgttaccttcattcaatatcttatattaggtatagaatcgatcatagttcccccacgaccaagagaagtggcttatctattgaataatagatctcgtaaatcaaataggttatgacaagagagggttcctacactcgttctaatggaacgtggggatcaaagcaagagtcaaagtcacagatcaggatggacatagtaccaattctgttaagccacaaccaactatcttatcaacccaaagctgcaagaagagaagttaagttgttgaccaggttcaaatagcccagtttcaaatagtgccgtattgaatgcgcaaagtgctgctcagcctagcctaatagaggagaggatggatccgacctctagctctttacttttactgcctgtgcagctaaggaaagacaactacacttccaagtcctaagagaatactagtatacgatctgttatataaataggtaaatgttcctttccattatgaatcgcgattgtatggccaaccattgcgggtagaatgctagatgcccgggaccacgttactattatttatttctttctcctccttcatattgaccttttctatttttgccaataaatgacgagctacaaaaggattcgttttttttgctgattactcctttttttcattttaaagagtggcatcctatgtccactatctcgatcgaggtatggaggtcagaataaatagaataataatgaatggaaaaaagagaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttaccttacggcgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactacggggcgtttacctagccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagattcttcttttttctcaaaaaaccccttcccaaactgtacaagcttcttccaaagcatacggctttctagatgtatatgacgatctctagacagatggatcttatatgaatcgtatgatgaagtaccacatgagtggatatatagaaaaggaatccaaatccgccgaatcgctcatgttatgatcttctacatcctaggtctccgcgttccgtcatctggcttatgttcttcatgtagcattcagatcgaatgactctatgaaattacgtcgatacttccacatattatgggtaacgtaggagacatccctattttcacccgggggtcttaattaccactgcttagcttcgcctctgaccataaaatgaaatgtgaataacccgtcctcctctctttgaaacaaggggcgcttccggttctgtgcgtgcttcaaacaattttgtcttctccatatctctagagtcaagaattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaaccctctgggatgtaaaatatatctctgctcaccatccccccagaaatagtgtatgagacaaatgtatgcatttcgattagggtcgtattctatggttacgattctactctaccagatatgtctttttgattccgtcgaaaatagattttacggtataggcgcgcctccccctctatgccttgcggtaatgattcctctggcattacgacctttaccacaacggtgccgtccatggatcaatttatttcgtggattggatttcacttgcctgtctacggttcccttgcgtgtgctcgggataggtgttttgtataaatgtttcgccgtattattaagtattctccttgagttcgtttctctatctagaagtggaatagaataacccggttgaagggtaatgatcatacgtctgtaatgcattgtatgtcccagaataggtcccattcttctaccctttccgggtagtcgatggctattcacagctactaccttaacaccaaagaagagttcgacccaatgcttgatttctgtcttagtgaatcccgattcgacattaaaagtatattgattctttcccaataaacgaagactcttttctgtaaatactgcgtatttgattccattatcgtacgataatactatatttttatttatatttgtttattgtattatacctttctatattctagatatatagaatagaagaatctcgatttgtcaagtctcatgatcgtatcaagatctatttcaattcggctcagtcttttttttttagaaaagattgagccgaattgaattgcaatcaattagaggaataaagaagaattactgcatttcttaacttattttttctctttctattttgcttcttttttattttatatggtatccatcgctttgaaaccatcaaattggatctccttccatatttcacaagctgcggctagttcagcactccatttgcaagctgctttgataatttcattaccttcacgagcaagatcgcgcccttcgttacgagcttgtacacaggcttctaaagccacacgattagctgctgcaccaggtgcatttccccaaggatgtcctaaagttcctccaccaaattgtaatacggaatcatctccaaagatttcggtcagagctggcatatgccaaacatgaatacccccagaagccaccggtataacacctggcatggatacccagtcctgagtgaaaaagataccgcgataacgatctttttcaataaaatcatcgcgcaataaatcaacaaaacctaaagttatttcgcgttccccttctaacttacctactactgtaccggagtggatatgatctccccccgacatacgcaatgctttagctaatacacggaaatgcataccatgatttttctgtctatcaataactgcatgcattgctcggtgaatgtgaagaagtaggccgttgtcgcggcaataatgagacaaagtagtatttgcgacctcctgttaagtagtcatgcattacaataggaacccctaattcccttgcaaatacagctctcttaatcatttattcgcatgtacctgcagtcgcattcaagtaatgccccttgatttcaccggtttcggcttgtgctttataaattgcttcggcacaaaagacaaaacggtctctccagcgcataaatggttgtgagtttacgttttcatcatctttggtaaaatcaagtccaccgcgtagacactcataacacgctctaccgtaattttttgcggataatccgtttaatagtacatcccaataaaggacgaccgtacttgttcaacttatccctttcaacttggataccgtgaggcggaccttggaaagtttttgaataagcagggggaattcgtagatcctccaaacgtagagcgcgtaaggctttgaaaccaaatacgttacccacaatggaagtaaacatgttagtaacagaaccctcttcaaataggtctaatggataagctacataacagatatattgatctgggtccccaggaacgggctcgatgtgatagcatcgtcctttgtaacgatcaagactggtaagtccatcagtccaaacagttgtccatgtaccagtagaagattccgcagctactgcagctcctgcttcttcaggcgcccgagctgaggagttactcggaatgcttgctgccaagatatcagtatccttggtttcgtactccggggtgtagtaagtcaatttataatccttaacaccagctttaaatccaacacttgctttagtttctgtttgtggtgacataagtccctccctacaactcatgaattaagaattctcacaacgacagggtctactcgatatggattaggcgtaaatgaaacctttgca

SEQ ID NO: 4689 - DNA, 9065 bp, Zea mays
atccggagaggtgttttcatagtcatctccgaatatttgccatctctgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaacgggaacggtctattggaattagctctctatccatggaatctcatccatcattcatacataacgaattggtatggtatattcataccataacataagaacaataagaactcgaattcttatcgatactggaactcagagcatagggggggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctatgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagttaagcagtggtaattaagacccccgggtgaaaatagggatgtctcctacgttacccataatatgtggaagtatcgacgtaatttcatagagtcattcgatctgaatgctacatgaagaacataagccagatgacggaacgcggagacctaggatgtagaagatcataacatgagcgattcggcggatttggattccttttctatatatccactcatgtggtacttcatcatacgattcatataagatccatctgtctagagatcgtcatatacatctagaaagccgtatgctttggaagaagcttgtacagtttgggaaggggttttttgagaaaaaagaagaatctacttcaaccgatatgcccttaggcacggccatacataacatagaaatcacacatggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcattattattctatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaaatttataggattcaaataatcaaataaagtaaaggtaggcgggtaataaccttatttatgacaagtttcaaattggtaaagtatacccctaggataaagaagaagaaggggctgagaaaactcgcaagaaaagttccaaccgatcgtctacttaaattcgaacgggttttcaaagcacaaaaacgcatacatatgtctgttttcaaagcacaaagagttctagatgagattcgctggcgttactacgaggaaaccgttatgatactgaatctcatgccttatcgagcatcgtatcccatcttaaagttggtttattcggcagcagcaaatgctactcattatagggatttcgacaaaacgaatttattcatcactaaagccgaagtcagtaggagtactattatgaaaaaattcagacctcgagctcgaggacgtagttattctataaaaaaaacgatgtgtaatataacaattgtactaaatatagtaaagaaatcaaaataatctttagatcaatctaagatttcgattcccagtaaaaaaaaaagaaatataatagaaaaatatgggacaaaaaataaatccactcggtttcagacttggtacaacccaaaatcaccattccttttggttcgcacaaccaaaaaattattctgaaggtctacaggaagataaaaaaatacggaattgtatcaagaactatatacaaaagaataggaaaaaaggctcgaatagaaaaatggaatcagactcaagttctgaagtaattacacatatagaaattcaaaaagaaatcgatacaatccacgtcataatccatattggattccccaacttattaaagaaaaagggagcaatcgaagaattagagaaagatctccaaaaggaagttaattctgtaaaccagagacttaatattgctatcgaaaaggttaaagaaccttatagacaacctaatattcttgcggaatatatagctttccaattaaaaaatagagtttcattccgaaaagcaatgaaaaaagctattgaattaactaaaaaagcggatataaagggaataaaaatccaaattgcgggtcgtctagcaggaaaagaaattgcacgtgccgaatgcatcaaaaaggggtagactacccctccaaacaattcgcgctaaaattgattattgctgctatccaattcgaactatctatggagtattaggtgtcaaaatttggatattcgtagaagaagaataactaaccatgtcttcccattccgcccagtgatagaataaaaaagacaagaaccttgtttttccaaaaatccctaaaaaaaagaagaaagtatccctctttctatatgatttaatgaaaattaagaaatcttttaatataattgctatgcttagtgtgtgactcgttagttttttctttagggtcaaaaatggaaaaaaacttagtaatgatagaaaattaactaataaccaacctattgcttcgtattgtcgagatcctaactaagaaacagtcactatgtgaataaatacatctatcaaaaatgagtagatctatcatatagttgtagcaactgcatttttttctctacaaaagaaacctgattctaggctgtgaagcaaaactaaagggatgtggataaaaggagggatgatagatagaaggaagaagaataagaaagatataggattcccatatgtatggtctatgaattacatcataaaaaaaaaggcaatgtgataaagcatcaatataataaaattctcaaaaaaaagagagaattcgaaatcgtaacttgacttttgaaacaacaaataaaaatataaagcaataaataaagagcagccgggttaataaaactgagaaaattgactcggaaaaaaaaattggaagctccattgcaggattcaaacctaaccattaaaggagaagctgtgggaacgacaaaacctatgactacataggattttattgaaaagaatcctaacacttcattgggtgggatggcggaacaaaccaaaaaaattgctttatttgataaggttctaaattaacaaataagacaggaaagagtaaatattcgcccgcgaaatccttattggattagaatactttaccacgattcaataagaataaaaaaaaggagattccaaaaaaggaaggattacattttatataaatattgaatttggatatattctagatcttctttcttgactatatatttatttttcttttttaagtttaagaaagtcaaaatcaaaaaaacctaactttttctattatatattgatgtgtatctatctataatatttttgaatattatggaattagagaaatgacattcgcacgctttctcatttcattcgcgaggagctggatgagaagaaactctcatgtccagttttgtagtagagatggaactaagaaagaaccatcgactataaccccaaaagaactagatttcgtaaacaacatagaggaagaatgaagggaaaatcctgccgaggcaatcatatttgttttggtagatatgctcttcaagtacttgaacccgcttggatcaccgcgagacagatagaagcaggacgaagagcaatgacacgatatgcacgtcgtggtggaaaaatatgggtgcgtatatttcccgacaaaccggttacaataagacccacagaaacacgtatgggctcgggaaagggatcccccgaatattgggtagccgttgttaaaccaggtcgaatactttatgaaatgagcggagtatccgaaactgtagctagagcagctatctctatagctgccagtaaaatgcccatacgaagtcaatttcttcgattagagatatagaaccccaaaaaggaatattgaagataaaaaacccctggtttttctttctggaaagacaatatttctttcatccttttgcattgaaataacaaatggaaatccaaataatatgattcaacctcagacccttttaaatgtagcagataacagtggagctcgaaaattgatgtgtattcgagtcataggagccgctggtaatcagcgatatgctcgtattggtgatgttattattgctgtaatcaaagacgcagtgccccaaatgcctctagaaagatccgaagtaattcgagctgtaattgtacgtacacgtaaagaattcaaaggcgacgacggtataataatacgctatgatgacaatgcagcagttatcattgatcaaaaaggaaatccaaaaggaactcgagtttttggcgcggttgccgaagaattaagagaattgaatttgactaaaatagtttcattagctcctgaagtattataaatactagtagacgagatatagatcaaagaaaaaattagtagattttgtctcacgtatatgcttaaaaatcctaaatttaaagaaaagggaaaacatgttgattatagaaaaattaggaggaacctagaattagagtcttatgggcaaggacactattgctgatttactaacctctataagaaacgcagacatgaataaaaaaggaactgttcgagtagtatccacaaatattaccgaaaacattgttaaaatacttctacgagagggttttattgaaagtgttcggaaacatcaggaaagtaacagatatttcttggttttaactttgcgacatcaaaggagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagttttatgttatatatggtaatggccccacctatagtacccaaattctatctcgaacttcctattttgaaaataaaaatagaaaaataggagaaaaatatatgacagaaaaaaaatagtagagaaaaaaaacccgagagaagcaaaagtcactttcgaaggtttagttacggaagccctacccaacggaatgttccgtgttcgcctagagaatgacacgatcatcctgggctatatttcaggaaagatccggtctagttctatacgaatactgatgggggatagggtcaaaattgaaataagtcgttatgattccagcaaaggtcgtataatttatagacttccccataaggattcgaagcgtaccgaagactcgaaggatactgaagatttgaaggataccaaagattcaaaggattaggtttttctggggtaataacttccaagtttcaaaatttaagtgaagagacttattttttccaaaagaatagattcatagtttaagaaaggaatacccatatatgaaaataagagcttccgttcgtaaaatttgtacaaaatgtcgactgattcgcaggcgtgggcgaattagagtcatttgttccaatccgaagcataaacaaagacaggggtaatctttcgaaaaagaagcttttctttctaatagcttttctttctaattaaagtaaaaagtacccacggaaatgcccaaattgcaaataaaaaaatgaaagtaaaggatatattttaacctgaaacggatatctttgtatcttttttctttttgttatttctaactcatatttatgagataataaaatatgacaaaagctataccaaaaataggttcacgtaagaaagtgcgtattggtttgcgtaggaatgcccgttttagtttacggaagagtgcacgtagaataacaaaagggattattcatgttcaagctagtttcaacaataccattataaccgttacagacccacaaggtcgggtcgttttctggtcctccgcaggtacttgtggattcaaaagctcaagaaaagcatcaccctatgctggtcaaagaacagcagtagatgctattcgtacagtgggtttgcaacgagcagaagttatggtaaaaggtgctggtagcggaagagatgccgcattacgagccattgctaaaagtggtgtacggttaagttatatacgcgatgtaacacctatgccgcataatggatgtcgacctcctaaaaaaagacgtctgtaaaaaaaatgaaaccgctttcaagagaaataaacgattcaatgatcaaataatactagtctgttatggttcgagaagagataacaggatccactcaaacactagagtggaagtgtgttgaatcaagagtagatagtaaacgtctttattatggtcgtttcattctgtctccgcttagaaaaggtcaagcggatactgtcggtattgccttgcgaagagctttacttggagaaatagaaggaacatgtatcacacgcgccaaatttgggaacgtgccacatgaatattccacaatagtaggtattgaagaatccatacaagaaattttactaaatttgaaagaaattgtattgagaagtaatctctatggagttatagacgcatcaatttgcgtcaaaggtcctagatacataaccgctcaagatataatcttaccgccttccgtagaaatcgttgatacgacacaacctatagctaacttgagagaacccgttgatttctgtattgagttacagatcaagagagatcgcgcatatcatacggaactcagaaagaactctcaagatggaagttatcctatagatgctgtattcatgcctgttcgaaatgtgaattatagtattttttcttgtgggaatggaaatgaaaaacacgagatactttttttagaatatggacaaatggaagtttaactcctaaagaagcgctttatgaagcttctcgtaatttgattgatttatttcttccttttctacacacagaggaagagggcactagtttcgaagaaaataaaaacaggttaactccaccccttttaacctttcaaaaaagattcactaatctaaagaaaaacaaaaaaggaattccattgaattgtatttttattgatcaattagaattgccttctagaacgtataattgtctcaaaagggccaatatacatacactattggaccttttgagtaagactgaagaagatcttatgcaaattaatagtttttgtatggaagatggaaaactgatatgggacactctagagaagcatctcccaattgatttacctaagaacaagttctcgctttaaatcattgcaattttttcctcttcttcttttttgagttagaataaaaagaaaaaagaaagcaatttggcatctttggcataatctatattttcacgaaatggatcataataaaatagattttaggtatctgtgaacca

SEQ ID NO: 4690 - DNA, 2410 bp, Zea mays
cgaacggacccttataaacttagtttccgtctgggtatgcgcccttggattgctgttgcatattcagctcctgttgcagctgctactgctgttttcttgatttaccctattggtcaaggaagtttctctgatggtatgcctttaggaatatctggtactttcaactttatgattgtattccaggcagagcacaacatccttatgcatccatttcacatgttaggtgtagctggtgtattcggcggttccctattcagtgctatgcatggttccttggtaacctctagtttgatcagggaaaccactgaaaatgagtctgctaatgagggttacaaatttggtcaggaagaagagacttataatattgtggctgctcacggttattttggtcgattaatcttccaatatgctagtttcaacaattctcgttctttacacttcttcttggctgcttggcctgtagtagggatctggttcactgctttaggtattagtactatggcattcaacctaaatggtttcaatttcaaccaatctgtagttgatagccaaggtcgcgttattaatacttgggctgatatcatcaactgtgctaatcttggtatggaggtaatgcacgaacgtaatgctcacaacttccctctagacctagctgctcttgaagttccttaccttaatggataaggtttttctcctaaacatataggaatttttgaaggaaggaaagccagaaatacccaatatcttgttccaacaggatattgggtatttctttgtttattctgaatctttctattctgaattcaattaacgacgagatttagtatcctttcttgtactttcataactcgtgaaatgccgagtaggcacgaattcccccaatttgcgacctaccataggatttgttatgtaaataggtatatgttcttttccattatgaatcgcgattgtatggccaaccattgcgggtagaatgctagatgcccgggaccacgttactattatttctttctcctccttcatattgaccttttcgatttttgccaataaatgacgagctacaaaaggattcgttttttttcgtgtcacagctgattactcctttttttcattttaaagagtggcatcctatgtccactatctcgatcgaggtatggaggtcagaataaatagaataataatgaatggaaaaaagagaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactacggggcgtttacctagccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagattcttcttttttctcaaaaaaccccttcccaaactgtacaagcttcttccaaagcatacgactttctagatgtatatgacgatctctagacagatggatcttatatgaatcgtatgatgaagtaccacatgagtggatatatagaaaaggaatccaaatccgccgaatcgctcatgttatgatcttctacatcctaggtctccgcgttccgtcatctggcttatgttcttcatgtagcattcagatcgaatgactctatgaaattacgtcgatacttccacatattatgggtaacgtaggagacatccctattttcacccgggggtcttaattaccactgcttaactttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaagggattggagccccg

SEQ ID NO: 4691 - DNA, 5059 bp, Zea mays
cccaatttgcgacctaccataggatttgttatgtaaataggtatatgttcttttccattatgaatcgcgattgtatggccaaccattgcgggtagaatgctagatgcccgggaccacgttactattatttctttctcctccttcatattgaccttttcgatttttgccaataaatgacgagctacaaaaggattcgttttttttcgtgtcacagctgattactcctttttttcattttaaagagtggcatcctatgtccactatctcgatcgaggtatggaggtcagaataaatagaataataatgaatggaaaaaagagaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactacggggcgtttacctagccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagattcttcttttttctcaaaaaaccccttcccaaactgtacaagcttcttccaaagcatacggctttctagatgtatatgacgatctctagacagatggatcttatatgaatcgtatgatgaagtaccacatgagtggatatatagaaaaggaatccaaatccgccgaatcgctcatgttatgatcttctacatcctaggtctccgcgttccgtcatctggcttatgttcttcatgtagcattcagatcgaatgactctatgaaattacgtcgatacttccacatattatgggtaacgtaggagacatccctattttcacccgggggtcttaattaccactgcttaactttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatctcttctcaccatccccatagtgtatgagacaaatgtatgcatttcgattagggtcgtattctatggttatgattctaccagatatgtctttttgattccgtcgaaaatcgattttacggtataggcgcttatgacctccccctctatgccttgcggtaatgattcctctggcattacgacctttaccacaacggtgccgtccatggatcaatttatttcgtggattggatttcacttgcctgtctacggttcccttgcgtgtgctcgggataggtgttttgtataaatgtttcgccgtattattaagtattctcctttagttcgtttctctatctagaagtggaatagaataacccggttgaagggtaatgatcatacgtctgtaatgcattgtatgtcccagaataggtcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagactcttttctgtaaatactgcgtatttgattccatccataaatcgactttcccccctatgctctgagttccagtatcgataagaattcgagttcttattgttcttatgttatggtatgaatataccataccaattcgttatgtatggatgatggatgagattccatggatagagagccaattccaatagaccgttcccgttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctccggatcctcgaattgaaagagagactgagagggatcaagaatcaagaatcctaattctcgctatttggaatggatccaattctattgagtctgacccatagtgatcatttctctttagcaaagaatgaccttggttatcaaaggattgaacaaccgagatccatttacttatgatacctagttgacattgctaacaaggatctaatgaattatgagtttaatagattctctttagcagaaagacgtatattccttgctcattatcagacaatcacttattcccaaacctcgtgtggggctaatcgttttcatttaccatctcatggaaaacccttttcgttccgcttagccctatcgggtattttagtgataggttctataggaactggacaatcctatttggtcaaatacctaacgaaaaattcctattttcctttcattaaggtacgagggcttcttattccacaagaacgaaagcaccttttcattctttcatatactaggggtttttacttggaaaagacaatgttccatactaaaggattcgggtccataaccacgagttccagtgcactagatcttgtagcacttagcaacgaggccctatccattagtattccacataagaaatccattatagaaactaatacaattagattagctcttcatagacaaacttggggtttgcgagccaagataagaccggctcgggatcatgggacccttttctatcagataggaggggatcttgtacaaaatagacttctaagtaataaccccatagatcctatatctatctatataaagaggcaatcgtgtcaggaagcggctttttctttggccaaacggtacttcgaacttggaacgagcatgaagagattaacgagacttctttctcttttgagtttttctggcggaccggtcgcgcaagatctttggtcttcccccggaaccgatgaaaaagtgggtcgcttcttatggactcgctcagaatgattcttctctatctatagttcatggcctattagaagtagaaggtgctctggtgcaatccttaccgacagaaaaagattgcagtcgggttgataataatcgagtgccattacttcgtcggtccgaaccaaggaatccgttagaaatgttttgaaatggatattgttctctctttgattagggatgctatatgaaaagaagtggagtttgaaaaagggaacggaatggtcaaaaccgggaactgctagaggaacgaattttcaatagcataacttgggctcctagaatatggggcccttggggacaatctatttgattgcagggacaggtacgctgaaatatgactggggattttcctatgggtattggagcgggtccaagcagattaaagaggatgagtagtcagagactgctatttattcgaattatttctggtatatttatcataaaaagggggaggtgcaagagactgattcggacttcttgcagagtggaacaatgcagtaccagacacgagatatatctttcaaagaagaaggcttttttcgaataagccaattgatttgggaccttcggatccattctttttcctattcaaagatcaggccctttgtctctgtgttttcacgtcgtgaattctttgcagatgaagatgaagagatggcaaagcggctttagtaccagtacctggagaaaaaagcctcctaaacatatggctagcaactggttcaccaggagtacgcaagaaaggcaaaagcactacgaattattgatttaggaatgggaatgggctagaaccctgggctcttcccttatataattaatggtcttttcattctaatactctatccgagagttctcagtatttagcaaagctgttcctatctaacggaaggctcctggatcaaatgacaaagacattgtttgtggagagagaggtggcttttcccggatgaaatgaaacatttcatttgtgtaacgggagaaagatttcccactccttagccgtaaagatatgtggccatgaaaaagggaggggattcagtggaacaggattggccgggcggtagagtcgtggaaacacttgttgattcctattttggaccctagctccatggaacaatatgctactgcggaaacatggaagaattgcaatcttagatcaaaacactatgtatgggatgatatgaactgcctaaataagaaattcttgagcgtcgaataacctgagtactaactacatcaaacaatttgcattaatgaaactgtgtaaatccaccggataatcaaaaatacgcatgtctgatgaaatggttgttgctatctgtttccataacgaatccttggtttaactgaataagtaaagaaaatgggccctttctcttcgtctcagatcgatggatcttctcgattggaagatctcccatatggataatacacattcc

SEQ ID NO: 4692 - DNA, 12786 bp, Setaria italica
tatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaacgggaacgttccataagtctattggaactggctctctatctatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaagagtcttcgtttattgggaaagaatcaatatacttctaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaacacctatcccgagcacacgcaagggaaccgtagacaggcaagtgaaatccaatccacgaaataaattgatccatggacggcaccgttgtggtaaaggtcgtaatgccagaggaatcattaccgtaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggtgaaaatagggatgtctcctacgttacccataatatgtggaagtatcgacgtaatttcatagagtcattcgatctgaatgctacatgaagaacataagccagatgacggaacgcggagacctaggatgtagaagatcataacatgagcgattcggcagatttggattccttttctatatatccactcatgtggtacttcatcatacgattcatataagatccatctgtctagagatcgtcatatacatctagaaagccgtatgctttggaagaagcttgtacagtttgggaaggggttttttgagaaaaaagaagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcatcattattctatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggttaatatgaaggaggagaaagaaatatagtaacgtggtcccgggcatctagcattctacccgcaatggttggccatacaatcgcgattcataatggaaaggaacatatacctatttacataacaaatcctatggtaggtcgcaaattgggggaattcgtgcctactcggcatttcacgagttatgaaagtgcaagaaaagatactaaatctcgtcgttaactgaattcagaatagaaagattcagaataaacaaagaaataattggattcaaataaagtaagatagacgggtaataaccttatttatgacaagtttcaaattggtaaagtatacccctaggataaagaagaagaagaacgagctaaggaaactcgcaagaaaagttccaactgatcgtctacttaaattcgaacgggttttcaaagcacaaaaacgcatacatatgtctgttttcaaagcacaaagagttcttgatgagattcgctggcgttactacgaggaaaccgttatgatactgaacctcatgccttatcgagcgtcttatcccatcttaaagttggtttattcggcagcagcaaatgctactcattatagggatttcgacaaagcgaatttattcatcactaaagccgaagtcagtaggggtactattatgaaaaaattcagacctcgagctcgaggacgtagttattctataaaaaaaaccatgtgtcatataacaattgtactaaatatagtaaagaaatctaaataatctttagatcaatccaagatttcgattcccaataaaaaaagaaatagaatagaaaatatgggacaaaaaataaatccactcggtttcagacttggtacaacccaaaatcaccattccttttggttcgcacaaccaaaaaattattctgaaggtctacaggaagataaaaaaatacggaattgtatcaagaactatatacaacagaataggaaaaaaggctcgaatagaaaatagaatcagactcaagttctgaagtaattacacatatagaaattcaaaaagaaattgatacaatccacgtcataatccatattggattccccaatttattaaagaaaaagggagcaatcgaagaattagagaaagatctccaaaaggaagttaattctgtaaaccagagacttaatattgctatcgaaaaggttaaagaaccttatagacaacctaatattcttgcagaatatatagctttccaattaaaaaatagagtttcattccgaaaagcaatgaaaaaagccattgaattaactaaaaaagcagacataaagggagtaaaaatcaaaattgcgggtcgtctagcaggaaagaaattgcacgtgccgaatgcatcaaaaagggcagactgcccctacaaacaattcgcgctaaaattgattattgctgctatccaattcgaactatctatggagtattaggtgtaaaaatttggatattcgtagaagaagaataactaacccagtcttcccattctgctcgttgatagaataagacaagaacttctttttcccaaaatccctaaaaaaagaagaaattatatctctttctataagatttaatgaaaattgataaatcttttaatataattgctatgcttagtgtgtgactcgttagttttttctttagggtcaaaaatgaggatttataaaaaaaaattggctgaaccctactaaaaatagaaaaaaacttagtaattctagaaaattaactaataaccaacctattgcttcgtatgtcgagatcctaactaagaaccagtcactatgtgaataaatacatctataaaaatgagtagatctatcatatagttgtagcaactgcatttttttctctacaaaagaaacctgattttaggctgtgaagcaaaactaaagggatgtggataaaaggagggatgatagatagaaggaagaagaataagaaagatataggattccaatgtgtatggtctatgaattacatcataaaaaaaaagcaatgtgataaagcatcaatataataaaataataaaaaaaagagagaattcgaaatcgtaacttttgaaataacaaatcaaaatttaaagaaataaaaaagagcagcccgcgttaataaaactgagaaaattgactcggaagacattttttggaagctccattgcaggattcaaacctaaccattaaaggagaagcagtgggaacgagaaaacctatgacggcatcggattttattgaaaagaatcctaacacttcattgggtgggatggcggaacaaaccaaaaaagtggctttattgataagattctaaattaacaaataagacaggaaagagtaaatattcgcccgcgaaatccttattggattagaatactttaccacgattcaataagaataaaaataaggagattccaaaatattatggaattagagaaattcgcacgctttctcatttaattcgcgaggagctggatgagaagaaactctcatgtccagttttgcagtagagatggaactaagaaagaaccgtcgactataaccccaaaagaactagatttcgtaaacaacatagaggaagaatgaagggaaaatcctgccgaggcaatcgtatttgttttggtagatatgctcttcaagtacttgaacccgcttggatcaccgcaagacagatagaagcaggacgaagagcaatgacacgatatgcacgtcgtggtggaaaaatatgggtgcgtatatttcccgacaaaccggttacaatgagacccacagaaacacgtatgggctcaggaaagggatcccccgaatattgggtagccgttgttaaaccaggtagaatactttatgaaatgagcggagtatccgaaactgtagctagagcagctatctctatagctgccagtaaaatgcccatacgaagtcaatttcttcgattagagatatagaaccccaaaaaggagtatttaagataaaaaaccccaggtttttctttctagaaagacaatatttctttcatccttttgcattgaaataacaaattgaaatcaaaataatatgattcaacctcagacccttttaaatgtagcagataacagtggagctagaaaattgatgtgtattcgagtcataggagccgctggtaatcagcgatatgctcgtattggtgatgttattgttgctgtaatcaaagacgcagtgccccaaatgcctctagaaagatccgaagtaattcgagctgtaattgtacgtacatgtaaagaattcaaatgcgaagatggtataataatacgctatgatgacaatgcagcagttatcattgatcaaaaaggaaatccaaaaggaactcgagtttttggcgcgattgccgaagaattgagagaattgaattttactaaaatagtttcattagctcctgaagtattataaacactagtagacgagatatagatcaaagaaaaaattagtagattgtgtctcacgtatatgctttaaaatctaaaattaaaagaaaaaggaaaacatgttgattatagaaaaattaggaggaacctagaattagagtcttatgggcaaggacactattgctgatttactaacctctataagaaacgcagacatgaataaaaaaggaactgttcgagtagtatccacaaatattaccgaaaacattgttaaaatacttctacgagagggttttattgaaagtgttcggaaacatcaggaaagtaacagatatttcttggtttcaacttgcgacatcaaaagagaaagactagaaagggaatatatagaactagaacctctttaaagcgtatcagccgacctggcttacgaatttatgtcaactatcaaggaattcctaaggttttgggcggaatgggaattgctattctttctacctctcgaggtataatgacagatcgagaagctcgactaaacagaattgggggagaagtcttatgttatatatggtaatggccccacctatagtacccgaattctatctcgaacttcctattttgaaaataaaaattgaaaaataggagaaaaaaaaatatgacagaaaaaaaaaaaccgagagaagcaaaagtcactttcgaaggtttagttacggaagccctacccaacggaatgttccgcgttcgcctagagaatgacaccatcatcctgggctatatttcaggaaagatccggtctagctctatacgaatactgatgggggatagggtcaaaattgaagtaagtcgttatgactccagcaaggggcgtataatttatagacttccccataaggattcgaagcgtaccgaagactcgaaggatactgaagatttgaaggataccaaagattcaaaggattaggtttttctagggtaataacttccaagtttcaaaatttaagtgaagagactcattttttccaaaagaatagattcatagtttaagaaaggaatacctatatatgaaaatagagcttccgttcgtaaaatttgtacaaaatgtcgactgattcgcaggcgtggacgaattagagtcatttgttccaatccgaagcataaacaaagacaggggtaatctttcgaaaaaggagcttttctttctaaaaagtaaaaaaaagtacctacggaaatgtccaaattccaaataaaaaaatgagagtaaaggatatattttacctgaaacggatatctttgtatctttttttctttttgttatttctaactcatatttatgagataataaaatatgacaaaagctataccaaaaataggttcacgtaagaaagtgcgtattggtttgcgtaggaatgcccgttttagtttacggaagagtgcacgtagaataacaaaaggggttattcatgttcaagccagtttcaacaataccattataaccgttacagacccacaaggtcgggtggttttctggtcctctgcaggtacttgtggattcaaaagctcacgaaaagcatcaccctatgctggtcaaagaacagcagtagatgctattcgtacagtgggtttgcaacgagcagaagttatggtaaaaggtgctggtagcggaagagacgccgcattacgagccattgctaaagtggtgtacggttaagttgtatacgcgatgtaacacctatgccgcataatggatgtcgacctcctaaaaaaagacgtctgtaaaagaattaaaccgctttcaagagaaataaacgattcaatgatcaaataataatactagtccgttatggttcgagaggaggtaacaggatccacccaaacactagagtggaagtgtgttgaatcaagagtagatagtaagcgtctttattatggtcgtttcattctgtccccgcttagaaaaggtcaagcggatactgtcggtattgccttgcgaagagctttacttggagaatagaaggaacgtgtatcacacgcgccaaatttgggaatgtgccacacgaatattctacaatagtaggtattgaagaatccatacaagaaattttactaaattgaaagaaattgtattgagaagtaatctctatggagttagagacgcatcaattgcgtcaaaggtcctagatacataaccgctcaagatataatcttaccgccttccgtagaaatcgttgatacgacacaacctatagctaacttgagagagccgattgatttctatattgagttacagatcaagagagatcgcggatatcatacggaactcagaaagaactctcaagatggaagttatcctatagatgctgtatccatgcctgttcgaaatgtgaattatagtattttttcttgtgggaatggaaatgaaaaacatgagatactttttctagaaatatggacgaatggaagtttaactcctaaagaagcgctttatgaagcttctcgtaatttgattgatttatttcttccttttctacacgcagaggaagagggcactagtttcgaagaaaataaaacagatttactccaccccttttaacctttcaaaaaagattcactaatctaaagaaaaacaaaaaaggaattccattgaattgtatttttattgatcaattagaattgccttctagaacgtataattgtctcaaaagggccaatatacatacactattggaccttttgagtaagactgaagaggatcttatgcgaattgaaagttttcgtatggaagatggaaaacttatatgggacactctcgagaagcatctcccaattgatttacttaagaacaagttctcgctttaaatccattgcaattttttcctctttttctttttttttgaattagaataaaaagaaaaaaaagcaattttgcatctttggcacaatctatattttcgcgaaatggatcataataaaatggattttaggtatctagggaagattcacttggaagtaactatttcctagatacccatgcaggggcttcgcggttgaatgaatcaactcgaaaaatccctaaaaaagacctaaagttaaggatttatcaatgggtaatgttgctccaatacctaaccaaagagctactgcagtaccgagtaaaaaaacggtcgtagctactggcgacgaaatggattttggaatttattgacattctctagaaagggtactgtcaataagcccgttggcacagaaaccattaagagaacgcccaataacttattgggtactgtacggagtattgaaatacgggaaagaagtaccactcgggtaatatttccagaggagttgcaaacggatccgccggttcaccaatcattgacggctcgagaaccgctaaacctacattacacgcaatagtacctagaattactactggaaaaatgtataaagatcgttgggccacgcgggttccccgtaataattatgtcccatccctttagctaattttgctcttaatacaggatcatttaagtcaggtttctttgttattgggataggtgaattctttaggatccatcccccaaaggaaccggacatgagaatttttcatcatccggctcgagcaagaatgaaagaaataagaccgtggagaatccacaatagaatagggtatataatgactcaatgactcaaggcaagaaaagctttatcagattatcttttccgaagttgcgcctatactactcattgaaaagaatcctattcttatgcgtaaatgctcatatccaagtgggcttacaaatttgatcatgatcaattgctttgtggattgtctcttgattagttggtgtttatcccctcaatatcgcaagtttcttacatccaaacaaagtatttacttgttactaataaaaaatcaaaaagtttagcctacgttcttccttagatcccttcttttactccgatagtattgcggatcgaaatcgatgcaaagaaaatgaatgcatttccatactataataaaaagtatgtgtaataaatatagaattggatcatatcacatgacttattccatttatactctatgggatcttacggagcctgctcatggatgacatggttggggtatgatcatagaaaatattctcctcgagtgaaccagcctatccttcctagataggggacttacgtgttgattggatgcggagacacctttggtcgtgaattctaatgtggcagatccaattctctatctgcatggccaaattaataattcaagtcacacactcccataatccgccttattttctttcgtaaaattaacttcaactataactatttgtatcaaatagttcgaagttgaagagaagtatccaaatgacatgtcttattgtaaaatagatatgtttgtagcaatgaaataccacaacctaccctatatgatatatgagaattagaattctctatgatatgctttccctataaaggacccgaaataccttgcttacgtatcattggaaagtgcattaacataaatacggcagtaagcagaggtagtacaaaggtatgtaaactataaaacgagtcaaagtggattggcccacactagcacttccacgtaataattccactaaaggggatcctattactggaatcgcgtcaggtacacctgtcacaattttgactgcccaataaccaatttgatcccaaggcaaagaataaccagttacaccaaatgatgcagtcaatacagccaaaaccacacctgtgacccaagttaattcacggggttttttaaatccacctgtgagatacacacgaaatacgtgcaggatcatcattagaaccatcatacttgctgaccatcgatgaactgatcggattaaccaaccaaagttggctccgtcattatatattgaacggaggaaaaagcctctgtaacggttggtcggtagtaaaaagtcatagcaaaaccggtagcgacttgtactagaaaacaagtaagtgtaattccccctaaacaataaaatatgtttacatgaggaggaacatatttactagttatatcatcagcaattgcctgaatctcaagacgttcctcaaccaatcatatactttattgagataggtaactagcccgattccccctccgagaaccgtatatgaaaatttcatctcgtacggctcaagcagaaacacacaattttcaacggatattagaaaaaaaagttcaaaacttcaccagccacggtattcgatcgatttgccttgaagatatgaaataagaaaaatccagaatttcttctttgtgatgataatgccaaaaaatctcaagttggctcatctgtctttctttcccgtatgttgatcattagaggcctcttgacttttctcttccctattttttatttatttgatttttttacttgtaaaaaaatcaaataaaaatttatagtggttttctgatagaaattttcttgttgcgatcctatgaatcagttcaattaaaaccttagattcatactagagccacgatgattgagtctcaagctaaacaaaaggcaagggttcttcgaataaaaaccgcttgatgatcatttattgaaagagaaaaaaattgtcttttgggcaaacaaaattggaaggaagaaaatttctttttttattaagaactacttgaatttttttttttcagtctggttgcgaggtctaaatagtgagtatgaatcatagttccattttttttcttgatccactctatgtatttcgtgttccagatactagaataaataatatccgacgaattagaatcatcttgatagagataacaggccctttctatgtattatcaataggatcaattctaacaagtcacacactcatattccagagataccgaaacaaaaaaatccacggtcgaactaccagaatgtctagaaatgtgaagcttaaagtagaaaggctttttttggatggaaaaactatgacttcatagtttttgttagtagaaacctaattcgttaaaattccgtccagtaaacagaagaattataaatttctaaaatgatagataggaatatcgcgaataaagccattgcgacccccataaaaggagtagtcccccaacccggagctactttcccatattccgaattcaagggtttcaataaactactgcgccagtccgttttggcttaggtctagaactatcttcaacggtttgtgtagccataaattctatttaatcattggtgttgactttgtatactattccgtgtagttgtaaatacacgatcttttcctagatccattgtaatcttgaaattctataaaaatggaaacagcaactttagtcgccatctccatatctggtttacttgtaagctttactgggtatgccttatataccgcgtttgggcaaccctctcaacaattaagagatccattcgaagaacatggggactaattgaagtaagaagtctcccctctgggggacttcttacttcaatgaaattatttatttccttcaattaaattatttcattttttagtcggaaccttaggtggttctcggaagaagatagcgaaaaaaattatccctaaagtcgaaactaaaaggaacgtataaaccaatgcttccatagattcgatcctggtttatttacaattataacttccacacctattcacttatcatttgggagcatttcccatataaaaaaagaaaaagagtcaaagaaaggacaggagatgtttttcatgtcaaatcaaaaaagagaggtgaaagataccatagcaatgtggtatcaggctgcctgtctctttgtagttggatctccaactttttggaatgttccaaattcaacttgagcatccaagtctggatcaataccagcaaaaacatctcggaacaaggttcgagcgccatgccaaatgtg

SEQ ID NO: 4693 - DNA, 1088 bp, Setaria italica
aatgaggagaggaaggatccgacctctagctctttacttttactgcctgtgcagctaaggaaagacaactacacttccaagtcctaagagaatactagtatacgatctgttatataaataggtaaatgttcctttccattatgaatcgcgattgtatggccaaccattgcgggtagaatgctagatgcccgggaccacgttactagaatttctttctcctccttcatattaaccttttcgatttttgccaataaatgacgagctacaaaaggattcgttttttttcgtgtcacagctgattactcctttttttcattttaaagagtggcatcctatgtccactatctcgatcgaggtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagattcttcttttttctcaaaaaaccccttcccaaactgtacaagcttcttccaaagcatacggctttctagatgtatatgacgatctctagacaga

SEQ ID NO: 4694 - DNA, 6483 bp, Pennisetum glaucum
tgtctttgtttttgcttcggattggaacaaatgactctaattcgtccccgcctccgaatcagtcgacattttgtacaaattttacgaacggaagctcttattttcaatatataggtattcctttcttaaactatgaatctatttttttggaaaaaatgagtctcttcacttaaattttgaaacttggaagtaattaccctagaaaaacctaatcctttggatctttggtatccttcaaatcttcagtatccttcgagtcttcggtacgcttcgaatccttatggggaagtctataaattatacgccccttgctggaatcataacgacttacttcaattttgaccctatcccccatcagtattcgtatagagctagaccggatctttccggaaatatagcccaggatgatggtgtcattctctaggcgaacgcggaacattccgttgggtagggcttccgtaactaaaccctcgaaagtgactttttgcttctctcggtttttttttttctgtcatattttttttctcctattttttccatttttattttcaaaataggaagttcaagatagaattcgggtactataggtggggccattaccatatataacataagacttctcccccaattctgtttagtcgagcttctcgatctgtcattatacctcgagaggtagaaagaatagcaattcccattccgcccaaaaccttaggaattccttgatagttgacataaattcgtaagccaggtcggctgatacgctttaaagaggttctagttctatatattccctttctagtttttctcttttgatgtcgcaaagttaaaaccaagaaatatctggtactttcctgatgtttccgaacactttcaataaaaccctctcgtagaagtattttaacaatgttttcggtaatatttgtggatactactcgaacagttccttttttattcatgtctgcgtttcttatagaggttagtaaatcagcaatagtgtccttgcccataagactctaattctaggttcctcctaatttttctataatcaacatgttttcctttttcttttcattttagattttaaagcatatacgtgagacacaatctacttattttttttctttgatctatatctcgtctactagtgtttataatacttcaggagctaatgaaactattttagtaaaattcaattctctcaattcttcggcaatcgcgccaaaaactcgagttccttttggatttcctttttgatcaatgataactgctgcattgtcatcatagcgtattattataccatcttcgcatttgaattctttacatgtacgtacaattacagctcgaattacttctgatctttctagaggcatttggggtactgcgtctttgattacagcaacaataacatcaccaatacgagcatatcgctgattaccagcggctcctatgactcgaatacacatcaattttctagctccactgttatctgctacatttaaaagggtctgaggttgaatcatattattttgatttcaatttgttatttcaatgcaaaaggatgaaagaaatattgtctttccagaaagaaaaacctgggttttttatcttaaatactcctttttggggttctatatctctaatcgaagaaattgacttcgtatgggcattttactggcagctatagagatagctgctctagctacagtttcggatactccgctcatttcataaagtattctacctggtttaacaacggctacccaatattcgggggatccctttcccgagcccatacgtgtttctgtgggtcttattgtaactggtttgtcgggaaatatacgcacccatatttttccaccacgacgtgcatatcgtgtcattgctcttcgtcctgcttctatctgtcttgcggtgatccaagcgggttcaagtacttgaagagcatatctaccaaaacaaatacgattgcctcggcaggattttcccttcattcttcctctatgttgtttacgaaatctagttcttttggggttatagtcgacggttctttcttagttccatctctactgcaaaactggacatgagagtttcttctcatccagctcctcgcgaattaaatgagaaagcgtgcgaatttctcaaattccataatattttagaatctccttatttttattcttattgaatcgtggtaaagtattctaatccaataaggatttcgcgggcgaatatttactctttcctgtcttatttgttaatttagaatcttatcaaataaagcaatttttttttggtttgttccgccatcccacccaatgaagtgttaggattcttttcaataaaatccgatgcctcataggttttgtcgttcccacagcttctcctttaatggttaggtttgaatcctgcaatggagcttccaaaaaatttctttccgagtcaattttctcagttttattaacgcgggctgctcttttttatttctttaaattttgatttgttatttcaaaagttacgatttcaaattctctttttttttattattttattatattgatgctttatcacattgcttttttttttatgatgtaattcatagaccatacacattggaattctatatctttcttattcttcttccttctatctatcatccctccttttatccacatccttttagttttgcttcacagcctaaaatcaagtttcttttgtagagaaaaaaatgcagttgctacaactatatgatagatctactcattttttatagatgtatttattcacatagtgactggttcttagttaggatctcgacaatacgaagcaataggttggttattagttaattttctagaattactaagttttttctatttttagtagggttcagccaattttttttataaatcctcatttttcaccctaaagaaaaaactaacgagtcacacactaagcatagcaattatattaaaagatttatcaattttcattaaatcttatagaaagagatctaatttcttctttttttagggattttgggaaaaagaagttcttgttttttttattctatcacagggcagaatgggaagactgggttagttattcttcttctacgaatatccaaatttttacacctaatactccatagatagttcgaattggatagcagcaataatcaattttagcgcgaattgtttgtaagggcagtctgccctttttgatgcattcggcacgtgcaatttctttccctgctagacgacccgcaattttgattttgactccctttatgtctgcttttttagttaattcaatggcttttttcattgcttttcggaatgaaactctattttttaattggaaagctatatattctgcaagaatattaggttgtctataaggttctttaaccttttcaatagcaatattaagtctctggtttacagaattaacttccttttggagatctttctctaattcttcgattgctccctttttctttaataaatttgggaatccaatatggattatgacgtggattgtatcaatttctttttgaatttctatatgtgtaattacttcagaacttgagtctgattctatttttctattcgagccttttttcctattctgttgtatatagttcttgatacaattccgtatttttttatcttcctgtagaccttcagaataattttttggttgtgcgaaccaaaaggaatggtgattttgggttgtaccaagtctgaaaccgagtggatttattttttgtcccatatttttctattctatttctttttttattgggaatcgaaatcttggaaagatctaaagattatttagatttctttactatataaagataaagattatttagatttctttactatatttagtacaattgttatatgacacatggttttttttatagaataactacgtcctcgagctcgaggtctgaattttttcataatagtactcctactgacttcggctttagtgatgaataaactcgctttgtcgaaatccctataatgagtagcatttgctgctgccgaataaaccaactttaagatgggataagacgctcgataaggcatgaggttcagtatcataacggtttcctcgtagtaacgccagcgaatctcatcaagaactctttgtgctttgaaaacagacatatgtatgcgtttttgtgctttaaaaacccgttcaaatttaagtagacgatcagttggaacttttcttgcgagtttccttagctcgttcttcttcttctttatcctaggagtatactttaccaatttgaaacttgtcataaataaggttattacccgtctatctttactttatttgaatccaattatttctttgtttattctgaatctttctattctgaattcagttaacgacgagatttagtatcctttcttgcactttcataactcgtgaaatgccgagtaggcacgaattcccccaatttgcgacctaccataggatttgttatgtaaataggtatatgttcctttccattatgaatcgcgattgtatggccaaccattgcgggtagaatgctagatgcccgggaccacgttactataatttctttctcctccttcatattaaccttttcgatttttgccaataaatgacgagctacaaaaggattcgttttttttcgtgtcacagctaattactcctttttttcattttaaagagtggcatcctatgtccactatctcgatcgaggtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagattcttcttttttctcaaaaaaccccttcccaaactgtacaagcttcttccaaagcatacggctttctagatgtatatgacgatctctagacagatggatcttatatgaatcgtatgatgaagtaccacatgagtggatatatagaaaaggaatcaaaatctgccgaatcgctcatgttatgatcttctacatcctaggtctccacgttccgtcatctggcttatgttcttcatgtagcattcagatcgaatgactctatgaaattacgtcgatacttccacatattatgggtaacgtaggagacatccctattttcacccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtggaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatctcttctcaccatccccatagtgtatgagacaaatgtatgcatttcgattagggtcgtattctatggttacgattctaccagatatgtctttttgattccgtcgaaaatcgattttacggtataggcgcttatgacctccccctctatgccttgcggtaatgattcctctggcattacgacctttaccacaacggtgccgtccatggatcaatttatttcgtggattggatttcacttgcctgtctacggttcccttgcgtgtgctcgggataggtgttttgtataaatgtttcgccgtattattaagtattctcctttagttcgtttctctatctagaagtggaatagaata

SEQ ID NO: 4695 - DNA, 4362 bp, Zea mays
gagtatcctatttccataggctcgaatgaccccttctcataataagaatgtgcacgatctggtccggtatggaatgaacttataatctgatgatcgagtcgattccatgattataagttcataaccctagcacccattcccattttgggcggaacatatctactaattcttttattccagttagtaagagggatcttgaactaagaaatagacctagcagctaaaagagggtatcctgagcaattgcaagaccagtagatattgatggtattcgtgagcctgtttctggttctttactttatggaaacaatattatctctggtgctattattcctacttctgcggcgatcggattgcatttttacccaatttgggaagctgcatctgttgatgaatggttatacaatggcggtccttatgagctaattgttctacacttcttacttggtgtagcttgttatatgggtcgtgagtgggaacttagtttccgtctgggtatgcgcccttggattgctgttgcatattcagctcctgttgcagctgctactgctgttttcttgatttaccctattggtcaaggaagtttctctgatggtatgcctttaggaatatctggtactttcaactttatgattgtattccaggcagagcacaacatccttatgcatccatttcacatgttaggtgtagctggtgtattcggcggttccctattcagtgctatgcatggttccttggtaacctctagtttgatcagggaaaccactgaaaatgagtctgctaatgagggttacaaatttggtcaggaagaagagacttataatattgtggctgctcacggttattttggtcgattaatcttccaatatgctagtttcaacaattctcgttctttacacttcttggctgcttggcctgtagtagggatctggttcactgctttaggtattagtactatggcattcaacctaaatggtttcaatttcaaccaatctgtagttgatagccaaggttgcgttattaatacttgggctgatatcatcaaccgtgctaatcttggtatggaggtaatgcacgaacgtaatgctcacaacttccctctagacctagctgctcttgaagttccttaccttaatggataaggtttttctcctaaacatataggaatttttgaaggaaggaaagccggaaatacccaatatcttgttccaacaggatattgggtatttctttgtttattctgaatctttctattctgaattcaattaacgacgagatttagtatcctttcttgtactttcataactcgtgaaatgccgagtaggcacgaattcccccaatttgcgacctaccataggatttgttatgtaaataggtatatgttcttttccattatgaatcgcgattgtatggccaaccattgcgggtagaatgctagatgcccgggaccacgttactattatttctttctcctccttcatattgaccttttcgatttttgccaataaatgacgagctacaaaaggattcgtttttttcgtgtcacagctgattactcctttttttattttaaagagcggcatcctatgtccactatctcgatcgaggtatggaggtcagaataaatagaataataatgatggaaaaaaggagaaaatcctttagctggattagggggcgggatgtagcccaagtggatcaagggcagtggattgtgaatccacccatgcgcgggttcaattcccgtcgttcgcccatcgcattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactacggggcgtttacctagccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtaggttcttcttttttctcaaaaaaccccttcccaaactgtacaagcttcttccaaagcatacggctttctagatgtatatgacgatctctagacagatggatcttatatgaatcgtatgatgaagtaccacatgagtggatatatagaaaaggaatccaaatccgtcgaatcgctcatgttatgatcttctacatcctaggtctccgcgttccgtcatctggcttatgttcttcatgtagcattcagttcgaatgactctatgaaattacgtcgatacttccacatattatgggtaacgtaggagacatccctattttcacccgggggtcttaattaccactgcttaactttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatctcttctcaccatccccatagtgtatgagacaaatgtatgcatttcgattagggtcgtattctatggttatgattctaccagatatgtctttttgattccgtcgaaaatcgattttacggtataggcgcttatgacctccccctctatgccttgcggtaatgattcctctggcattacgacctttaccacaacggtgccgtccatggatcaattcatttcgtggattggatttcacttgcctgtctacggttcccttgcgtgtgctcgggataggtgttttgtataaatgtttcgccgtattattaagtattctcctttagttcgtttctctatctagaagtggaatagaataacccggttgaagggtaatgatcatacgtctgtaatgcattgtatgtcccagaataggtcccattcttctaccctttccgggtagtcgatggctattcacagcaatacccaaacaggatattcgctctttttcttgttcttgatgatattgtaatggaacgacgagcctatttcttcgctttttcgccaacaaatctgaattatcttgaagaatggaaggatagaaacaattccaatgaccgttgaacacgattcgatctggcgttaaataatcaagaatttctctatcttttttaccaaaagtatccaacagtctatggcttacttgatcattagccattgagaagtcaaagatatatcttccatcaacaaaaaaagaataagtattcatttgatcttgatccttgtgcagcgaaaaagatgctatactggatctgcacatacttactgacaatatccataaatggcttgtttttggtaatcgacgaagattaccatattgatattcgggcgcatggtaaacatcagtactccagtgcatttccccgtctgattcggaataaatatgcttttgtaccttttctttaaaatgcaaagtggacgttccggcacgaatctccgcaattacttgttcagattctacatattgatcattttgcactagaatcaagctttttaacggaatattcacactatgtagaatatcctgactctgaatagttacatgcaagtctatatagcatagaaaagcaggttgcccatgacgggtacgtgtggggtgaaccaaatcctcattgaattggattttttcattcgagggggatcgtataaggtcggcagtaccccctgtgaatactccaccagtatgaaaagttcttaatgttaattgagttcccggctccccaattgattgacccgcaataatacctacagcttcccccaattcgaccagatccccatgagtgggactccgcccataacataattgacagatccaagatgtgctccggcaag

SEQ ID NO: 4696 - DNA, 793 bp, Zea mays
cattcagaacataagccagatgacggaacgcggagacctaggatgtagaagatcataacatgagcgattcagcggatttggattcgttttctatatatccactcatgtggtacttcatcatacgattcatataagatccatctatctagagatcgtcatatacatctagaaagccgtatgctttggaagaagcttgtacaatttgggaaggggttttttgagaaaaaataagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaactcgcgcaggtggattcagaatccactgccttgatccacttggc

SEQ ID NO: 4697 - DNA, 4147 bp, Oryza sativa
gatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaataggtaagcggggaataaccttatttatgacaagtttcaaactggtaaagtatacccctaggataaagaagaagaagagtgggctaaggaaactcgcaagaaaagtaccaaccgatcgtctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggcagcagcaaatgctactcattatagggatttcgacaaagcaaatttattcatcactaaagccgaagtcagtaggagtactattatgaataaattcagacctcgggctcgaggacgtagttctcccataaaaaaaaccatgtgtcatataacaattgtactaaatatagtaaagaaatcgaaataatctttagatccatctaagatttgattcccggtaaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgagtgcatcaaaaaaggtagacttcccctccaaacaattcgcgctaaaattgattattgctgctatccaattcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaaattctacctctttctataagatttaatgaaaattgagaaatcttttaataaaattgctatgcttagtgtgtgactcgttagtttttttttagggttcaaaaaggggattaaaaaaaaatagaatgaaccctactatgtaattatagaaaatgaactaataaccaacctattgcttcgtattgtcgagatcctaactaagaaacagtcactatatgaataaatacatctatcataaatgagtaaatctatcatatacgtgtagcaactgcaattttttctttaaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattcgaaatcgtaatttgattgaaacaagaaatacaaatttcaaggaataacaaagagcgtcccgagttaataaaactgagaaattgactcggaaagaaattttttggaagctccattgcgagattcaaacctaaccattaaaggagaagcagtgggaacgacagaacctatgactggataggattttcttgaaaagaatcccaatacttcattgggtgggatggcggaacaaaccaaaaaaattgtcttatttgataaggttatgaattaacaaataagacaggaaagagtaaatattcgcccgcgaaatttttattgaattagaatactttaccgcgattcaataagagtaaaataaaaaaaggagatt

SEQ ID NO: 4698 - DNA, 5459 bp, Setaria italica
tccacaaacaatgtctttgtcatttgatccaggagccttccgttagataggaacagcttgctaaatactgagaactctcggatagagtattagaatgaaaagaccagaaataattcgaataaatagcagtctctgacaactcatcctctttaatctgcttggacccgctccaatacccataggaaaatccccagtcatattcagcgtacctatccctgcaatcaaatagatgtcccaagggccccatattctaggagcccaagttatgctattgaaaattcgttcctctagcagttccggtttgaccattccgttccctttttcaaactccacttcttttcatatagcaatccctaatcaaagagagaacaatatccatttcaaaacatttctaacggattccttggttcggaccgacgaagtaatggcactcgattattatcaacccgagtgcaatctttttctgtcggtaaggattgcaccagagcaccttctacttctaataggccatgaactatagatagagaagaatcattctgagcgagtccataagaagcgaccactttttcatcggttccgggggaagaccaaagatcttgcgcgaccggtccgccagaaaaactcaaagagaaagaagtctcgttaatctcttcatgctcgttccaagttcgaagtaccgtttggccaaagaaaaagccgcttctgacacgattgcctgtttatatagatagatataggatctatggggttattacttagaagtctattttgtacaagacccctcctatctgatagaaaagggtcccatgatcccgagccggtcttatcttggctcgcaaccccaagtttgtctatgaagagctaatctaattgtattagtttctataatggatttcttatgtggaatactaatggatagggcctcgttgctaagtgctacaagatctagtgcactggaactcgtggttatggacccgaatcctttagtatggaacattgtcttttccaagtaaaaacccctagtatatgaaagaatgaaaaggtgctttcgttcttgtggaataagaagccctcgtaccttaatgaaaggaaaataggaatttttcgttaggtatttgaccaaataggatcgtccagttcctatagaacccatcactaaaatacccgatagggctaagcggaacgaaaagggtttccataagatggtaaatgaaaacgattagccccacacgaggtttgggaataagtgattgtctgataatgagcaaggaatatacgtctttctgctaaagagcatctataaactcataattcattagatccttgttagcaatgtcaactaggtatcataagtaaatggatcccggttgttcaatcctttgataaccaaggtcattctttgctaaagagaaatgatcactatgggtcagactcaatagaatggatccattccaaatagcgagaattaggattcttgatccctctcaatctctctttcaattcgaggatccagagaggtgttttcatagtcatctccgaatatttgccatctccgaatatttgccatctccgaatattttcgatttcattttctatgatatgtctttctatatgaaaattggttattacgatgtacgatgatccctgttaagcatccatggctgaatggttaaagcgcccaactcataattggtaaattgcgggttcaattctgctggatgcacgcgaacgggaacgttccataagtctattggaactggctctctatctatggaatctcatccatcatccatacataacgaattggtatggtatattcataccataacataagaacaataagaactcgaattctatcgatactggaactcagagcataggagggaaagtcgatttatggatggaatcaaatacgcagtatttacagaaaagagtcttcgtttatgggaaagaatcaatatacttctaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggtattctattccacttctacatagagaaacgaactaaaggagaatacttaataatacggcgaaacatttatacaaaacacctatcccgagcacacgcaagggaaccgtagacaggcaagtgaaatccaatgatgagaatgggaaaagaaaaatcaaatatttttaattagttcctaatgccagaggaatcattaccgtaaggcatagagggggaggtcataagcgcctataccgtaaaatcgatttcgacggaatcaaaaagacatatctggtagaatcgtaaccatagaatacgaccctaatcgaaatgcatacattgtctcatacactatggggatggtgagaagagatatattttacatcccagaggggctataattggagatactattgttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggtgaaaatagggatgtctcctacgttacccatatatgtggaagtatcgacgtaatttcatagagtcattcgatctgaatgctacatgaagaacataagccagatgacggaacgcggagacctaggatgtagaagatcataacatgagcgattcggcagatttggattccttttctatatatccactcatgtggtacttcatcatacgattcatataagatccatctgtctagagatcgtcatatacatctagaaagccgtatgctttggaagaagcttgtacagtttgggaaggggttttttgagaaaaaagaagaatctacttcaaccgatatgcccttaggcacggccatacataacatagaaatcacacgtggaaggggtgggcaattagctagagcagcaggtgctgtagcgaaactgatgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgcccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcatcattattctatttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggttaatatgaaggaggagaaagaaattatagtaacgtggtcccgggcatctagcattctacccgcaatggttggccatacaatcgcgattcataatggaaaggaacatatacctatttacataacaaatcctatggtaggtcgcaaattgggggaattcgtgcctactcggcatttcacgagttatgaaagtgcaagaaaagatactaaatctcgtcgttaactgaattcagaatagaaagattcagaataaacaaagaaatacccaatatcctgttggaacaagatattgggtatttctggctttccttctttcaaaaattcctatatgttagtagaaaaaccttatccattaagagatggaacttcaagagcagctaggtctagagggaagttgtgagcattacgttcgtgcattacttccataccaagattagcacggttgatgatatcagcccaagtattaataacgcgaccttgactatcaactacagattggttgaaattgaatccatttaggttgaatgccatagtactaatacctaaagcagtgaaccagatccctactacaggccaagcagccaagaagaagtgtaaagaacgagagttgttgaaactagcatattggaagattaatcgaccaaaataaccgtgagcagccacaatgttataagtctcttcttcttgaccaaatttgtaaccctcattagcagactcattttcagtggtttccctgatcaaactagaggttaccaaggaaccatgcatagcactgaatagggaaccgccgaatacaccagctacacctaacatgtgaaatggatgcataaggatgttgtgctccgcctggaatacaatcataaagttgaaagtaccagatattcctaaaggcataccatcagagaaacttccttgaccaataggataaatcaagaaaacagcagtagcagctgcaacaggagctgaatatgcaacagcaatccaagggcgcatacccagacggaaactaagttcccactcacgacccatataacaagctacaccaagtaagaagtgtagaacaattagctcataaggaccgccattgtataaccattcatcaacagatgcagcttcccaaattgggtaaaaatgcaatccgatcgccgcagaagtaggaataatagcaccagaaataatattgtttccataaagtaaagaaccagaaacaggctcacgaataccatcaatatctactggaggagcagcgatgaaggcgataataaatacggaagttgcggtcaataaggtagggatcatcaaaacaccgaaccatccgatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagaat

SEQ ID NO: 4699 - DNA, 3665 bp, Oryza sativa
taacaagccttctattatctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacatcggatggttcggtgttttgatgatccctaccttattgaccgcaacttctgtatttattatcgccttcatcgctgcccctccagtagatattgatggtattcgtgagcctgtttctggttctttactttacggaaacaatattatctctggtgccattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagagacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgcttcagcaagatatgggtatttctttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgtta

SEQ ID NO: 4700 - DNA, 3879 bp, Oryza sativa
attcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgacttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcattcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattattttgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacaga

SEQ ID NO: 4701 - DNA, 1771 bp, Oryza sativa
aatgaggagaggaaggacccgacctctagctctttacttttactgcctgtgcggctaaggaaagacaactacacttccaagtcctaagagaatactagtatacgatctgttatataaataggtaaatgttcctttccattatgaatcgcgattgtatggccaaccattgcgggtagaatgctagatgcccgggaccacgttactattgtttctttctcctccttcatattgaccttttctattttttccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagatccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatataccttctcaccatccccatagtgtatgagac

SEQ ID NO: 4702 - DNA, 10854 bp, Oryza sativa
aaaccacaagagtgaagactagtagagtctcgtcttttgtcattctttgctcctttttcactcaatgattcattcgaatttcccgaccaaaaattctatatgtctattcatagggcctcgttgctaagtgctacaagatctagtgcactggaactcgtggttatggacccgaatcctttagtatggaacattgtcttttccaagtaaaaacccccagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcaggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaaaagaaataggtaagcggggaataaccttatttatgacaagtttcaaactggtaaagtatacccctaggataaagaagaagaagagtgggctaaggaaactcgcaagaaaagtaccaaccgatcgtctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggcagcagcaaatgctactcattatagggatttcgacaaagcaaatttattcatcactaaagccgaagtcagtaggagtactattatgaataaattcagacctcgggctcgaggacgtagttctcccataaaaaaaaccatgtgtcatataacaattgtactaaatatagtaaagaaatcaaaataatctttagatccatctaagatttgattcccggtaaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaattccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgaatgcatcaaaaaaggtagacttcccctccaaacaattcgcgctaaaattgattattgctgctatccaattcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaaattctacctctttctataagatttaatgaaaattgagaaatcttttaataaaattgctatgcttagtgtgtgactcgttagtttttttttagggttcaaaaaggggattaaaaaaaaatagaatgaaccctactatgtaattatagaaaatgaactaataaccaacctattgcttcgtattgtcgagatcctaactaagaaacagtcactatatgaataaatacatctatcataaatgagtaaatctatcatatacgtgtagcaactgcaattttttctttaaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattcgaaatcgtaatttgattgaaacaagaaatacaaatttcaaggaataacaaagagcgtcccgagttaataaaactgagaaattgactcggaaagaaattttttggaagctccattgcgagattcaaacctaaccattaaaggagaagcagtgggaacgacagaacctatgactggataggattttcttgaaaagaatcccaatacttcattgggtgggatggcggaacaaaccaaaaaaattgtcttatttgataaggttatgaattaacaaataagacaggaaagagtaaatattcgcccgcgaaatttttattgaattagaatactttaccgcgattcaataagagtaaaataaaaaaaggagattaaaaaaaaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccatcgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacgtatgggttcgggaaagggatcccccgaatattgggtagccgttgttaaaccaggtcgaatactttatgaaatgggcggagtatccgaaactgtagctagagtagctatttccatagctgccagcaaaatgcccatacgaagtcaatttcttcggttagaaatataacccccccatacgaatattgaaaataaaaaaccaggttcttctttctggaaagacaatatttctttcatccttttgcattgaaataacaaattgaaatcaaaataatatgattcaacctcagacccttttaaatgtagcagataacagtggagctcgaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacatgttgattatagaaaaattaggaggaacctagaattagagtcttatgggcaaggacactattgctgatttactaacctctataagaaacgcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagtcttatgttatatatggtaatcgccccgcctatagcggtaatcgccccacctatagtacccaaattctatcttgaacttcctatttttcaaacaaaaatacaacaaaaataggagaaaaaaaatatgacagaaaagaaaaataggagagaaaaaaaaaacccgagagaagcaaaaattactttcgagggtttagttatggaagccctacccaacggaatgttccgcgttcgcctagagaatgacaccatcatcctgggctatatttcaggaaagatccggtctagttctatacgaatactgatgggggatagggtcaaaattgaagtaagtcgttatgattcaagcaaggggcgtataatttatagacttccccataaggattcgaagcgtaccgaagactcgaaggataccgaagatttgaaggataccaaagattcaaagggttaggtttttctttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtaatctttcgaaaaaagaacttgactttctaaaaagtaaaaaaaaagtacccgcgaaaatgtccaaattccaaataaaaaaattcaagtaaaggatatattttaccctgaaacggatatctttgtatcttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctcaagaaaagcatcaccctatgctggtcaaagaacagctgtagatgctattcgtacagtgggtttgcaacgagcagaagttatggtaaagggtgctggtagtggaagagatgccgcattacgagccattgctaaaagtggtgtacgattaagttgtatacgcgatgtaacacctatgccgcataatgggtgtcgacctcctaaaaaaagacgtctgtaaaagaattaaacccctttcaagagaaataaacgattcaatgatcaaataataatactagtctatatggttcgagaggaggtagcaggatccactcaaacactacagtggaagtgtgttgaatcaagagtagatagtaagcgtctttattatggtcgtttcattctgtccccgcttagaaaaggtcaagcggataccgttggtattgccttgcgaagagctttacttggagaaacagaaggaacatgtatcacacatgcaaaatttgggagcgtgccgcacgaatattctacaatagcaggtattgaagaatcggtacaagaaattttactaaatttgaaagaaattgtattgagaagtaatctctatggagttagaaccgcatcaatttgcgtcaaaggtcctagatacataactgcccaagatattatcttaccgccttccgtagaaatcgttgatacggcacaacctatagctaacttgacagaacccacggatttccgtattgagttacggatcaagagagatcgcggatatcacacggaagtcagaaagaacactcaagatggaagttatcctatagatgctgtatccatgcctgttcgaaatgtgaattatagtatttttgcttgtgggaatggaaatgcaaaatatgagatactttttctagaaatatggaccaatggaagtttaacccctaaggaagcgctttatgaggcttctcgtaatttgattgatttatttcttccttttcttcacacggaggaagagggtactcgtttccaagaaaataaaaacaggtttacttccccccttttaagctttcaaaaaagattaactaatctaaagaaaaacaaaaaaagaattccattgaattgtatttttattgatcaattagaactgccttctagaacgtataattgtctcaaaagggccaatatccatacactattggaccttttgagtaagacggaagaagatctgatgagaattgacagttttcgtatgcaagatggaaaacagatatgggacactctagagaagcatctcccaatggatttacctaagaataagttctagttttaaatccattgcaattttttcctcttcttctttttcgagttagaataaaaagaaaaaagaaaacaattttgcatctttgggacaatctatattttcgcgaaatggatcataataaaatagattataggtatctagggaagattcacttggaagtaactatttcctagatacctatgcacggtacttcacgattgaatgaatcaaactgaaaaatccctaaaaaagacctaaagttaaggatttttcaatgggtaatgttgctccaatacctaaccaaagagctactgcagtaccgattaaaaaaacggttgtagctactgggcgacgaaatggattttggaatttattgacattctctagaaaaggtactgtcaataagcccgtcggcacagaaaccattaagagaacgcccaataacttattaggtactgtacggagtatttgaaacacgggaaagaagtaccactcgggtaatatttccagaggagttgcaaacggatccgccggttcaccaatcattgacggctcgagaaccgctaaacctacattacatgcaatagtacctagaattactactggaaaaatatataaaagatcgttgggccacgcgggttccccgtaataattatgtcccatccctttagctaattttgctcttaatacaggatcgtttaagtcaggtttctttgttattgggataggtgaattctttaagatccagcccccaaaggaaccggacatgagaatttttcatcatccggctcgagcaagaatgaaagaaataaaaccgtagaagatccataatagaataaggtatataatggctcaatggctctaagtaagaaaagctttatcagattctattttccgaagttgcacctacaactattcattgaaaagaatcctactcttatgggtaaatgctcaatatccaagtgggcttacaaatttgatcatgatcaattgctttgtggattgtctcgcgtctcttgattagttggtatttatcccccccaatattgcaagtttcttacgtccaaacaaagtatttacttgttactaataaaaaatcaaaaagtttagcctacgttcttccttagatcccttcttttactccgatagtattgcagatcgcaatcgatgcaaagaaaatgaatgcatttccatactataataaaaagtaagtgtaataaatagagaattggatcatgtcacatgacttattc

SEQ ID NO: 4703 - DNA, 16891 bp, Sorghum bicolor
gaggggaggggatttagccttaattccacaaacggatatagcggattctgtatccgtgtatacagtatacagagatatattgaaagtggacttgcatctgagatgagttagtagatcatttcatatagctatgttctatttgtaggaataaaatagggattgggctgtggagagatggctgagtggttgatagctccggtcttgaaaaccggtatagttctaggaactatcgagggttcgaatccctctctctccttttgtatattgaatacatttgtttctttctatctatgtttttctttgttcagcccccttatatcattctttcataaaaaagcatgaatggctcggctagatggaataaccgagccagaacagaaaaaaactagaacaggtataaataaaaaatcttagttaagaggggtcatgtaaagaacaggttccaaatcacgatcaattcccttttcaaagcctgctgcagcagctcgggctcttcctgcatgccacaaatggcccacaaaaaagaagaatcctagaacaaaatgggaggtcgctaaccaacttctaggagagacataattaactgcattgatctcggtagctacgccacccacggaatttaaagagcctaaaggagcatgggtcatatattctgctgaacgtcgttcttgccaaggttggatatcttttttcaacctactcaagtccaaaccgttggggccccttagaggttctaaccacggagcacgaagatcccaaaaacgcatagtttcccctccaaaaataacctctcccgttggggaacgcattagatatttacctaaacccgtcggtccttgggcagaccctacattagctccaagacgctggtctctaactagaaaagtaaatgcttgagcttgagaagcttctggtccagtgggcccgtaaaactcacttggataagccgtattattgaaccagacaaaacaacaagcgataaaaccaaaaacagataaagcacctaaactataagacaagtaagcttcgccagaccatacaaatgcacggcgagcccatgcaaagggtttggttaagatatgccaaattccgccaagtacacaaatggaacccaaccatacatgccccccaattatatcttctaaatcatccacactaacaatccatccttctcccccaaaaggggattttagtaaataaccaaatataacaccggggctaagggtcaaattggtaatttttcttacatccccccccccgggggcccaggtatcatatacgccgccaaaataaagagccttgagtactagaagaaaagcacctagacctaacaaaattaagtgaatacccaaaattgtagtcattttatttctatctttccatacataaccaaagaatggaaaagattcttcaagagtctcgggtcccagaagcgcgtgataaatgccaccgaagcctaagactgcggaggaaattaagtgaagtactccggatacaaagtaaggaaaagtatctagaacttctccccccggccctactccccaacctagagtagctaagtgcggaagtaaaatcaacccttgttcatacatgggcttttctggtacgaaatgggccacttcaaataggttcattgctccggcccagaatacgattaatccggcatgggctacatgagctccaagtagtttaccggacaaattgataagtctggcattcccagcccaccaagcaaagccggtggtttcttggtcacgaccagctaaaacgaaagttccattaaagagcgtttccacgtggtagaacctcctcagggaatataagattttcatgaggctgatcctgagctgccatccacgcacgaataccctcatttaaaagaatatttttggtgtagaaagtctcaaattcaggatcttccgctgcacggatttcctgggaaacgaagtcataggcacgtaggttcagagccagaccaactacgccaatagcactcatccataaaccggtgacgggtacaaatagcataaagaaatgtaaccaacgtttattggaaaaagcaacaccaaagatttgggaccaaaagcggttagcagtgaccattgaataagtttcttcagcttgagttgggttaaaagcacggaaggtatttgcaccatcgccatcttcgaatagagtgttttctacggtagccccgtggatagcgcatagcagagctgcgcctaatactccggcaactcccatcatatgaaatgggttcaacgtccaattatgaaatccttggaagaaaaggatgaaccgaaatatagctgctacgccaaaactcggcgcaaagaaccaaccagattgtcccagtggataaataaggaatacggaaacaaaaacagcgattggaccagagaatgaaattgcattataaggccgcaattgaacagaccgagcaagttcaaattgacgtagcataaaacctattagtgcaaaagctccatggagagcgacaaaagtccaaagaccacctaattgacaccaacgagtaaaatccccctgtgcttccggtccccatagtagcaacaaagagtgtgctaaactattggcaggtgtggaaaccgccgcggttaagaaattgcaaccttccaaataggaactagccaatccatgggtataccaagaagttacaaaagtagtccctgtaaaccaaccccctaaagcgaaataagcacaaggaaagagcaataagccggaccatcctacaaaaacaaaacggtcccttcgtaaccagtcgtccataatatcaaatagatcgttttcttctttagtaactctaccaacggctatagtcatagtgatcctcctattcaattacttcaaccattttcgagcacctcatattacttccagggcatacgatagtttgattatctgtggacgatttctttctcgttcaatgccctttttcagtcgtctcgaagatagaaattttgcatttttatctatggggtcacaaccaaggtcgtgctaaatccacgaatttcatttaattcatttttcttatactatagaaaagaaataaaagaaaagaaataaagaaataaacatttgaattcagcattattccatgatttctatttcaaagcctattttttaagggaaaacccctcttttctcattcgctctctattgcatgggtggaagaacaaaaatagaataggattctgaaaaaaaaagaaagatattgaaaagaaaaattgacttttgaaaccctttattcattatgtgtaacggaaaagagttgcgatttcttcttattcctatagaacgtctagtaacaagaatatgaaatcgtaaatagcgaaaaattcttgccttgcgcgatctaagtctaaggaaataaaaaaatgcgcttatacaccaatttcatccacatcgaatttatatatcagaatagcggatagaggtatcattcaaggggtcaggtctacttactttatctttctttccaattttattgtgggtttgataagaaccttttttgctttgtggataaaaaaagagttttttttataacccgcttgttttattctaacaaattctatatggaactgcccgctgaagagaaaatcgatctgattgtctctcagcctatatcgaattttggaaagaaaaaaccagaattttcttcttttttttattaacattaagaaaaaagaatataattaaaatggaattggcaatataatttttatgcacttttgaaatgaaagaaaaaggaaggattttttgcaatcgttatttcttgcctctgtcatatcatgaaaacctttcgatttggaacggggagagatggctgagtggactaaagcggcggattgctaatccgttgtacaatttttttgtaccgagggttcgaatccctctctttccgccccctcggatcatttgggactttcaaattgtaaggaattctgacccccggattttctcataaataaatgtacgaaataaatccaattttaatttataaaaaaaaattctcaaaaattttggatttttactcctcacgcccaggattacgtcctgggtcattagataagaatccaaagataaagagggaaacaaagaatatcactactgtataaacaaaaagtttgagagtaagcattacaaaatctccaaaaatttttttgttaaggaatagattacccatttttccttaccacacggatccactagaatgggttttctttattttgacacctaaaaatgcaaaaatcaattcttaaaaaaattgcaagaattgatttataataagcactcttatcattagtttaggtattgtgtgggtacctaaaggtacgttcaacgtaggcgcagggggtagaaaggctgatcaaaatttattgctgcagctatacattcaatgtagaagaatttgaattttagaatcgaaggttcataatataagacttctcagctcttatccatttttttttttggaatgaatacatcattcaatttggcaggcagaatagtaaagatttcatcgaaaacttacagcagcttgccaaacaaacgctaatagaaaaaagagtacaggtatgacaggcataacatccacgattgggttgaaaatggcataagcttcgggtaatttggcgaagaaaaagctagtcggacaaagaacagaattaaaacagatacaggttaaactaagtatattaggcataacaagcatttcattcttgtagagtagataattggattttgattgagttatttttctaagggaaaaagcaaaagaaaaggtagattccaaatccttttttcttcggactttcccaaacacaaaatacctccttgtattcgcattctcaaatgagaatggaagaaattcgactttcatataatatcttaatagaattctatgtaatgatcaatgcattttttggattctatattatctgcatgtctcgaatcctagcaagaaaatatccctcattttttaggtaattgaagtgggattgacgaataatatataaaaataatagtgtttattagtgtctcataaaacgaaatgacatggggcgtggccaagtggtaaggcagcgggttttggtcccgttactcggaggttcgaatccttccgtcccagattttttctgatgaagcgaaagatagaatcgtattgtgccctgcacgacacaaaagtttattaaagagaataattatctcttatgaactcgtagattagatgcatttctaagcatttttttctttctcagaaaaccaaaaataaagtgtcaagtccagtcaaatttaatatctttattttcatgaaaaattttaaaagcaaagaccttaattttactttacaaaaaaaatttctttcttttgttattcgagtcgaagaagtatgagaattttataactacccaaaaacgaccaatcttttcattggcatagcttatttgtttaatagcttatttgtttaatagttaattgtttttgttacagaaaaatctattaattcattaaattaattccgctttttttgaggttgatagtttatttgttgggaaagggtcgatccttctcatttcaggattgatcatcttgagttctctgttgagaatggaaattcaataataaaaataaagaagtcttaagtaaactcttttattcctctttttcgaactatgtttcattcatatgatagaaagaatatgggtttaaataaattgtatctttgcagagtgttccccgataaatacttatttcttttatccaattttctccatagatagcaggtttgaattagtatacaaaagcaatgactattcatgattccatccatattggatcaattctcgataccattttgcaatgaaattagaggaatgttatggtaaaacttcgtttaaaacgatgtggtagaaagcaacgtgcgacttgaaggacatgatcgattgtggattttgctatccatcattttccatagtaatgaaaatgctcttggctcgacatagtctgttctattcgtcccgaaccgaatttgcgctgggttgtttgtaagtaaagtaaatagtacacgatggagctcgagaggacagaatttctttttgatcaagggaaagaatctagggttagtgaaaactaataaattaggccaactttgtcagtctatccttaatatggaaatcaaaaggttaaaataagaaaaagtccaattttggaagattggaaaaacttttttgattaaaagtctatctgaatcaattgttcatatttgatttctatagaagagtgaaatgctttatcgaaggaaataagaaaaaagaaagggtatgttgctactcttttgaaagaaaaaagaataggagttcccgaagtaatgtctaaacccaaggatttcacaaatcaaagataaaggattccggaacaagtaaacacgattttcaaccgtctcaacaatagaattagatcagaataaggaataaaagtcaatttgttcgagatgagataaagaaaagagtttagagacgactcaaaaaatttcgaagggtttttcttttgaagtttgtcagtcaaaattagccaacttgagtcatgagtataaatgaaatttgttttttattttctttaaggaaattaatgcaagtcataatcgaatttctatctatttgcattatagacagaaattcgaatcattttctcgagccgtatgaggagaaaacctcctatacgtttctaggggggggttgtttatctacatctatcccaataagctatctatcgaatcgttgcaattgatgttcgatctcgaagagaaggaagagatcttcgaaaagtaggtttttatgatccgataaagaatcaaacttgtttaaatgttccagctattctctatttccttgaaaagggtgctcaacctacaagaactgtttatgatattttaaggaaggcagaattctttaaagataaagaaagaactttgagttaattgaagaactaaatgaataaaaaagtaggagagggtccttagtaccccttaattatttagacacaatttgcctctttcttagtcctatttttttttgctgcatttatatcgtgccaatccaacaaaagtccctattttatttcctttttctatctaattacattgtatttccattgacaaaggtctattgaacaaatagaatttgtagatagatgggtctctttattgtcactccatattaggtatttctgtctacacttcgttcaaatgatagggttgcccctcttgcatgtactctcatacaagattattttacttctttaaataaaaattgccaaaaaaatcacaattttgccattgtgattggggctgctcttagccttagtgaaattgaaccggatctgttcattttggtatttgagtgtttttaatggattagaaaatctttcttttgatgtcttgctaattcaatgttttgacaggagcgtccggtgtaatttcatcgatttttagattttgatcgtatctaagagatcctattttatctgggttgctaactcaatggtagagtactcggcttttaagtgcggctatgatcttttacacatttggatgaagcaacaaattcgtccagacttttggtagagtctagaagaccacgactgatcctcaaaggtaatgaatggaaaaaatagcatgtcgtaataaaatcaatttctttttttttataaaaaaaaagaaattgattttctgggtctagtgaataaatggatagagcctggctctaattctggtaaaataaaaaaaaaagcaacgagcttaacttcttaattggttaattggaaggattccccgatctaattagacgttaaaaatagattagtgcctaatgcagggaaaggttaggttttcctatgagtggaccctttactttttttttagaaatcctaattattcttgattatggattgaaaagggatgttatgacttgaatgtgtaaaagaaacagtatattgataaagagactgtattccaaagtcaaaagagcgattggcctgcaaaaataaaagattagttcttgtttgttttgtaattagaacaaacataaactaattagatagaaaaggagcggaaaaagttctatggattagactccctttctttcctgggtttgtattatgcaacaccttgttctgaccatattgcactatgtatcatcatttgataaaccgagaaatgcttttttctctgattcaagtagaaatacaaatggaaaaattcgaagggtattcagaaaaacagaaatctcgtcaacactacttcgtctacccacttctctttcaggaatatatttatgcatttgctcatgattatggattaaatggttccgaacccgtggaaatttttggttgtaataacaagaaatttagttcaatacttgtgaaacgtttaattattcgaatgtatcagcagaatttttggattaattcggttaattatcctaaccaagatcgattgtttgatcaccgcaattatttttattctgagttttattctcagattctatctgaggggtttgggattgttgtagaaattccactctcgctagggcaactatcttgtccagaagaaaaagaaataccaaagtttcaaaatttacaatctattcattcaatatttccctttttagaagacaaatttttgcatttacattatctatcacatatagaaataccctatcctatccatttagaaatcctggttcaactccttgaataccggattcaagatgttccctctttgcatttattgcgattctttctccactattattcgaattggaatagtcttattacttcaatgaaatccatttttcttttgaaaaaagaaaataaaagactatttcgattcctatataactcttatgtatcagaatatgaatttttcttgttgtttcttcgtaaacaatcttcttgcttacgattaacatcttctggaacctttctggaacgaatcatcttttctgggaagatggaacattttggtgtaatgtacccggggttttttcggaaaaccatatggttctttatggatcctcttatgcattatgttcgatatcaaggaaaggcaattcttgcatcaaaaggcactcttcttttgaagaagaaatggaaatcttaccttgtcaatttctcgcaatattttttctctttttggactcaaccacaaaggattcgtctaaaccaattaacaaactcttgcttcgattttctggggtacctttcaagtgtaccaataaatactttgttagtaaggaatcaaatgctggagaattcttttctaatagatactcgaatgaaaaaattcgataccacagtccctgcaactcccctcgttggatccttatcaaaagctcaattttgtactggatcggggcatcctattagtaaacccgtttggactgatttatcagattgggatattctggatcgttttggtcggatatgtagaaatctttttcattatcatagtggatcttcgaaaaaacagactttgtatcgactaaaatatatacttcgactttcatgtgctagaactttagctcgtaaacataaaagtacggtacgaacttttatgcaacgattgggtttggtatttttagaagaattttttacggaagaagagcaagttttttctttgatgttcaccaaaaccaaaacaattcacttttctttccatggatcacaaagtgagcgtatttggtatttggatattatccgtatcaatgacctggtgaatcctcttactcttaattaatcattagacaaaattaataaactagaaaagatcgatatcaagataaaacttgcacattttccattctgaaatgttccatagtaggtgaatcactttaactaattaaaaattctaaaaattagtggacttcctcttcggaatagaaatcggctatttctacatagggaaagtcgtgtgcaatgaaaaatgcaagcacgatttggggaggggttttttctattgtaacaaggaagaattatctactccatccgactagttccgggttcgagtcccgggcaacccatatggaaaatagaaaagagcaatctgagttttgaatttttactaacttcatttccaaaatttttggatttggtaaatgaagttatacgaaaatccaattgttggggctggcttggttgacattggtatatagactatgttatactgttaaataacaagccttctattatctattttctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacattggatggttcggtgttttgatgatccctaccttattgaccgcaacttccgtatttattatcgccttcatcgctgctcctccagtagatattgatggtattcgtgagcctgtttctggttctttactttatggaaacaatattatctctggtgctattattcctacttctgcggcgatcggattgcatttttacccaatttgggaagctgcatctgttgatgaatggttatacaatggcggtccttatgagctaattgttctacacttcttacttggtgtagcttgttatatgggtcgtgagtgggaacttagtttccgtctgggtatgcgcccttggattgctgttgcatattcagctcctgttgcagctgctactgctgttttcttgatttaccctattggtcaaggaagtttctctgatggtatgcctttaggaatatctggtactttcaactttatgattgtattccaggcagagcacaacatccttatgcatccatttcacatgttaggtgtagctggtgtattcggcggttccctattcagtgctatgcatggttccttggtaacctctagtttgatcagggaaaccactgaaaatgagtctgctaatgagggttacaaatttggtcaggaagaagagacttataatattgtggctgctcacggttatttcggtcgattaatcttccaatatgctagtttcaacaactctcgttctttacacttcttcttggctgcttggcctgtagtagggatctggttcactgctttaggtattagtactatggcattcaacctaaatggtttcaatttcaaccaatctgtagttgatagccaaggtcgcgttattaatacttgggctgatatcattaaccgtgctaatcttggtatggaggtaatgcacgaacgtaatgctcacaacttccctctagacctagctgctcttgaagttccatctcttaatggataaggtttttctcctaaacatataggaatttttgaaggaaggaaagccggaaatacccaatatcttgttccaacaggatattgggtatttctttgtttattctgaatctttctattctgaattcaattaacgacgagatttagtatcctttcttgtactttcataactcgtgaaatgccgagtaggcacgaattcccccaatttgcgacctaccataggatttgttatgtaaataggtatatgttcttttccattatgaatcgcgattgtatggccaaccattgcgggtagaatgctagatgcccgggaccacgttactattatttctttctcctccttcatattgaccttttcgatttttgccaataaatgacgagctacaaaaggattcgttttttttcgtgtcacagctgattactcctttttttcattttaaagagtggcatcctatgtccactatctcgatcgaggtatgtaggtcagaataaatagaataataatgaatggaaaaaagagaaaatcctttagctggataaggggcggatgtagccaagtggatcaaggcagtggattgtgaatccaccatgcgcgggttcaattcccgtcgttcgcccatcgcattattgcaatttccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactacggggcgtttacctaaccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagattcttcttttttatcaaaaaaccccttcccaaactgtacaagcttcttccaaagcatacggctttctagatgtatatgacgatctctagacagatggatcttatatgaatcgtatgatgaagtaccacatgagtggatatatagaaaaggaatccaaatccgccgaatcgctcatgttatgatcttctacatcctaggtctccgcgttccgtcatctggcttatgttcttcatgtagcattcagatcgaatgactctatgaaattacgtcgatacttccacatattatgggtaacgtaggagacatccctattttcacccggggttcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatctcttctcaccatccccatagtgtatgagacaaatgtatgcatttcgattagggtcgtattctatggttacgattctaccagatatgtctttttgattccgtcgaaaatcgattttacggtataggcgcttatgacctccccctctatgccttgcggtaatgattcctctggcattacgacctttaccacaacggtgccgtccatggatcaatttatttcgtggattggatttcacttgcctgtctacggttcccttgcgtgtgctcgggataggtgttttgtataaatgtttcgccgtattattaagtattctcctttagttcgtttctctatctagaagtggaatagaataacccggttgaagggtaatgatcatacgtctgtaatgcattgtatgtcccagaataggtcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagactcttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagaccgttcccgttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaaaacctctctggatcctcgaattgaaagagagattgagagggatcaagaatcctaattctcgctatttggaatggatccaattctattgagtctgacccatagtgatcatttctctttagcaaagaatgaccttggttatcaaaggattgaacaaccgagatccatttacttatgatacctagttgacattgctaacaaggatctaatgaattatgagtttaatagatcctctttagcagaaagacgtatattccttgctcattatcagacaatcacttattcccaaacctcgtgtggggctaatcgttttcatttaccatctcatggaaaacccttttcgttccgcttagccctatcgggtattttagtgataggttctataggaactggacgatcctatttggtcaaatacctaacgaaaaattcctattttcctttcattaaggtacgagggcttcttattccacaagaacgaaagcaccttttcattctttcatatactaggggtttttacttggaaaagacaatgttccatactaaaggattcgggtccataaccacgagttccagtgcactagatcttgtagcacttagcaacgaggccctatccattagtattccacataagaaatccattatagaaactaatacaattagattagctcttcatagacaaacttggggtttgcgagccaagataagaccggctcgggatcatgggacccttttctatcagataggaggggatcttgtacaaaatagacttctaagtaataaccccatagatcctatatctatctatataaagaggcaatcgtgtcaggaagcggctttttctttggccaaacggtacttcgaacttggaacgagcatgaagagattaacgagacttctttctcttttgagtttttctggcggaccggtcgcgcaagatctttggtcttcccccggaaccgatgaaaaagtgggtcgcttcttatggactcgctcagaatgattcttctctatctatagttcatggcctattagaagtagaaggtgctctggtgcaatccttaccgacagaaaaagattgcagtcgggttgataataatcgagtgccattacttcgtcggtccgaaccaaggaatccgttagaaatgttttgaaatggatattgttctctctttgattagggatgctatatgaaaagaagtggagtttgaaaaagggaacggaatggtcaaaccggaactgctagaggaacgaattttcaatagcataacttgggctcctagaatatggggcccttgggacaatctatttgattgcagggacaggtacgctgaatatgactggggattttcctatgggtattggagcgggtcatttctggtatatttatcataaaaagggggaggtgcaagagactgattcggacttcttgcagagtggaacaatgcagtaccagacacgagatatatctttcaaagaagaaggcttttttcgaataagccaattgatttgggaccttcggatccattctttttcctattcaaagatcaggcctttgtctctgtgttttcacgtcgagaattctttgcagatgaagatgaagagatggcaaagcggcttagtaccagtacctggagaaaaaagcctcctaaacatatggctagcaactggttcatcaggagtacgcaagaaaggcaaaagcactacgaattagtgatttaggaatgggaatgggctagaaccctgggttcttccttatataattaatggtcttttcattctaatactctatccgagagttctcagtatttagcaaagctgttcctatctaacggaaggctcctggatcaaatgacaaagacattgtttgtggagaaagaggtggcttttcccggatgaaatgaaacatttcatttgtgtaacaggagaaagatttcccactccttagccgtaaagatatgtggccatgaaaaagggaggggattcagtggaacaggattggccgggcggtagagtcgtggaaacacttgttgattcctattttggaccctagctccatggaacaatatgctactgcggaaacatggaagaattgcaatcttagatcaaaacactatgtatgggatgatatgaactgcctaaataagaattcttgagcgtcgaataacctgagtactaactacatcaaacaatttgcattaatgaaactgtgtaaatccaccggataatcaaaaatacgcatgtctgatgaaatggttgttgctatctgtttccataacgaatccttggtttaactgaataagtaaagaaaatgggccctttctcttcgtctcagatcgatggatcttctcgattggaagatctcccatatggataatacacattccagttgaccgagcctaatgctaattgttttgttccgaagcaaagatatccgcggaggccggttcgttcgtcctattctgatattcaggaccaagaggtcctggattctctttcggataggccctgaaaggagaagagaagctgaaatgccaacggacctctgtctattctctaattcacccgatccgatagtacccgtttttggaacgtccagtgccaaagtcactgaatgggtaagtcaccaatccaatccctttgacaaatcgggtgtcatattagatatcatattctatatatatagaaatatcata

SEQ ID NO: 4704 - DNA, 1071 bp, Sorghum bicolor
gaggagaggatggatccgacctctagctcttgacttttactgcctgtgcagctaaggaaagacaactacacttccaagtcctaagagaatactagtatacgatctgttatataaataggtaaatgttcctttccattatgaatcgcgattgtatggccaaccattgcgggtagaatgctagatgcccgggaccacgttactattatttctttctcctccttcatattgaccttttcgatttttgccaataaatgacgagctacaaaaggattcgttttttttcgtgtcacagctgattactcctttttttcattttaaagagtggcatcctatgtccactatctcgatcgaggtatgtaggtcagaataaatagaataataatgaatggaaaaaagagaaaatcctttagctggataaggggcggatgtagccaagtggatcaaggcagtggattgtgaatccaccatgcgcgggttcaattcccgtcgttcgcccatcgcattattgcaatttccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactacggggcgtttacctaaccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagattcttcttttttatcaaaaaaccccttcccaaactgtacaagcttcttccaaagcatacggctttctagatgtatatgac

SEQ ID NO: 4705 - DNA, 1096 bp, Setaria italica
caacaggatattgggtatttctttgtttattctgaatctttctattctgaattcagttaacgacgagatttagtgtcctttcttgcactttcataactcgtgaaatgccgagtaggcacgaattcccccaatttgcgacctaccataggatttgttatgtaaataggtatatgttcctttccattatgaatcgcgattgtatggccaaccattgcgggcagaatgctagatgcccgggaccacgttactataatttctttctcctccttcatattaaccttttcgatttttgccaataaatgacgagctacaaaaggattcgtttttttcgtgtcacagctgattactccttttcttcattttaaagagtggcatcctatgtccactatctcgatcgaggtatggaggtcagaataaatagaataatgatgaatggaaaaaagagaaaatcctttagctggataaggggcggatgtcgccaagtggatcaaggcagtggattgtgaatccaccatgcgcaggttcaattcctgtcgttcgcccatcacattattgcaaattccaaaaatgcaattttccatattcctagttacgtatttacttacggcgacaaagaataaaactatcactatatttttttccttttcctagttcttcttccaagcgcaggataaccccaaggggttgtgggtttttttctaccaatgggggctttcccttcaccgcccccatgggggtggtccacaaggttcataactacccctcttactacggggcgtttacctagccaacacttagatccggctctacccaaacttttttggttcaccccaacattacccacatgtccgactgttgctaagcagttttgggataccaaacggacctccccagattgtaatcttaaagtggccaatttaccctcttttgcaatcagtttcgctacagcacctgctgctctagctaattgcccaccacttccatgtgtgatttctatgttatgtatggccgtgcctaagggcatatcggttgaagtagattcttcttttttctcaaaaaaccccttcccaaactgtacaagcttcttccaaagcat

SEQ ID NO: 4706 - DNA, 6883 bp, Brachypodium distachyon
aacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcaggattcactaagacagaaataaagcattgggtcgaactcttctttggtgttaaggtagtagctgtgaatagccatcgactacccggaaagggtagaagaataggacctattctgggacatacaatgcattacagacgtatgatcattacccttcaaccgggttattctattccacttctagatagagaaaaaaactaaaggagaatacttaataatacggcgaaacatttatacaaaacacctatctcgagtacacgcaagggaaccgtagacaggcaagtgaaatccaatccacgaaataatttgatccatggacggcaccgttgtggtaaaggtcgtaattccagaggaatcattaccgcaaggcatagagggggaggtcataaacgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactactgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagaccttaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagagtaggacgggttattcacatttaatttgatggtcagaggcgaattgaaagctaagcagtggtaattaagacccccggggaaaaaagggatgtctcctacgttacccataatatgtggaagtatcaacgtaatttcatagagtcattcgatctgaatgctacatgaagaacataagccagatgacggaacgcggagacctaggatgtagaagatcctaacatgagcgattcggcagatttggattcctttcctatatatccactcatgtggtacttcatcatatgatttatataagatccatctgtctagagatcgtcatatacatctagaaagccgtatgctttggaagaagcttgtacagtttgggaaggggttttttgagagaaaagaagaatctacttcaaccgatatgcccttaggcacggccatgcataacatagaaatcacacgtggaaggggtggccaattagctagagcagcaggtgctgtagcgaaacttattgcaaaagagggtaaatcagccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcattttttgcatttgcaataatgcgatgggcgaacgacgggaattgaacccgcgcatggtggattcacaatccactgccttgatccacttggctacatccgccccttatccagctacaggatttttctcttttttccattcatcattattctatttattctgacctccatacttcgatcgagatattggacatagattgccgctctttaaaaaggaaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccccaatggttggccatacaatcgcgattcataatggaaaggaacatatacctatttacataacaaatcctatggtaggtcgcaaattgggggaattcgtacctactcggcatttcacgagttatgaaaatgcaagaaaggatactaaatctcgtcgttaactgaattcagaatagaaagattcagaataaaaaaaaagaaataggtaagcggggaataaccttatttatgacaagtttcaaactggtaaagtatacccctaggataaagaagaagaagagtgggctaaggaaactcgcaagaaaagtaccaaccgatcgtctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggcagcagcaaatgctactcattatagggatttcgacaaagcaaatttattcatcactaaagccgaagtcagtaggagtactattatgaataaattcagacctcgggctcgaggacgtagttctcccataaaaaaaaaccatgtgtcatataacaattgtactaaatatagtaaagaaatcgaaataatctttagatccatctaagatttgattcccggtaaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgaatgcatcaaaaaaggtagacttcccctccaaacaattcgcgctaaaattgattattgctgctatccaattcgaactatctatggagtattaggagttaaaatttggatattcgtagacgaagaataaccaaccctgtcttcccattctgttcagtaatagaataaaaaatgacaagagacttattttccctaaaatccctgaaaaaaagaagaaattctacctctttctataagatttaatgaaaattgagaaatcttttaataaaattgctatgcttagtgtgtgactcgttagtttttttttagggttcaaaaaggggattaaaaaaaaatagaatgaaccctactatgtaattatagaaaatgaactaataaccaacctattgcttcgtattgtcgagatcctaactaagaaacagtcactatatgaataaatacatctatcataaatgagtaaatctatcatatacgtgtagcaactgcaattttttctttaaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattcgaaatcgtaatttgattgaaacaagaaatacaaatttcaaggaataacaaagagtgtcccgagttaataaaactgagaaattgactcggaaagaaattttttggaagctccattgtgagattcaaacctaaccattaaaggagaagcagtgggaacgacagaacctatgactggataggattttcttgaaaagaatcccaatacttcattgggtgggatggcggaacaaaccaaaaaaattgtcttatttgataaggttataaattaacaaataagacaggaaagagtaaatattcgcccgcgaaatttttattgaattagaatactttaccgcgattcaataagagtaaaataaaaaaaggagattaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttcattcacgaggagctggatgagaagaaactctcatgtccagttttgcagtagagatggaactaagaaagaaccattgactataaccccaaaagaaccagatttcgtaaacaacatagaggaagaatgaaaggaaaatcctaccgaggcaattgtatttgttttggtagatatgctcttcaagcacttgaacctacttggattacagcgagacagatagaagcaggacgaagagcaataacacgatatgcacgtcgtggtggaaaaatatgggtacgtatatttcccgacaaaccggttacaataagacccacagaaacacatatgggttcaggaaagggatcccccgaatattgggtagccattgttaaaccaggtcgaatactttataaaatgggcggagtatccgaaactatagctagagcagctatttacatagctgctagtaaaatgtcaatacgaagtcaatttattcgattagaaatatagacccccgccaaaaaagtagtattgaaaataaaaaaccaggttcttctttctggaaagacaatatttctttcatccttttgcattgaaataataaattgaaatcaaaataatatgattcaacctcagacccttttaaatgtagcagataacactggagctcgaaaattaatgtgtattcgagtcataggagctgctagtagtcagcgatatgctcgtattggtgatgttattgttgctgtaatcaaagacgtagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacgtgttgattatagaaaaattaggaggaacctagaattagagtcttatgggcaaggacactattgctgatttactaacctctataagaaactcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagtgtatcagccgacctggcttacgaatttatgccaactatcaaggaattcctaaggttttgggcggaatgggaattgctattctttctacttctcgaggtataatgacagatcaagaagctcgactaaacagaattgggggagaagtcttatgttatatatggtaatcgcctcgcccatagcggtaatcgccccacctatagttatagtacccaaattctatcttgaacttccaaggtccaacaaggttggtcgcagtctgaacaatagcaagggcatccggaacggcttggcgacattgtggacaccgagcgaatggcgacggcgtgcttcggcaaacgatcggagagcgggggatcgacgttggaagccagtggccggagttggagaagaaaaccccgatctcctcatcgctgcatccccaaccaaggaagataggggcgttgtagagggcggttttcaggatggtgatggcgcaagggttcagccggatctgcacttggaagctttctgtcttggtttcaactgctgagacatgaacgtggaagacgagaaatggttcagggagcttaggggatgtaggcaagttctccatagaggcgtcggtgggggtgaagtggaggccgggctggagctttgccgacgtggcatgaaggagcttccacgacgtcttccgcgtcaatgaccaggtcaatatgaccaaaaggcgcaaggtcat

SEQ ID NO: 4707 - DNA, 3033 bp, Brachypodium distachyon
ggttattttggcaataaaatcctatggagtcataggttctgtcgttcccactgcttctccttgactgttaggtctgaatcccgcaacggagcttcaaaaaaatgtctttccgagttaattttctcagttaatggattcaatttcaaccaatctgtagttgatagtcaaggtcgcgttattaagttacgatttctaattctctgttatttttattatattatattgatgctttatcacattgccttttttgatgcaattcatagaccatacatattggaatcctatatcttacttattcttctttctatcatctttccctttatctacatccctttagttttgcttcagaacctagaatctcgtttcttttttagagaaaaaattgcagttgctacaactatatgatagatctactcatttatgatagagatatttattcagatagtgactgcttcttagttaggatctcgacaatacgaagcaataggttggttattagttaattttctataattactaaattttttctttaaaaaaagaaaaaaataacgagtcacatactaagcatagcaattatattaaatgatttatcaattttcattaaatcttatagaaagaggtataatttcttctttttttagggatttcgggaaaaaaggctcttgtcattttttattctaccactgcacagaatgcgaagacagattagttattcttcatctacgaatatccaaatttttacacctaatactccatagatagttcgaattggatagcaacaataatcaattttagcgcgaattgtttggagaggaagtctaccctttttgatgcattccgcacgtgcaatttcttttcctccgagacgacccgctatttttactttgactccccttatatctgcttttttagttaattcaatggctttttttattgcctttcggaatgaaactcgattttttaattgaaaagctatatattctgcaagaatgttaggttgtctataaggctctttactttttcgatagaaatattaagtctctggtttacagagttaatttctttttgtagatctttctctaattcttcgattactccctttttctttaataaatttggaaatcctatatggattatgacgtggatcgtatcaatttctttttgatttctatatgtgtaattacttcggaacttgagtctgattctatttttctattcgagccctttttcctatttttttgtatatagttcttgatacaattccttatttttttatcttcctgtagaccctcagaataattttttggttgtgcgaaccaaaaggaatggtgtttttgggttgtaccaattctgaaaccaagtggatttattttttgtcccatatttttctattctatttttttttactgggaatcgaaatcttagctggatctaagggttatttagatctctttactatatttagtgcaattgttatatgacacatgcttttttttatggggaaactgcgccctcgagcccgaggtctgaattttttcataatagtacttctactgacttcggctttagttatgaataaattcgctttgtcgaaatccctataatgagcagcatttgctgctgccgaataaaccaactttaagatgggataagatgctcgataaggcatgaggttcagtatcataacggtcgcgttattaatacttgggctgatatcatcaaccgtgctaatcttggtatggaagtaatgcacgaacgtttttgtgctttgaaaactcgctcgaacttaagtagacgatcggttggaactttccttaaggtttttccgctaacatataagaatttttgaagaaaagaaagcgagaaatacccaatatcttgttctaccaagatattgggtatttctttactttgcatcttttttttattctgaatctttctattctgaattcagttaacgacgagatttagtatcctttcttgcattttcataactcgtgaaatgccgagtaggtacgaattcccccaatttgcgacctaccataggatttgttatgtaaataggtatatgttcctttccattatgaatcgcgattgtatggccaaccattgtgggtagaatgctagatgcccgggaccacgttactattgtttctttctcctccttcatattgaccttttctatttttgccaataaatgatgagctacaaaaggattcgttttttttcgtgtcacagctgattactcctttttttcctttttaaagagcggcaatctatgtccaatatctcgatcgaagtatggaggtcagaataaatagaataatgatgaatggaaaaaagagaaaaatcctgtagctggataaggggcggatgtagccaagtggatcaaggcagtggattgtgaatccaccatgcgcgggttcaattcccgtcgttcgcccatcgcattattgcaaatgcaaaaaatgcaattttccatattcctagttacgtatttacttacggcgacgaagaataaaactatcgctatattttttccttttcctagttcttcttccaagcgcaggataaccccaaggggttgtgggtttttttctaccaatgggggctttcccttcaccgcccccatgggggtggtccacagggttcataactacccctcttactatggggcgtttacctagccaacacttagatccggctctacccaaacttttttggttcaccccaacattacccacttgtccgactgttgctaagcagttttgggatactaaacggacctccccagatggtaatcttaaagtggctgatttaccctcttttgcaataagtttcgctacagcacctgctgctctagctaattggccaccccttccacgtgtgatttctatgttatgcatggccgtgcctaagggcatatcggttgaagtagattcttcttttctctcaaaaaaccccttcccaaactgtacaagcttcttccaaagcatacggctttctagatgtatatgacgatctctagacaga

SEQ ID NO: 4708 - DNA, 906 bp, Eragrostis curvula
  misc_feature (40)..(40): n is a, c, g, or t
  misc_feature (481)..(481): n is a, c, g, or t
  misc_feature (488)..(488): n is a, c, g, or t
gaagaaaaagagaaaaaagaaagaaaaagaggggagggcntgtcggactattgttaagatgcatataatctagaaagcgtatgttggaagaagctgtacagtttgggaaggggttttttgagaaaaaagaagaatctattcaaccgatatgccttaggcacggccatacataacatagaaatcacacgtggaaggggtgggcaattagctagagcggcgggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccccgtggaccacccccatgggggcggtgaagggaaagcccctattggtagaaaaaaanccacaancccttggggttatccagcgcttggaagaagaactaggaaaaggaaaaaatatagtgatagttttattcttcgtcgtcgtaagtaaatacgtaactaggaatatggaaaattgcattgcaataatgcgatgggcgaacgacgggaattgaacccgcgcatggtggattcacaatccactgccttgatccacttggctacatcccgcccttatccagctaagggatttctatgttgtccactcatcattattctaataattctgacctccatacttcgatcgagatagtgaccatagatgccgtctttaaatagaaaaaggataacagtggacgaaaaaacaatctttgtgctcgtatatgcaaaatgaaaggtacttaggagaataaaatatactggccaggataactttaggaggggg

SEQ ID NO: 4709 - DNA, 3558 bp, Zea mays
gagaagcaaattgttggagcagcacaggatcggagcacctgtttcagagagagacggtatcacattattgatgtcagagcgatgaaagtagcagtgtattaaagacccccgggtggaaatagggatgtctctacgttacccataatatgtggaagtatcgacgtaatttcatagagtcattcgatctgaatgctacatgaagaacataagccagatgacggaacgcggagacctaggttgtagaagatcataacatgagcgattcggcggatttggattccttttctatatatccactcatgtggtacttcatcatacgattcatataagatccatctatctagagatcgtcatatacatctagaaagccgtatgctttggaagaagcttgtacagtttgggaagggttttttgagaaaaaagaagaatctacttcaaccgatatgcccttaggcacgaccatacataacatagaaatcacacgtatatggggtgggcatttagctagagtagcaggtgctgtaacaaaactgattgcaaaagagggtaaattggccactttaagattaccatctggggaggtccgtttggtatcccaaaactgcttagcaacagtcggacaagtgggtaatgttggggtgaaccaaaaaagtttgggtagagccagatctaagtgttggctaggtaaacgccctgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcaccgtaagtaaatacgtaactaggaatatggaaaattacatttttggaatttgcaataatgcgatgggcaaacgacgggaattgaacccgcgcatggtggattcacaatccactgccttgatccacttggctacatccgccccttatccagctaaaggattttctcttttttccatccattatttattctatttattctgacctccatacctcgatcgagatagtggacataggatgttactctttaaaatgaaaaaaaggagtaatcagctatgacatgaaaaaaacgaatccttttgtagctcgtcatttattggcaaaaatcgaaaatgtcaatatgaaggaggagaaagaaataatagtaacgttgtcccgggcatctagcattctacccgcaatcgttggccatacaatcgcgattcataatggaaacgaacatatacctatttacataacaaatcctatggtaggtcgcaaattgggggaattcgtgcctacttggcattttacgagttatgaaagtacaagaaaggatactaaatctcgtcgttaattgaattcagaatagaaagattcagaataaacaaaatttataggattcaaataatcaaataaagtaaaggtaggcgggtaataaccttatttatgacaagtttcaaattggtaaagtataaccctaggataaagaagaagaaggggctgagaaaactcgcaagaaaagttccaaccgatcgtctacttaaattcgaacgggttttcaaagcacaaaaacgcatatgtctgttttcaaagcacaaagagttctagatgagattcactgacgttactacgaggaaactgttatggtactgaatcttatgccttatcgagcccatcttaaagttggtttattcggcagcagcaaatgctactcattatagggatttcgacaaaacgaatttattcatcactaaagccgaagtcagtaggagtactattatgaaaaaattcagacctcgagctcgaggacgtagttatttctatataaaaacgatgtgtaatataacaattataataaatatagtaaagaaatcaaaataatctttagatcaatctaagatttcgattcccagtaaaaaaggaaatataatagaaaaatatgggacaaaaagataaatccactcgggtttcagacttggtacaaccaaaaatcaccattccttttggttcgcacaaccaaaaaattattctgaaggtctataggaagataaaaaaaatacagaattgtatcaagaactatatacaaaagaataggaaaaaaggctcgaatagaaaaatggaatcagactcaagttctgaagtaattacacatatagaaattcaaaaagaaattgatacaatccacatcataatccatattggattcgccaacttattaaaggaaaagggagcaatcgaagaattagagaaagatctccaaaaggaagttaattctgtaaaccagagacttaatattgctatcgaaaaggttaaagaaccttatagacaacctaatattcttgcggaatatatagctttccaattaaaaaatagagtttcattccgaaaagcaatgaaaaaagctattgaattaactaaaaaagcggatataaagggaataaaaatccaaattgcgggtcgtctagcaggaaaagaaattgcacgggccgaatgcataaaaaaggatagactacccctccaaacaattcgctctaaaattgattattgctgctatccaattcgaactatctatggagtattaggtgtcaaaatttggatatccgtagaagaagaataactaaccatgtcttcccattccgcccagtgatagaataaaaaagacaagaaccttgtttttccaaaaatccctaaaaaaagaagaaagtatccctctttgtataagatttaatgaaaattaagaaatcttttaatataattgctatgcttagtgtgtgactcgttagtttttttctttagggtcaaaaatggaaaaaaacttagtaatgatagaaaattaactaataaccaacctattgcttcgtattgtcgagatcctaactaagaaacagtcactatgtaaataaatacatctatcaaaatgagtagatctatcatatagttgtagcaactacatttttttctctacaaaagaaacctgattctaggctgtgaagcaaaactaaagggatgtggataaaaggagagatgatagatagaaggaagaagaacaagaaagatataggattcccatatgtatggtctatgaattacatcataaaaaaaggcaatgtgataaagcatcaatataataaaattctcaaaaaaagagagaattcgaaatcgtaacttgacttttgaaacaacaaataaaaatataaagtaataaataaagagcagcccggttaataaaactgagaaaattgactcgggaaaaaaattggaagctccattgcaggattcaaacctaaccattaaaggagaagttgtgggaaagacaaaacctatgactacataggattttattgaaaagaatcctaacacttcattgggtgggatggcggaacaaaccaaaaaaattgctttatttgataaggttctaaattaacaaataagacaggaaagagtaaatattcgcccgcgaaatccttattggattagaatactttaccacgattcaaacaa

SEQ ID NO: 4710 - DNA, 6504 bp, Zea mays
ccaaaaattctatatgtctattctatgatatttctatatatatagaatatgatatctaatatgacacccgatttgtcaaagggattggattggtgacttacccattcagtgactttggcactggacgttccaaaaacgggtactatcggatcgggtgaattagagaatagacagaggtccgttggcatttcagcttctcttctcctttcagggcctatccgaaagagaatccaggacctcttggtcctgaatatcagaataggacgaacgaaccggcctccgcggatatctttgcttcggaacaaaacaattagcattaggctcggtcaactggaatgtgtattatccatatgggagatcttccaatcgagaagatccatcgatctgagacgaagagaaagggcccattttctttacttattcagttaaaccaaggattcgttatggaaacagatagcaacaaccatttcatcagacatgcgtatttttgattatccggtggatttacacagtttcattaatgcaaattgtttgatgtagttagtactcaggttattcgacgctcaagaattcttatttaggcagttcatatcatcccatacatagtgttttgatctaagattgcaattcttccatgtttccgcagtagcatattgttccatggagctagggtccaaaataggaatcaacaagtgtttccacgactctaccgcccggccaatcctgttccactgaatcccctccctttttcatggccacatatctttacggctaaggagtgggaaatctttctcctgttacacaaatgaaatgtttcatttcatccgggaaaagccacctctttctccacaaacaatgtctttgtcatttgatccaggagccttccgttagataggaacagctttgctaaatactgagaactctcggatagagtattagaatgaaaagaccattaattatataaggaagagcccagggttctagcccattcccattcctaaatcaataattcgtagtgcttttgcctttcttgcgtactcctggtgaaccagttgctagccatatgtttaggaggcttttttctccaggtactggtactaagccgctttgccatctcttcatcttcatctgcaaagaattctcgatgtgaaaacacagagacaaaggcctgatctttgaataggaaaaagaatggatccgaaggtcccaaatcaattggcttattcgaaaaaagccttcttctttgaaagatatatctcgtgtctggtactgcattgttccactctgcaagaagtccgaatcagtctcttgcacctccccctttttatgataaatataccagaaataattcgaataaatagcagtctctgacaactcatcctctttaatctgcttggacccgctccaatacccataggaaaatccccagtcatattcagcgtacctgtccctgcaatcaaatagattgtcccaagggccccatattctaggagcccaagttatgctattgaaaattcgttcctctagcagttccggtttgaccattccgttccctttttcaaactccacttcttttcatatagcatccctaatcaaagagagaacaatatccatttcaaaacatttctaacggattccttggttcggaccgacgaagtaatggcactcgattattatcaacccgactgcaatctttttctgtcggtaaggattgcaccagagcaccttctacttctaataggccatgaactatagatagagaagaatcattctgagcgagtccataagaagcgacccactttttcatcggttccgggggaagaccaaagatcttgcgcgaccggtccgccagaaaaactcaaaagagaaagaagtctcgttaatctcttcatgctcgttccaagttcgaagtaccgtttggccaaagaaaaagccgcttcctgacacgattgcctctttatatagatagatataggatctatggggttattacttagaagtctattttgtacaagatcccctcctatctgatagaaaagggtcccatgatcccgagccggtcttatcttggctcgcaaaccccaagtttgtctatgaagagctaatctaattgtattagtttctataatggatttcttatgtggaatactaatggatagggcctcgttgctaagtgctacaagatctagtgcactggaactcgtggttatggacccgaatcctttagtatggaacattgtcttttccaagtaaaaacccctagtatatgaaagaatgaaaaggtgctttcgttcttgtggaataagaagccctcgtaccttaatgaaaggaaaataggaatttttcgttaggtatttgaccaaataggattgtccagttcctatagaacctatcactaaaatacccgatagggctaagcggaacgaaaagggttttccatgagatggtaaatgaaaacgattagccccacacgaggtttgggaataagtgattgtctgataatgagcaaggaatatacgtctttctgctaaagagaatctattaaactcataattcattagatccttgttagcaatgtcaactaggtatcataagtaaatggatctcggttgttcaatcctttgataaccaaggtcattctttgctaaagagaaatgatcactatgggtcagactcaatagaattggatccattccaaatagcgagaattaggattcttgatccctctcagtctctctttcaattcgaggatccggagaggtgttttcatagtcatctccgaatatttgtcatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaacgggaacggtctattggaattggctctctatccatggaatctcatccatcatccatacataacgaattggtatggtatattcataccataacataagaacaataagaactcgaattcttatcgatactggaactcagagcataggggggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagttaagcagtggtaattaagacccccgggtgaaaatagggatgtctcctacgttacccataatatgtggaagtatcgacgtaatttcatagagtcattcgatctgaatgctacatgaagaacataagccagatgacggaacgcggagacctaggatgtagaagatcataacatgagcgattcggcggatttggattccttttctatatatccactcatgtggtacttcatcatacgattcatataagatccatctgtctagagatcgtcatatacatctagaaagccgtatgctttggaagaagcttgtacagtttgggaaggggttttttgagaaaaaagaagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttctcttttttccattcattattattctatttattctgacctccatacctcgatcgagataggggacataggatgccactcttaaaaatgaaaaaaaggagtattcagctgtgacaggaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaagaaatacccaatatcctgttggaacaagatattgggtatttccggctttccttccttcaaaaaattcctatatgtttaggagaaaaaccttatccattaaggtaaggaacttcaagagcagctaggtctagagggaagttgtgagcattacgttcgtgcattacctccataccaagattagcacggttgatgatatcagcccaagtattaataacgcgaccttggctatcaactacagattggttgaaaatgaaaccatttaggttgaatgccatagtactaatacctaaagcagtgaaccagatccctactacaggccaagcagccaagaagaagtgtaaagaacgagaattgttgaaactagcatattggaagattaatcgaccaaaataaccgtgagcagccacaatattataagtctcttcttcctgaccaaatttgtaaccctcattagcagactcattttcagtggtttccctgatcaaactagaggttaccaaggaaccatgcatagcactgaatagggaaccgccgaatacaccagctacacctaacatgtgaaatggatgcataaggatgttgtgctctgcctggaatacaatcataaagttgaaagtaccagatattcctaaaggcataccatcagagaaacttccttgaccaatagggtaaatcaagaaaacagcagtagcagctgcaacaggagctgaatatgcaacagcaatccaagggcgcatacccagacggaaactaagttcccactcacgacccatataacaagctacaccaagtaagaagtgtagaacaattagctcataaggaccgccattgtataaccattcatcaacagatgcagcttcccaaattgggtaaaaatgcaatccgatcgccgcagaagtaggaataatagcaccagagataatattgtttccataaagtaaagaaccagaaacaggctcacgaataccatcaatatctactggaggagcagcgatgaaggcgataataaatacggaagttgcg

SEQ ID NO: 4711 - DNA, 753 bp, Brachypodium distachyon
ccgtatgctttggaagaagcttgtacagtttgggaaggggttttttgagagaaaagaagaatctacttcaaccgatatgcccttaggcacggccatgcataacatagaaatcacacgtggaaggggtggccaattagctagagcagcaggtgctgtagcaaaacttattgcaaaagagggtaaatcagccactttaagattaccatctggggaggtccgtttagtatcccaaaactgcttagcaatagtcagacaagtgggtaatgttggggtgaaccaaaatagtttgggtagagccggatctaagtgttggctaggtaaacgccccatagtaagaggggtagttatgaaccctgtggaccacccccatgggggcggtgaagggaaagcccccattggtagaaaaaaacccacaaccccttggggttatcctgtgcttggaagaagaactaggaaaaggaaaaaatatagcgatagtgttattcttcgtcgccgtaagtaaatacgtaactaggaatatggaaaattgcattttttgcatttgcaataatgcgatgggcgaacgacgggaattgaaccagcgcatggtggattcacaatccactgccttgatccacttggctacatccgccccttatccagctacaagatttttctcttttttccattcatcattattctatttattctgacctccatactttgatcgagatattggacatagattgccgctctttaaaaaggaaaaaaaaa

SEQ ID NO: 4712 - DNA, 1119 bp, Sorghum bicolor
atgctttggaagaagcttgtacagtttgggaaggggttttttgataaaaaagaagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggttaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaaattgcaataatgcgatgggcgaacgacgggaattgaacccgcgcatggtggattcacaatccactgccttgatccacttggctacatccgccccttatccagctaaaggattttctcttttttccattcattattattctatttattctgacctacatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaggaacatttacctatttatataacagatcgtatactagtattctcttaggacttggaagtgtagttgtctttccttagctgcacaggcagtaaaagtcaagagctagaggtcggatccatcctctcctctattaggctaggctgagcagcactttgcgcattcaatacggcactatttgaaactgggctatttgaacctg

SEQ ID NO: 4713 - DNA, 539 bp, Oryza sativa
tcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaacaaatatagtgatagttttattcttcgtcgccgtacgtaaatacgtaactaggaat

SEQ ID NO: 4714 - DNA, 522 bp, Oryza sativa
tcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaatacccacaaccccttggggtatcctgcgcttggaagaagaactaggaaaaaaaaaaaatatagtgatagttttattcttcgtcgccgtaagtaaata

SEQ ID NO: 4715 - DNA, 2481 bp, Elaeis guineensis
gtatattcataccataacatatgaacagtaagaactagaattcttatcgatactggaactcatagggaagaaaatggatttatggatggaatcaaatatgcagtatttacagaaaaaagtattcggttattggggaacaatcaatatacttttaatgtcgaatcaggattaactaggacagaaataaagcattgggtcgaactcttctttggtgtcaaggtaatagctatgaatagttatcgactcccgggaaagggtagaagaatgggacctattatgggacatacaatgcattacagacgtatgatcattacgcttcaaccgggttattctattccacctcttatagagaaaagaacttaaagcaaaatacttaataacacggcgatacatttatacaaaacttctaccccgagcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgcctataccgtaaaatcgattttcgacggaatgaaaaagacatatccggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgagtgcggtttgaactattgatttacgtaattggaagtaaccaattaggtttacgatgaaacctagaaatcgatcactgatccaatttgagtacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagatcccccgggggaaaaagagagatgtctcctacgttacccgtaatatgtggaagtatcgacgtaatttcatagagtcattcggtctgaatgctacatgaagaacataagccagatgacggaacggggagacctaggatgtagaagatcataacatgagtgattcggcagatttggattcctatatatccactcatgtggtacttcatcatacgattcatataagatccatctgtctagatatcatcatatacatctagaaagccgtatgctttggaagaagcttgtacagtttgggaaggggtttttattgataaaaaagaagaatctacttcaaccgatatgcccttaggcacggccatacataacatagaaatcacacttggaaagggtggacaattagctagagcagcaggtgctgtagcgaaactgattgcaaaagagggtaaatcggccacattaagattaccatctggggaggtccgtttgatatccaaaaactgcttagcaacagtcggacaagtgggtaatgttggggtgaaccaaaaaagtttgggtagagccggatctaagtgttggctaggtaagcgtcctgtagtaagaggagtagttatgaaccctgtagaccatccccatgggggcggtgaagggagagccccaattggtagaaaaaaacccacaaccccttggggttatcctgcgcttggaagaagaagtaggaaaaggaaaaaatatagtgatagttttattcttcgtcgccgtaaataggaatattgaaaatcgaattttttttggaatttgaaataatgtgatgggcgaacgacgggaattgaacccgcgcatggtggattcacaatccactgccttgatccacttggctacatccgccccttatctagctaaaggattttctcttttttccattcatcattattgtatttattctgacctccatacttagatcgagatattggacatagaatgccaatctttaaaatgtaaaaaaaaggagtaatcagctgtgacacgttcactaaaaaaaaatccttttgtagctaatcatttagcgggaaaaattgaaaaactcaacatgagggaggagaaagaaataatagtaacttggtctcgggcatctaccattatacccacaatgattggccatacaatcgctattcataatggaaaggaaaatttacctatttatataacagatcgtatggtaggtcacaaattgggagaattcgcgcctactctgactttcgcgagacatgcaagaaacgacaataaatctcgtcgttaaattattaaaattttaataatatttttgaatattaaataataatagaaatattattaatataaataaaaaaagtaaaataaaata

SEQ ID NO: 4716 - DNA, 2798 bp, Elaeis guineensis
tgagtgaaagatcccactgaatcgaatttgatccatgaatctaagaaatagtgagaattcttgatctctctcaatatctctctcaattcgaagatccaggattgaattgatgtccttcattgattcctcctaaagatttcatttcaattggaatttggttattcacgatgtacgatgatcccttttaagcatccatggctgaatggttaaagcgccccaactcataattggcaaattcgtaggttcaattcctgctggatgcacaccaatgggaacgttcaataagtctattggaattggctctgtatcaatggaatctcatcatccatacataacgaattggtatattcataccataacatatgaacagtaagaactagaattcttatcgatactggaactcatagggaagaaaatggatttatggatggaatcaaatatgcagtatttacagaaaaaagtattcggttattggggaacaatcaatatacttttaatgtcgaatcaggattaactaggacagaaataaagcattgggtcgaactcttctttggtgtcaaggtaatagctatgaatagttatcgactcccgggaaagggtagaagaatgggacctattatgggacatacaatgcattacagacgtatgatcattacgcttcaaccgggttattctattccacctcttatagagaaaagaacttaaagcaaaatacttaataacatggcgatacatttatacaaaacttctaccccgagcacacgcaatggagccgtagacagtcaagtgaaatccaatccacgaaataatttgatctatggacagcatcgttgtggtaaaggtcgtaatgccagaggaatcattaccgcaaggcatagagggggaggtcataagcgcctataccgtaaaatcgattttcgacggaatgaaaaagacatatccggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgagtgcggtttgaactattgatttacgtaattggaagtaaccaattaggtttacgatgaaacctagaaatcgatcactgatccaatttgagtacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagatcccccgggggaaaagagagatgtctcctacgttacccgtaatatgtggaagtatcgacgtaatttcatagagtcattcggtctgaatgctacatgaagaacataagccagatgacggaacggggagacctaggatgtagaagatcataacatgagtgattcggcagatttggattcctatatatccactcatgtggtacttcatcatacgattcatataagatccatctgtctagatatcatcatatacatctagaaagccgtatgctttggaagaagcttgtacagtttgggaagggtttttatgataaaaagaagaatctacttcaaccgatatgcccttaggcacggccatacataacatagaaatcacacttggaaagggtggacaattagctagagcagcaggtgctgtagcgaaactgattgcaaaagagggtaaatcggccacattaagattaccatctggggaggtccgtttgtataccaaaaactgcttagcaacagtcggacaagtgggtaatgttggggtgaaccaaaaaagtttgggtagagccggatctaagtgttggctaggtaagcgtcctgtagtaagaggagtagttatgaaccctgtagaccatccccatgggggcggtgaagggagagccccaattggtagaaaaaaacccacaaccccttggggttatcctgcgcttggaagaagaagtaggaaaaggaaaaaatatagtgatagttttattcttcgtcgccgtaaataggaatattgaaaatcgaattttttttggaatttgaaataatgtgatgggcgaacgacgggaattgaacccgcgcatggtggattcacaatccactgccttgatccacttggctacatccgccccttatctagctaaaggattttctcttttttccattcatcattattgtatttattctgacctccatacttagatcgagatattggacatagaatgccaatctttaaaatgtaaaaaaaaggagtaatcagctgtgacacgttcactaaaaaaaaatccttttgtagctaatcatttagcgggaaaaattgaaaaactcaacatgagggaggagaaagaaataatagtaacttggtctcgggcatctaccattatacccacaatgattggccatacaatcgctattcataatggaaaggaaaatttacctatttatataacagatcgtatggtaggtcacaaattgggagaattcgcgcctactctgactttcgcgagacatgcaagaaacgacaataaatctcgtcgttaaattattaaaattttaataatatttttgaatattaaataataatagaaatattattaatataaa

SEQ ID NO: 4717 - DNA, 2477 bp, Elaeis guineensis
tctcatcatccatacataacgaattggtatattcataccataacatatgaacagtaagaactagaattcttatcgatactggaactcatagggaagaaaatggatttatggatggaatcaaatatgcagtatttacagaaaaaagtattcggttattggggaacaatcaatatacttttaatgtcgaatcaggattaactaggacagaaataaagcattgggtcgaactcttctttggtgtcaaggtaatagctatgaatagttatcgactcccgggaaagggtagaagaatgggacctattatgggacatacaatgcattacagacgtatgatcattacgcttcaaccgggttattctattccacctcttatagagaaaagaacttaaagcaaaatacttaataacacggcgatacatttatacaaaacttctaccccgagcacacgcataggagccgtacgacagtcaagtagaaatccaatccacgaaataatttgatctatggacagcatcgttgtggtaaaggtcgtaatgccagaggaatcattaccgcaaggcatagagggggaggtcataagcgcctataccgtaaaatcgattttcgacggaatgaaaaagacatatccggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgagtgcggtttgaactattgatttacgtaattggaagtaaccaattaggtttacgatgaaacctagaaatcgatcactgatccaatttgagtacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagatcccccgggggaaaaagagagatgtctcctacgttacccgtaatatgtggaagtatcgacgtaatttcatagagtcattcggtctgaatgctacatgaagaacataagccagatgacggaacggggagacctaggatgtagaagatcataacatgagtgattcggcagatttggattcctatatatccactcatgtggtacttcatcatacgattcatataagatccatctgtctagatatcatcatatacatctagaaagccgtatgctttggaagaagcttgtacagtttgggaaggggtttttattgataaaaagaagaatctacttcaaccgatatgcccttaggcacggccatacataacatagaaatcacacttggaaagggtggacaattagctagagcagcaggtgctgtagcgaaactgattgcaaaagagggtaaatcggccacattaagattaccatctggggaggtccgtttgatatccaaaaactgcttagcaacagtcggacaagtgggtaatgttggggtgaaccaaaaaagtttgggtagagccggatctaagtgttggctaggtaagcgtcctgtagtaagaggagtagttatgaaccctgtagaccatccccatgggggcggtgaagggagagccccaattggtagaaaaaacccacaacccttggggttatcctgcgcttggaagaagaagtaggaaaaggaaaaaatatagtgatagttttattcttcgtcgccgtaaataggaatattgaaaatcgaattttttttggaatttgaaataatgtgatgggcgaacgacgggaattgaacccgcgcatggtggattcacaatccactgccttgatccacttggctacatccgccccttatctagctaaaggattttctcttttttccattcatcattattgtatttattctgacctccatacttagatcgagatattggacatagaatgccaatctttaaaatgtaaaaaaaaggagtaatcagctgtgacacgttcactaaaaaaaatccttttgtagctaatcatttagcgggaaaaattgaaaaactcaacatgagggaggagaaagaaataatagtaacttggtctcgggcatctaccattatacccacaatgattggccatacaatcgctattcataatggaaaggaaaatttacctatttatataacagatcgtatggtaggtcacaaattgggagaattcgcgcctactctgactttcgcgagacatgcaagaaacgacaataaatctcgtcgttaaattattaaaattttaataatatttttgaatattaaataataatagaaatattatta

SEQ ID NO: 4718 - DNA, 1896 bp, Vitis vinifera
taagaactagcattcttattgagactagaactcatagggaagaaaatagatttatggatggaatcaaatatgcagtatttacagacaaaagtattcggttattggggaaaaatcaatatacttctaatgtcgaatcaggatcaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatagagccgtagacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccagaagcgccccttgtttcaaagagaggaggacgggttattcacatttcatttgatggtcagaggcgaattgaaagctaagcagtggtaattctaaagattccccgggggaaaaatagagatgtctcctacgttacccataatatgtggaagtatcgacgtaatttcatagagtcattcggtctgaatgctacatgaagaacataagccagatgacggaacgggaagacctaggatgtagaagatcataacatgagtgattggcagatttggattcctatatatccactcatgtggtacttcattatacgatatatataagatccatctgtatagatatcatcatctacatccagaaagccgtatgctttggaagaagcttgtacggtttgggaaggggttttgattgatcaaaaagaagaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaggtgggaaatgttggggtgaaccagaaaagtttgggtagagccggatctaagtgttggctaggtaagcgtcctgtagtaagaggagtagttatgaaccctgtagaccatccccatgggggtggtgaggggagagccccaattggtagaaaaaaacccacaaccccttggggttatcctgcacttggaagaagaagtagaaaaaggaataaatatagcgataatttgattcttcgccgccgtagtaagtagtaaataggagagaaaatagaatttgtttcttcgtctttacaaaaaaaaaaaaaa

SEQ ID NO: 4719 - DNA, 2280 bp, Vitis vinifera
tcaattcgaaaatccaagatttgaattgatgtcctttcattgattcctcctaaattacattgatttatcctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttctaatgtcgaatcaggatcaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatagagccgtagacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccagaagcgccccttgtttcaaagagaggaggacgggttattcacatttcatttgatggtcagaggcgaattgaaagctaagcagtggtaattctaaagattccccgggggaaaaatagagatgtctcctacgttacccataatatgtggaagtatcgacgtaatttcatagagtcattcggtctgaatgctacatgaagaacataagccagatgacggaacgggaagacctaggatgtagaagatcataacatgagtgattggcagatttggattcctatatatccactcatgtggtacttcattatacgatatatataagatccatctgtatagatatcatcatctacatccagaaagccgtatgctttggaagaagcttgtacggtttgggaaggggttttgattgatcaaaaagaagaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaggtgggaaatgttggggtgaaccagaaaagtttgggtagagccggatctaagtgttggctaggtaagcgtcctgtagtaagaggagtagttatgaaccctgtagaccatccccatgggggtggtgaggggagagccccaattggtagaaaaaaacccacaaccccttggggttatcctgcacttggaagaagaagtagaaaaaggaataaatatagcgataatttgattcttcgccgccgtagtaagtagtaaataggagagaaaatagaatttgtttcttcgtctttacaaaaaaaaaaaaaataggagtaattaactgtgacacgttcactaaaaaaaaatccttttatagcaaagcatttatgtttagtta

SEQ ID NO: 4720 - DNA, 10965 bp, Vitis vinifera
atataataatatataaggctataacgaatctttattttgttttgtctttatcatatcggatcgctcaaaaaatagagcaattcggtaaaataaagctttcgcgggcgaacatttactctttcaatatctatttcaattgtaaggttagcccacgatctttcagaacaaatgaattgatacctggtttgttccgccatcccactcaatgaatcattaggattcgtttttaatagaatcttctgtattcacaggtttccgtcgttcccatcgcttctcaattaatggttaggtctgaattatacaatggagctcctgttcttgagtcaatcttctcagtctttattggctctaggctcttgatttttttttctatgaacatattcatttaattcgggaggaattagtttgatgctttattacattgctttttatgaaatgattcatagaccttacatattatattggaatcatatatcattggcgttctttttatctctttctctcacccttcttccatttatccacatcattctagatttcgcttcccaaactcataatcagattggtttggtttttttttgtgtttatgcaaaaaagatttcagttgctacaatgatatgaccaatatatcatatcttgactggttgtttagatctagataatgtgaagcgatgagttggttattaattctgtaattttgagttcatactatgtatgggccggtccattttttgttttgaaccctaatcctacaaaaaaccaacgagtcacacactaagcatagcaattatatcaaatggtcaatcgaatctttattcaaccctatagaattaatttctaattgttcatttttgttttgattgaagagaaaaagaatgaaagaatttgtcattttttgtttcattacattactggatagaacgaaagaaaagacaaggaaggacttattattttattcctcgtctacaaatatccaaattttgatgcctaataccccatatatagttcgaactctataggaacaataatcaattttagctcgaatggtttgtaggggaacccttccttctctaatccattcaacacgtgcaatttcttttccgtcgatacgccctgcaatttgtacttgaattccttttgtatctgcctgttcagttaattcaatagctttttttattgccttgcgaaacgaaactctattccttaattgtccggctataaattctgcaagaatattaggatgtccgtaaggttttgtaattcttgtaatagcaatgttgagttttcggttcacgtaattcaattctttttgtacattcatctgtaattcttcaattcttcgtggtttaccttctactaataactttgggaatcccatatagattatgacctgaatcagatcgattcttttttgaatctctatacgtgcaattccctcgacaccagaggatattcttatatttttttgtacataattcttgatacaatcccgtattttttgatcttcttgtagacccttggaataattttttggttgtgcaaaccaaagcgaatgatgaccttgggttgtaccaagtctgaaacccagtggatttattttttgtcccatactcccccactactatacatattatgacacgtaatatctgtggacttctttttatatatccatccggttttttttaaacacctgatagagttttctacgacatatttttcatataaggctgtatctttcaatacaatagttatatgacaagtgggtctttttatcgcataactacgtcctcgagctcgaggtttcaattttttcacggtagtaccctcgttgactgtggctttagtaatgactaaatattcttcgttcaaacccatattgtgcttagcatttgctgctgcagaataaattaatttaaaaatgggataacacgctcgataaggcatgagttcaagtatcgtaagtgtttcccgataggaacgtccaagaatttgatcaagtactcttcgcgctttgtgagcagacatagagatagattgacttaaagcgtatacttctgtttttaattttatatcttctttttctcttgtaaatataaatgggtctttatttatgttccttaacatatttgtcataaggttcacctcccactaatgaataatgaaggataagtatcgttattttaacgacgagatctattatcgttttttgcgtgtccccggaaatttagagtagatgaaaattctcccaatttgtggcctaccatacgatctgttatataaataggaaaatgctcctttccattatgtacagcaatagtatggccgatcattgtgggtataatggtagatgtccgggaccaagttactattatttctttttcccacgttgtgttaagcatagcaatttttcttaataaatgctttgctataaaaggatttttttttagtgaacgtgtcacagttaattactcctattttttttttttttttgtaaagacgaagaaacaaattctattttctctcctatttactacttactacggcggcgaagaatcaaattatcgctatatttattcctttttctacttcttcttccaagtgcaggataaccccaaggggttgtgggtttttttctaccaattggggctctcccctcaccacccccatggggatggtctacagggttcataactactcctcttactacaggacgcttacctagccaacacttagatccggctctacccaaacttttctggttcaccccaacatttcccacctgtccgactgttgctgagcagtttttggatatcaaacggacctccccagaaggtaattttaatgtggccgatttcccctcttttgcaatcagtttcgctacagcacccgctgctctagctaattgtccaccctttccaagtgtgatttctatgttatgtatggccgtgcctaagggcatatcggttgaagtagattcttctttttgatcaatcaaaaccccttcccaaaccgtacaagcttcttccaaagcatacggctttctggatgtagatgatgatatctatacagatggatcttatatatatcgtataatgaagtaccacatgagtggatatataggaatccaaatctgccaatcactcatgttatgatcttctacatcctaggtcttcccgttccgtcatctggcttatgttcttcatgtagcattcagaccgaatgactctatgaaattacgtcgatacttccacatattatgggtaacgtaggagacatctctatttttcccccggggaatctttagaattaccactgcttagctttcaattcgcctctgaccatcaaatgaaatgtgaataacccgtcctcctctctttgaaacaaggggcgcttctggttctgtcggtgcttgaaacaattttgtcttctccatattactatatctctagagtcaataattttatatgaggaactactgaactcaatcacttgctgccgttactcttcagttttctgttgaggtctatcctgtagaggtactcaaattggatcagtgatcgatttctaggtttcgtcgtaaacctaattggttacttccaattacgtaaatcaatagttcaaaccgcactcaaaggtagggcatttcccatttttataggaacttctgtaccagaaacaatggtatctccaattatagcccctctgggatgtaaaatatatctcttctcaccatccccatagtgtatgagacaaatgtatgcatttcgattagggtcgtattctatggttacgattctaccatatatgtctttttcattccgtcgaaaatcgattttacggtatagacgcttatgacctccccctctatgccctgcggtaatgattcctctggcattacgacctttaccacaacgatgctgtccatagatcaaattatttcgtggattggatttcacttgactgtctacggctctattgcgtgtgctcggggtagaagttttgtataaatgtatcgccatgctattaagtattttgatttaagttcttttctttctaagaggtggaatagaataacccggttgaagcgtaatgatcatacgtctgtaatgcattgtatgtcccataataggtcccattcttctaccctttcccgggagtcgatgactattcatagctattaccttgacaccaaagaagagttcgacccaatgctttatttctgtcctagttgatcctgattcgacattagaagtatattgatttttccccaataaccgaatacttttgtctgtaaatactgcatatttgattccatccataaatctattttcttccctatgagttctagtctcaataagaatgctagttcttactgttcatatgttatgatatgaatataccacaccaattcgttatgtatggatgatgagattccattgatacagagccaattccaatagacttattggagggtcccattggcgtgcatccagtaggaattgaacctacgaattcgccaattatgagttgggcgctttaaccattcagccatggatgcttagcggggatcctcgtacatggtgaataaccaaattccaattgaaatgaaatctttaggataaatcaatgtaatttaggaggaatcaatgaaaggacatcaattcaaatcttggattttcgaattgagagagatattgagagagatcaagaattctcactatttcttagattcatggacccaattcacttcagtgggatctttcattcacatttttttccaccaagaacgttttataaaactctttgacccccgaatttggagtatcctactttcacgcaattcacagggttcaacaagcaatcgatatttcacgatcaagggtgtagtactatttgtagtagcggtccttatatatcgtattaacaatcgaaatatggtcgaaagaaaaaatctctatttgacagggcttcttcctatacctatgaattccattggacccagaaatgatacattggaagaatcttttgggtcttccaatatcaataggttgattgtttcgctcctgtatcttccaaaaggaaaaaagatctctgagagctgtttcctggatccgaaagagagtacttgggttctcccaataactaaaaagtgtatcatgcctgaatctaactggggttcgcggtggtggaggaactggatcggaaaaaagagggattctagttgtaagatatctaatgaaaccgtcgctggaattgagatctcattcaaagaaaaagatatcaaatatctggagtttctttttgtatattatatggatgatccgatccacaaggaccatgattgggaattgtttgatcgtctttctccgaggaagaggcgaaacataatcaacttgaattcgggacagctattcgaaatcttagtgaaacactggatttgttatctcatgtctgcttttcgtgaaaaaataccaattgaagtggagggtttcttcaaacaacaaggagctgggtcaactattcaatcaaatgatattgagcatgtttcccatctcttctcgagaaacaagtgggctatttctttgcaaaattgtgctcaatttcatatgtggcaattccgccaagatctcttcgttagttgggggaaaaatccgcacgaatcggattttttgaggaacgtatcgagagagaattggatttggttagacaatgtgtggttggtaaacaaggatcggttttttagcaaggtacggaatgtatcgtcaaatattcaatatgattccacaagatctagtttcgttcaagtaacggattctagccaattgaaaggatcttctgatcaatccagagatcatttcgattccattagtaatgaggattcgaaatatcacacattgatcaatcaaagagagattcaacaactaaaagaaagatcgattctttgggatccttcctttcttcaaacggaacgaacagagatagaatcagaccgattcccgaaatgcctttctggatattcctcaatgtcaatgtcccggctattcacggaacgtgaaaagcagatgattattcatctgcttccggaagaaattgaagaatttcttgggaatcctacaagatccattcgttcttttttctctgacagatggtcagaacttcatctgggttcgaatcctattgagaggtccactagagatcagaaattgttgaagaaacaacaagatgtttcttttgtcccttccaggcgatcggaaaataaagaaatggttaatatattcaagataattacgtatttacaaaataccgtctcaattcatcctatttcatcagatccgggatgtgatatggttccgaaggatgaaccggatatggacagttccaataagatttcattcttgaacaaaaatccattttttgatttatttcatctattccatgaccggaacagggggggatacacgttacaccacgattttgaatcagaagagagatttcaagaaatggcagatcgattcactctatcaataaccgagccggatctggtgtatcataagggatttgccttttctattgattcctacggattggatcaaaaacaattcttgaatgaggtatttaactccagggatgaatcgaacaagaaatctttattggttctacctcctagtttttatgaagagaatgaatctttttatcgaaggatcagaaaaaaatgggtccggatctcctgcggaaatgatttggaagatccaaaaccaaaaatagtggtatttgctagcaacaacataatggaggcagtcaatcaatatatattgatccgaaatctgattcaaatccaatatagcacctatgggtacataagaaatgtattgaatcgattctttttaatgaatagatccgatcgcaacttcgaatatggaattcaaagggatcaaataggaaatgatactctgaatcatagaactataatgaaatatacgatcaaccaacatttatcgaatttgaaaaagagtcagaagaaatggttcgatcctcttatttttatttctcgaaccgagagatccatgaatcgggatcctcatgcatatagatacaaatggtccaatgggagcaagaatttccaggaacatttggaacatttcgtttctgagcagaagagccgttttcaagtagtgttcgatcgattacgtattaatcaatattcgattgattggtctgaggttatcgacaaaaaagatttgtctaagtcacttcgtttctttttgtccaagtcacttctttttttgtccaagttgcttctctttttgtctaactcacttccttttttctttgtgagtttcgggaatatccccattcataggtccgagatccacatctatgaattgaaaggtccgaatgatcaactctgcaatcagttgttagaatcaataggtcttcaaatcattcatttgaaaaaatggaaactcttcttattggatgatcatgatacttcccaaaaatcgaaatttttgatcaatggaggaacaatatcaccgtttttgttcaataagataccaaagtggatgattgactcattccatagtagaaataatcgcaggaaatcctttgataacacggattcctatttctcaatgatatcccacgatcaagacaattggctgaatcccgtgaaaccatttcatagaagttcattgatatcttctttttataaagcaaatcgacttcgattcttgaataatccgcatcgcttctgcttctattgcaacaaaagattccctttttatgtggaaaaggcccgtatcaataattctgattttacgtatggacaattcctcaatattttgttcattcgcaagaaaatattttctttgtgcggcggtaaaaaaaaacatgcttttttggagagagatactatttcaccaatcgagtcacaggtatctaacatattcatacctaacgattttccacaaagtggtgacgaaacgtataacttgtacaaatctttccattttccaattcgatccaatccattcgttcgtagagctatttactcgatcgcagacatttctggaacacctctaacagagggacaaatagtcaattttgaaagaacttattgtcaacctctttcagatatgaatctatctgattcagaagggaagaacttgcatcagtatctcaatttcaattcaaacatgggtttgattcacactccatgttctgagaaatatttaccatccgaaaagaggaaaaaacggagtctttgtataaagaaatgcgttgagaaagggcagatgtatagaacctttcaacgagatagtgctttttcaactctctcaaaatggaatctattccaaacatatatgccatggttccttacttcgacagggtacaaatatctaaatttgatatttttagatactttttcagacctattgccgatattaagtagcagtccaaaatttgtatccatttttcatgatattatgtatggatcagatatatcatggcgaattcttcagaaaaaattgtgtcttccacaacggaatctgataagtgagatttcgagtaagtgtttacataatcttcttctgtccgaagaaatgattcatcgaaataatgagtcaccattgatatcgacacatctgagatcgccaaatgttcgggagttcctctattcaatccttttccttcttcttgttgctggatatctcgttcgtacacatcttctctttgtttcccgagcctctagtgagttacagacagagttcgaaaaggtcaaatctttgatgattccatcatacatgattgagttgcgaaaacttctggataggtatcctacatctgaactgaattctttctggttaaagaatctctttctagttgctctggaacaattaggagattctctagaagaaatacggggttctgcttctggcggcaacatgctattgggtggtggtcccgcttatggggtcaaatcaatacgttctaagaagaaatatttgaatatcaatctcatcgatatcatcgatctcataagtatcataccaaatcccatcaatcgaatcactttttcgagaaatacgagatgtctaagtcatacaagtaaagagatctattcattgataagaaaaagaaaaaacgtgaacggtgattggattgatgataaaatagaatcctgggtcgcgaacagtgattcgattgatgatgaagaaagagaattcttggttcagttctccaccttaacgacagaaaaaaggattgatcaaattctattgagtctgactcatagtgatcatttatcaaagaatgactctggttatcaaatgattgaacaaccgggagcaatttacttacgatacttagttgacattcataaaaagtatctaatgaattatgagttcaatacatcctgtttagcagaaagacggatattccttgctcattatcagacaatcacttattcacaaacctcgtgtggggctaatagttttcatttcccatctcatggaaaacccttttcgctccgcttagccctatccccctctaggggtattttagtgataggttctataggaactggacgatcctatttggtcaaatacctagcgacaaactcctatgttcctttcattacggtatttctgaacaagttcctggataacaagcctaaaggttttctttttgatgatatcgatattgatgatagtgacgatattgatgctagtgacgatattgatgctagtgacgatattgatgctagtgacgatatcgatcgtgaccttgatacggagctggagctgctaactatgatgaatgcgctaactatggatatgatgccggaaatagaccgattttatatcacccttcaattcgaattagcaaaagcaatgtctccttgcataatatggattccaaacattcatgatctggatgtgaatgagtcgaattacttatccctcggtctattagtgaactatctctccagggattgtgaaagatgttccactagaaatattcttgttattgcttcgactcatattccccaaaaagtggatcccgctctaatagctccgaataaattaaatacatgtattaagatacgaaggcttcttattccacaacaacgaaagcactttttcactctttcatatactaggggatttcacttggaaaagaaaatgttccatactaatggattcgggtccataaccatgggttccaatgcacgagatcttgtagcacttaccaatgaggccctatcgattagtattacacagaagaaatcaattatagacactaatgcaattagatccgctcttcatagacaaacttgggatttgcgatcccaggtaagatcggttcaggatcatgggatccttttctatcagataggaagggctgttgcgcaaaatgtacttctaagtaattgccccatagatcctatatctatctatatgaagaagaaatcatgtaacgaaggggattcttatttgtacaaatggtacttcgaacttggaacgagcatgaagaaattaacgatacttctttatcttttgagttgttctgccggatcggtcgctcaagacctttggtctctacccggacccgatgaaaaaaatgggatcacttcttatggactcgttgagaatgattctgatctagttcacggcctattagaagtagaaggcgctctggtgggatcctcacggacagaaaaagattgcagtcagtttgataatgatcgagtgacattgcttcttcggcccgaaccaaggaatcccttagatatgatgcaaaatggatcttgttctatcgttgatcagagatttctctatgaaaaatacgaatcggagtttgaagaaggggcaggagaaggagccctcgacccgcaacagatagaggaggatttattcaatcacatagtttgggctcctagaatatggcgcccttggggctttc

SEQ ID NO: 4721 - DNA, 732 bp, Amborella trichopoda
atgaagaacataagccagatgacggaatggggagacctaggatgtataaaatcgtaggatgagtgattcgacagatttggattcctatatatctactcgtgtggtacttcatcatacgattcatataagatccacctgtctagatatcatcatatacatccagaaagccgtatgctttggaagaagcttgtacagtttgggaaggggtttttattgatcaaaaagaagaatctacttcaaccgatatgcccttaggcacggccatacataatatagaaataacacttggaaagggtggacaattagctagagcagcaggtgctgtagcgaaactgattgcaaaagagggtaaatcggccacattaagattaccatctggggaggttcgtttgatatccaaaaactgctcagcaacagtcggacaagtgggtaatgttggggtgaaccagaaaattttgggtagagccggatctaaatgttggctaggtaagcgtcctgtagtaagaggagtagttatgaaccctgtagaccatccccatgggggtggtgaagggagggccccaattggtagaaaaaaacccacaaccccttggggttatcccgcgcttggaagaagaagtaggaaaaagaagaaatatagtgatagtttcattcttcgtcgtcgtaagtaaatagaacaagtcgggcgaacgacataaaaaaaaaaaaaacgaaaaggaggagttcttcact

SEQ ID NO: 4722 - DNA, 11231 bp, Amborella trichopoda
ccggaaggaatagggttatgtacattctcgttatgagaagggtcgaacatatgtaaatagatactatggatccctacgtcgttacattccatttaggttaggaataggcgtaatcggacctgctttttacatatctatcgttttgggtaccatattcacttcgtttgggcttctattgaatcgagaaataggtttgattgtacatcttttataaggcatcctccggataattcaaatccaagcaatttgatgtccgactcgggcctatatgacatgaccgatcgatagaaatactccaaaactccatctttgtcatatattccatatatcacactagatagatatcatattcgtggaatacgattcactttcaagatgccttgatggtgaaatggtagacacgcgagactcaaaatctcgtgctaaagagcgtggaggttcgagtcctcttcaaggcattgagaatgctcattgaatgagcaattcaataacagaaacagatctcggatctaatcgatattggcaagtttcatacgaagtattccggcgatccccacgatccgagtccgagctgttggaattggaataggttcggcagcggatcacgaaatcttggcgatcttctctatctaatcaatggaggagtcctttttgaaatggtccgtcccgcacccacccccgagtatatgattcaacaggaatcacacaagggtagattgatacgatagaaacttctggtaaaatgccccaccgtaacccagcagatagagtacattacatagtaagttttagggattgccacttatccattcagtgactttggcactggacgttcccaaaatgggtactatcggatcgggtgaattagataatagacgtctgttggcattccagccttccttctccttccagggcctatccgaaagagaattcagcgcctcttggtcgtgaatatctgaataggacgaaccggcctacgttgatatctttgctttgcttcggaacaaaacaattagaattaggctcggtcaactggaatgtgtattatccatataggagatattccaattgagaagatctatcgacctgagacgaagagaaaggtctatctatttgatttagttattcagttaaaccaatgattcgttattggagcagatagcaacaaccatttcatcggacatgcgtattttttcttttccaatagatttatttcattaatggaaattgtttgatgtagtgagtaataggttctggttgttcgccgttcaagaattcttgtttaggcagttcataccatccatacatagttttttgatctaagatttcaattgttccatgtttcagcagtagcatattgttccgtggagctaaggtccaaaatatggaataaacgagtgtttccacgactctaccacccagtcaattccacttaatccctatttcatggccacatatcttttctttccggctaaggaatgggaaatctttctcctgttacatgaatcaaatgtttcatttcatccgggaaaagccatctctttctcaacaatgtctttgccatttgatccaatagcgttccgttagataggaacagatttgataaatactgataactctcggatggcgtattagaacggaaagatccattagataatgaactattggtgctaagccatctctggcgatgaatcaacaattcgaagtgcttttcttgcgtattcttgatcaaccagcgttcatatatagatgtaggagaatgtgtttgggaagtaataagcccctttgacatctcttcatctgcaaagaattctcgacgtgcaaacacagagacaaagggctgatctttgaataggaaaaagaatggatctgcggggtcccaaatgaattggcttatttgaaaaaacccttgttctttggaggatctatctcgtgtctggtactgcatggttccactctgcaagaactccaaatcattctcttgaagctcatcctctttatgagaaatgatctgcttgccccgaaatgacctggaccgatagggaaatctcgattcattgggcctttcgatacaatcaaatagattgccacaagggcgccatattctaggagcccaaactatgtgattgaataaatcctcctctatctgttgcgggtcgagggttccttctccttccccttcttcaaactccgattcgtatttttcatatagaaatctctgatcaacgatagaacaagatccattttgcatcatatctaacggattccttggttcggaccgaagaagcaatgtcactcgatcattatcaaactgactgcaatctttttctgtccgtgaggatcccaccagagcgccttctaataggccatgaactagatcagaatcattctcaacgaatccataagaagtgatccaatttttttcatcgggtccgggtggagaccaaagatcttgagcgaccgatccggcagaacaactcaaaagataaagaagtgtcgttaatttctttatgctcgttccaagttcgaagtaccatttgtacaaataagaatccccttccttacatgatttcttcttcatataggtagatataggatctatggagcaattacttagaagtacattttgtgcaaaggaccttcctatctgatagaaaaggatcccatgatcctgaacggatcttacctgggatcgcaaatcccaagtttgtctatgaagagctgatctaattgtattagtgtctataattgatttcttctgtgtaatactaattgatagggcctcattggtaagtgctacaagatctcgtgcattggaacccatggttatggacccgaatccgttagtatggaacatcttcttttccaagtggaatcccctagtatatgaaagaatgaaaaagtgctttcgttgttgtggaataagaagccttcgtatcttaatgcatgtatttgatttattcggagctattagagcgggatccactttttggggaatatgagtcgaagcaataacaagaatatttctagtggaacatctttcacaatctctggagagatggttcactaatagaccgagggataagtaattcgactcattcacatacagatcatgaatgtttggaatccatattatgcaaggagacattgcttttgctaattctaattgaggggtgatatcaaaccggtccattttcggcgtcatatacatagttagcacattcgtcatagttagcagctccgcatcaaggtcatcatcaatatcgatatcatcactatcaccaatatcgacatcgtcactatcatcaatatcatcaatatcatcaataagataacctttaggcttgtcatccaggaacttgttcggagataccgtaatggaaggaaggtaggagtttgtcgctaggtatttgaccaaataggatcgtccagttcctatagaacctatcactaaaatacccctagaaggggataggtctaagcggagcgaaaagggttttccatgagatgggaaatgagaactattagccccacacgaggtttgtgaataagtgattgtctgataatgagcaaggaatattcgtctttctgctaaacaggatctattgaactcagaattcattagatactttttatgaatgtcaactaagtatcgtaagtaaattgatcccggttgttcaatcatttgataaccagagtcattctttgagaaaggatcactatgagtcagactccatagaatttgatcaatccttttttctgtcgttaaggcggagaactgaaccaagaattctctttcttcatcatcaatcaaatcactgttcgcgacccaggattctattttcccatcaatccaatcgctgttcacgttttttctttttcttatcaatgaatagatctctttactcgtacgacttaaacgtctcgtatttatcgaaaaagtgattggattgacgggatttggtatgatacttatgagatcgatgatatcgatgagattgatattcaaatctttcttcttagaacgtattgatttgaccccataagcgggaccgccacccaatagcatgttgccgccagaatcagaaccccgtatttcttccggagaatctcctaattgttccagagcaactagaaagagattctttaaccagaaagaattcagttcaggtggaggataactatccagaagttttcgcaactccatcatgtatgatggaatcatcaaagatttgatcttttctaactctgtatgtaactcactagagactcgggaaacaaagagaagatgtgtacgaacgagatatccagcaacaagaagaaggaaaaggcttgaatagaagaactctcgaggatttggtgatctcagatgtgtccatatcaatggaacgggtgactcattatttcgatgaatcatttcttcggacagaagaagattctgtaaacatttactcgaaatctcacttatcagattccattgtggaagaatcgcccgcaattttttctgaggaattgaccatgccgatccatgcataatatcatgaaaaatggatacaaatttgtgactgctacttagtatcggcaatgggtctgaaaaagtatctaaaaggatgaaatttatatatttgcaccctgtcgaagtaaggaaccatggcatatatgtttggaacagattccattttgagatatttgaaaaagcactatctcgttgaaaggttctatacatctgccgtttctcaacgcatttatttagacaaagattccgttttttcctctttccggatggtaaatatttctcagaacatggagtgtgaatcaaacccatgtttgaattgaaactgagatactgatgcaagttcttcccttctgaatcagatagattcagatctgaaagaggctgacaataagttccttcaaaattgactctttgttcctctgtcagaggtgttccagaaatgtctgcgatcgagtaaatagctctacgaacgaatggatcggatcgagttggaaaatggaaagatttgtacaagttatacgtttcgtcaccactttgtggaaaatcgttaggtatgaatatgtcagatacctgtgactcaattggcgaaggtgaaatagtatctctctccaaaaaaacatgtttttttttaccgacgcacaaagaaaatatcttgttgcgaatgaacgagatattgaggaattgtccatatgtaagatcataattattgatacgggtcttttccgcataaaaagggaatcttttgttacaatagaaccagaagtgatgtggattattcaagaatcgaagttgatttgctttataaaaagaagatatcaatgaactcctatgaaagggtttcacgggattcagccaattgtctcgatcgtgggatatcattgagaaataggaatccgtgttctcaaaggatttcccgcgattattcctagtatggaatgagtcaatcatccactttggtatcttattgaaccaaaatcgtgctattgttcctccattgatcaataatttcgatctttgggaagtatcatgatcatctaataagaaaggtttcaatttgttcaaatgaacgatttgaacacctattgattctaacaactgattgcagagttgatcattcggacctttcaattcatagatgtggatctcggacctatgaatggggatattcccgatactcacaaagaaaaaaggaagtgacttagacaaaaagagaagtgacttggacaaaaagaaacgaagtgacttagacaaatcttgtttgtcgataacctcggaccaatcaatcgaatgttgattaatacgtaatcgatcgaacactacttgaaaacggttcttctgttcagaaacgaaatgttccaaatgttcttggaaattcttgctcccattggaccatttgtatctatatgcattaggatcccgattcatggatctctcggttcgagaaataagaggatcgaaccatttcttctgactctttttcaaattcgataaatgttggttgatcgtatatttcattatagttatatgattcagagtatcatttcctatttgatccctttgaattccatattcgaagttgcgatcggatctattcattaaaaagaatctcttcgatacatttcttatgtacccataggtgctatattggatttgaatcagatttcggatcaatctatattgattgactgcctccattatgttgttgctagcaaataccactatttttggatcttccaaaccattcctgcaggagatccggaccgattttgttctgatccttcgataaaaagattcattctcttcataaaaaatatgaggtagaaccaataaagatttctttttcgattcatccctggagttgaatacctcattcaataattttttttgatccaatccgtaggaatcaatagaaaaggcaaatcccttatgatacatcagatcgggctcggttattgatagagtgaatagatctgccctttcttgaaatctctcttctgattcaaaatcgtggtgtaacgtgtatccacctttgttccggccatggaataggtggaataaatcacaaatggatttttgttcaagaatgaaatcttattggaactgtccatatccggttcatccttcggaaccatatcacatcccggatctgatgaaataggatgaattgagacggtattttgtaaatacgtaattatcttgaatatatcaaccatttctttattttccgatcgcctggaagggacaaaagaaacatcttgttgtttcttcaacaatttctgatctctagtggacctctcagtagcattcgaccccagatgaagttctgaccatctgtcagagaaaaaagaacgaattgatcttgtaggattcccaataaattcttcgatttcttccggaaacagatgattattcatctgcttctcacgttccgtgaatagccgggacattgagaaatatccagaaaggcatttcgggaatcgatctgattctatctctgttcgttccgtttgaagaaaggaaggatcccaaagaatcgatctttcttttagttgctcaatttctgtttgatgtatcaatgtgtgatattccgaatcctcattactaatggaattgaaatgatctctggattgatcagaagatcctttcaattggctagaatccgttactttaacgaaaatagatcttgtggaatcgtattgaatatttgacgatacattccgtaccttgctaaaaaacctatccttgtttaccaaccacatactgcctaaccaaatcaaattctctctcgatacgttcctcaaaaaatccgattcgtgctgattcttcccccaactaacgaagagatcctggtggaattgccacatatgaaattgagcgcaattttgcaaagaaataccccacttgtttttgtttcccgagaagagacggggaacatgctcaatatcatttgattgaatagttgcctcagctccttgttgtttgaagaaaccctccacttcaattggtcttttttcacgaaaagcagacatgagataacaaatcaagtgtttcactaagatttcgaatagctgtcccgaattcaagttgattatgttttgcttcttccccggagaaagacgatcaaacaattccaaatcatggtccttgcggatcggatcatccgtatccgtataggatacaaaaagaaactccagatatttgatatctttctctttgaatgagatctcaattccagctactgtttcattagatatcttacaactagaatccctcttttttccgatccggttcctccaccaccgcgaaccccagttagattcaggcatgatacactttttagttattgggagaagccaagtactctctttcggatccatgaaacaactctcagagatctttttcccttttggaagatacaggagcgaaacaatcaacctattgatattggaagacaaaaaagattcttccaatgtatcatttctgggcccaatggaattcataggtataggaagaagcctcatcaaatagagattttttctttcgaccatatttcgattgttaatacgatatataaggaccgctactacaagcagtactacacctttgatcgtgaaatatcgattgcttgttgaactctgcgaatcgcatgaaagtaggatactccaaattcgggggtcaaagagtttcataaaacgttcttggtggaaaaaaatgtgagtgaaagatcccactaaattcaattttgtccatgaatctaagaaatagtgagaattcttgatctctctcaatatctctctcaattcgaagatccaggatttgagttgatgtcctttcattgattcctcctaaagatttcatttcaattggaatttgcttattcgtgatgatacttatcttatgatgatccttgtgaaattaagcatccatggctgaatggttaaagcgcccaactcataattggcaaattcgtaggttcaattcctgctggatgcacgccaattggaatgtttaataagtctattggaattggctctgtatcaatggaatctcatcatccatacataacgaattggtatggtatattcataccataacatatgaacagtaagaactagaattcttatcgatactggaactcatagggaagaaaatggatttatggatggaatcaaatatgcagtatttacagaaaaaagtattcggttattggggaacaatcaatatacttctaatgtcgaatcaggatcaactagggcagaaataaagcattggatcgaactcttctttggtgtcaaggtaatagctatgaatagtcatcgactcccggtcccgggaaagggtagaagaatgggacctcttatgggacatagaatgcattacagacgtatgatcattacgcttcaaccgggttattctattccacctcttatagagaaaaggacttaaatcaaaatacttaataacacggcgatacatttatacaaaacttctaccccgagcacacgcaatggagccgtagacagtcaagtgaaatccaatccacgaaagaatttgatctatggacagcatcgttgtggtaaaggtcgtaatgccagaggaatcattaccgcagagtatagcggggggggtcataagcgtctataccgtaaaatcgattttcgacggaatgaaaaagacatatctggtagaatcgtaaccatagaatacgaccctaatcgaaatgcatacatttgtctcatacactatggggatggtgagaagagatatattttacatcccagaggggctataattggagataccattgtttctggtacagaagttcctatatcaatgggaaatgccctacctttgagtgcggtttgaaccattgatttacgtaattggaagtaaccaattaggtttacgacgaaacctagaaatcgatcactgatccaatttgagcgggatagacctcaacagaaaactgaagagtaacggcagcaggtgattgagttcagtggttcctcatataaaatgattgactctagagatatggtaatatggagaagactaaattgtttgaagcacggacagaaccggaagcgccccttgtttcaaagagagggggacgggttattcacatttcatttgatggtcagaggcaaattgaaagctaagcaatggtaattctaaagatcccccgggggaagagatgtctcctacgttacccgtaatatgtggaagtgtcgacgtaatttcatagagtcattcggtctgagtgctacatgaagaacataagccagatgacggaatggggagacctaggatgtataaaatcgtaggatgagtgattcgacagatttggattcctatatatctactcgtgtggtacttcatcatacgattcatataagatccacctgtctagatatcatcatatacatccagaaagccgtatgctttggaagaagcttgtacagtttgggaaggggtttttattgatcaaaaagaagaatctacttcaaccgatatgcccttaggcacggccatacataatatagaaataacacttggaaagggtggacaattagctagagcagcaggtgctgtagcgaaactgattgcaaaagagggtaaatcggccacattaagattaccatctggggaggttcgtttgatatccaaaaactgctcagcaacagtcggacaagtgggtaatgttggggtgaaccagaaaattttgggtagagccggatctaaatgttggctaggtaagcgtcctgtagtaagaggagtagttatgaaccctgtagaccatccccatgggggtggtgaagggagggccccaattggtagaaaaaaacccacaaccccttggggttatcccgcgcttggaagaagaagtaggaaaaagaagaaatatagtgatagtttcattcttcgtcgtcgtaagtaaatagaacaagtcgggcgaacgacataaaaaaagaaaaaacgaaaaggaggagttcttcactatgtcacgttcacttaaaaaaaatccttttgtagctaataatttattattaaaaattcataagcttaacacgagggaggaaaaagaaattatagtaacttggtcccgggcatctaccattatacccactatgattggtcatacaattgctattcataatggaaaagagcatttacctgtttatgtaacagatcgtatggtaggtcacaaattgggagaatttgcacctactcttactttccagggacatgcgagaaacgatagtaaatttcgtcgttaattgggcactcatcattcaggaggtaaaaaattatgataaataaaatctcaggtacagaaatacgagcattagctaaacatatatgtatgtcccctcacaaagcgcgaagagttattgatcagattcgcggttgctcttatgaacaaacacttatgatactagaactcatgccgtatcgagtatgttatcccgttttcaaattggtttactctgcagcggcaaatgctagtcacaatatgggtttgaacgaagctgattcattcattagtaaagcggaagtccatggaggtgccatgatgaaaaagttcaaacctaaagctaggggacgcagttatccgataaaaagacccacttgtcatataactattgttttaaaggaaagaaaaaagagtccccttgtagtttgaatttgacagatcaagccttacaaaaataaa

SEQ ID NO: 4723 - DNA, 5042 bp, Platanus occidentalis
gaaaatggatttatggatggaatcaaatatgcagtatttacagacaaaggtattcggttattggggaacaatcaatatacttttaatgtcgaatcaggattaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttagaaagaaaagaacttaaatcaaaatacttaataacatggcgatacatttatacaaaacttctaccccgagcacacgcaatggagccgtcgacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaataaaaaaaacatagagggtagaatcgtaaccatagaatacgaccctaatcgaaatgcatacatttgtctcatacactatggggatggtgagaagagatatattttacatcccagaggggctataattggagattccattgtttctggtacagaagtttctataaaaatgggaaatgccctacgactgggaaatgccctacctttgagtgcggtttgaactattgatttacgtaattggaagtaaccaattaggtttacgacgaaacctagaaatcgatcactgatccaatttgagtacctctacgggatagacctcaacagaaaactgaagagtaacggcagcaagtgattgagttcagtagttcctcatataaaattattgactctagagatatggtaatatggagaagacaaaattgtttgaagcaccgacagaaccggaagcaccccttgtttcaaagagaggaggacgggttattcacatttcatttgatggtcagaggcgaattgaaagctaagcagtggtaattctaaagatcccccgggggaaaaatagagatgtctcctacgttacccgtaatatgtggaagtatcgacgtaatttcatagagtcattcggtctgaatgctacatgaagaacataagccagatgacggaacggggagacctaggatgtagaagatcataacatgagtgattcggcagattttgattcctatatatccactcatgtggtacttcatcatacgattcatataggatccatctgtctagatatcatcatcatcatatacatccagaaagccgtatgctttggaagaagcttgtacagtttgggaaggggttttgattgatcaaaaagaagaatctacttcaaccgatatgcccttaggcacggccatacataacatagaaatcacacttggaaagggtggacaattagctagagcagcgggtgctgtagcgaaactgattgcaaaagagggtaaatcggccacattaaaattaccctctggggaggtccgtttgatatccaaaaactgctcagcaacattcggacaggtgggtaatgttggggtgaaccagaaaagtttgggtagagccggatctaagtgttggctaggtaagcgtcctgtagtaagaggagtagttatgaaccctgtagaccatccccatgggggtggtgaagggagggccccaattggtagaaaaaccccacaaccccttggggttatcctgcgcttggaagaagaagtagaaaaaggaataaatatagtgatagtttgattcttcgtcgccgtactaaataggagaatattgaaaatagaatatgtttcttcgtctttacaaaagaaaaaaaaagatagcaataggagtaattagttgtgacacgttcactaaaaaaaaatccttttgtagctaatcatttattaagaaaaattgagaagcttaacacgaaggcagaaaaagagataatagtaacttggtcccgggcatctaccattatacccacaatgatcggccatacaattgctattcataatggcaaggagcatttgcctatttatataacagatcgtatggtaggtcacaaattgggagaatttgcgcctactatgaatttccggggacatgcgaaaaatgataatagatctcgtcgttaataaagtgaatatgggtcctcatcgttcatgagtaggaggtgaaccttatgataaacaagataaagaagaacccagatacagaagtatacgctttaggccaacatatatgtatgtccgctcacaaagcgcgaagggtaattgatcagattcgtgggcgttcctacgaagaaacacttatgatactcgaactcatgccttatcgagcatgttaccccatttttaaattggtttattctgcagcagcaaatgctagtcacaatatgggtttcaacgaagcggatttaatcattagtaaagccgaagtcaacgaaggtcctaccatgaaaaggttaaaacctcgagctcgaggacgtagttatccgataaaaagacccacctgtcatataactattgtattgaaagatatatccttagatgaagaatatctcatatggttaagaaaatatggatggatatatagaaataagtatacagataggatgtgtcgtgataagtatggtatagtggggtagtatgggtacaaaaaataatccactcggtttcagacttggtacaacccaaatcatcattccgtttggtttgcacaaccaaaaagttattccgagggcctccaggaagatcaaaaaatacgggattgtatcaagaattatgtacaaaaaaataagagaatacccttagtcgagggaattgcacgtatagagattcaaaaaagaattgatctaatccaggtcataatctatatgggattcccaaagttgttaatagaggatagaccacgaggaatcgaagaattacagatcaatttacaaaaagaatttaattccatgaaccgaaaacttaacattgctatcacaagaattgcaaaaccttatggacaacctaatattcttgcagaatatatagccggacaattaaagagtagagtttcatttcgaaaggcaatgaaaaaagctattgaattaactgaacaaacagatacaaaaggaattcaagtacaaattgcagggcgtatcgacggaaaagaaattgcacgtgtcgaatggatcagagaaggtagggttcccctacaaaccattcgagctaaaattgattattgttcctatacagttcgaactatctatggggtattgggcatcaaaatttggatatttgtagacgaggaataatgatcctttccttgtctttccgttctatccagttagaagttcttgttattatggaacaaaaaatgtcaaactctttcattctttttctgttcaatcaaaatcaaataaaatgaacaattttagttctttctaattctatagggttggataaaaattcgattaaccgtttggtataattgctatgcttagtgtgtgactcgttgatttttttagggttaggtattacaaaaaaaaaaaggaccctgcccatagtatgaactaataactatagaactaataaccagctcattgcttcgtattatctagatccaaggaaccggtcattatatgatgtatcgatcatatcattgtagcaactgaaatcttttttgcataaaggaaaaatcaatctgattatgggttgtgaagcgaaaaaaatagaaggatgcggataaatggaagaatgaaagaaagagagaaagagaatatcaatgatatataattccaatataatatgtatggtctacgaatcatctcataaaaagcagtgtaataaagcattaattcaatactgattcgtccataaccataattagatgaatctggttcataggaaaaaaaataaagagcctcgagtcaataaagactgaggagattgactcaagaacaaatctcattaggagctccattgcaaagttcaggcctagccattaatcgagaagcggtgggaacgacggaacctgtgactgcagaagattctattgaaaacgaatcctaatgattcattgggcgggatggcggaacgaaccaggaaccaattcattctcatttattttgagagatcatgggctggccctacaaatgaaagagatatggaaagagtaaatattcgcccgcgaaagccttcttgttggattgcaaaatttttggcgattcgataaagggcaaaattaaataaaataaaaattcgttgtaaaaaaaaaaagacattctatattctattctatataaattctatataaatcgtctagttgtatatacaatacaaacaagatctacaaattaaattcctatggacagattcaatctacaaaaaatttcacgattcagtgtcttattcattaaatacatgtatatctgtaatattattgaatcgttttgaatcgtttcattcgcgaggagctggatgagaagaaactctcatgtccggttctgcagtagagatggtattgagaccatcaactataaccccaaaagaaccagattccgtaaacaacatagaggaagaatgaagggaatatcatatcgaggcaatcgtatttcttttggtagatacgctcttcgggcacttgaacccgcttggatcacatctagacaaatagaagcaagggcgacgagcaatgacacgatatgcacgtcgtggtggaaaaatatgggtacgtatatttccagacaaacccgttacagtaagacctacggaaacacgtatgggttcggggaaaggatctcccgaatattgggtatctgtcgttaaaccgggtcgaatactttatgaaatgggtggaatatcagaaattgtagccagagaagctatttcaatagctgcgtccaaaaatgcctatacgaacccaattcgttattgcgggatagggatgtggagccaaaagaaagatatttttgtaggtgaaaaaaaagcaatcgctggtttatttattttt

SEQ ID NO: 4724 - DNA, 9727 bp, Amborella trichopoda
cgacttgttctatttacttacgacgacgaagaatgaaactatcactatatttcttctttttcctacttcttcttccaagcgcgggataaccccaaggggttgtgggtttttttctaccaattggggccctcccttcaccacccccatggggatggtctacagggttcataactactcctcttactacaggacgcttacctagccaacatttagatccggctctacccaaaattttctggttcaccccaacattacccacttgtccgactgttgctgagcagtttttggatatcaaacgaacctccccagatggtaatcttaatgtggccgatttaccctcttttgcaatcagtttcgctacagcacctgctgctctagctaattgtccaccctttccaagtgttatttctatattatgtatggccgtgcctaagggcatatcggttgaagtagattcttctttttgatcaataaaaaccccttcccaaactgtacaagcttcttccaaagcatacggctttctggatgtatatgatgatatctagacaggtggatcttatatgaatcgtatgatgaagtaccacacgagtagatatataggaatccaaatctgtcgaatcactcatcctacgattttatacatcctaggtctccccattccgtcatctggcttatgttcttcatgtagcactcagaccgaatgactctatgaaattacgtcgacacttccacatattacgggtaacgtaggagacatctcttcccccgggggatctttagaattaccattgcttagctttcaatttgcctctgaccatcaaatgaaatgtgaataacccgtccccctctctttgaaacaaggggcgcttccggttctgtccgtgcttcaaacaatttagtcttctccatattaccatatctctagagtcaatcattttatatgaggaaccactgaactcaatcacctgctgccgttactcttcagttttctgttgaggtctatcccgctcaaattggatcagtgatcgatttctaggtttcgtcgtaaacctaattggttacttccaattacgtaaatcaatggttcaaaccgcactcaaaggtagggcatttcccattgatataggaacttctgtaccagaaacaatggtatctccaattatagcccctctgggatgtaaaatatatctcttctcaccatccccatagtgtatgagacaaatgtatgcatttcgattagggtcgtattctatggttacgattctaccagatatgtctttttcattccgtcgaaaatcgattttacggtatagacgcttatgacccccccctctatgctctgcgttatgattcctctggcattacgacctttaccacaacgatgctgtccatagatcaaattctttcgtggattggatttcacttgactgtctacggctccattgcgtgtgctcggggtagaagttttgtataaatgtatcgccgtgttattaagtattttgatttaagtccttttctctataagaggtggaatagaataacccggttgaagcgtaatgatcatacgtctgtaatgcattctatgtcccataagaggtcccattcttctaccctttcccgggaccgggagtcgatgactattcatagctattaccttgacaccaaagaagagttcgatccaatgctttatttctgccctagttgatcctgattcgacattagaagtatattgattgttccccaataaccgaatacttttttctgtaaatactgcatatttgattccatccataaatccattttcttccctatgagttccagtatcgataagaattctagttcttactgttcatatgttatggtatgaatataccataccaattcgttatgtatggatgatgagattccattgatacagagccaattccaatagacttattaaacattccaattggcgtgcatccagcaggaattgaacctacgaatttgccaattatgagttgggcgctttaaccattcagccatggatgcttaatttcacaaggatcatcataagataagtatcatcacgaataagcaaattccaattgaaatgaaatctttaggaggaatcaatgaaaggacatcaactcaaatcctggatcttcgaattgagagagatattgagagagatcaagaattctcactatttcttagattcatggacaaaattgaatttagtgggatctttcactcacatttttttccaccaagaacgttttatgaaactctttgacccccgaatttggagtatcctactttcatgcgattcgcagagttcaacaagcaatcgatatttcacgatcaaaggtgtagtactgcttgtagtagcggtccttatatatcgtattaacaatcgaaatatggtcgaaagaaaaaatctctatttgatgaggcttcttcctatacctatgaattccattgggcccagaaatgatacattggaagaatcttttttgtcttccaatatcaataggttgattgtttcgctcctgtatcttccaaaagggaaaaagatctctgagagttgtttcatggatccgaaagagagtacttggcttctcccaataactaaaaagtgtatcatgcctgaatctaactggggttcgcggtggtggaggaaccggatcggaaaaaagagggattctagttgtaagatatctaatgaaacagtagctggaattgagatctcattcaaagagaaagatatcaaatatctggagtttctttttgtatcctatacggatacggatgatccgatccgcaaggaccatgatttggaattgtttgatcgtctttctccggggaagaagcaaaacataatcaacttgaattcgggacagctattcgaaatcttagtgaaacacttgatttgttatctcatgtctgcttttcgtgaaaaaagaccaattgaagtggagggtttcttcaaacaacaaggagctgaggcaactattcaatcaaatgatattgagcatgttccccgtctcttctcgggaaacaaaaacaagtggggtatttctttgcaaaattgcgctcaatttcatatgtggcaattccaccaggatctcttcgttagttgggggaagaatcagcacgaatcggattttttgaggaacgtatcgagagagaatttgatttggttaggcagtatgtggttggtaaacaaggataggttttttagcaaggtacggaatgtatcgtcaaatattcaatacgattccacaagatctattttcgttaaagtaacggattctagccaattgaaaggatcttctgatcaatccagagatcatttcaattccattagtaatgaggattcggaatatcacacattgatacatcaaacagaaattgagcaactaaaagaaagatcgattctttgggatccttcctttcttcaaacggaacgaacagagatagaatcagatcgattcccgaaatgcctttctggatatttctcaatgtcccggctattcacggaacgtgagaagcagatgaataatcatctgtttccggaagaaatcgaagaatttattgggaatcctacaagatcaattcgttcttttttctctgacagatggtcagaacttcatctggggtcgaatgctactgagaggtccactagagatcagaaattgttgaagaaacaacaagatgtttcttttgtcccttccaggcgatcggaaaataaagaaatggttgatatattcaagataattacgtatttacaaaataccgtctcaattcatcctatttcatcagatccgggatgtgatatggttccgaaggatgaaccggatatggacagttccaataagatttcattcttgaacaaaaatccattttgtgatttattccacctattccatggccggaacaaaggtggatacacgttacaccacgattttgaatcagaagagagatttcaagaaagggcagatctattcactctatcaataaccgagcccgatctgatgtatcataagggatttgccttttctattgattcctacggattggatcaaaaaaaattattgaatgaggtattcaactccagggatgaatcgaaaaagaaatctttattggttctacctcatattttttatgaagagaatgaatctttttatcgaaggatcagaacaaaatcggtccggatctcctgcaggaatggtttggaagatccaaaaatagtggtatttgctagcaacaacataatggaggcagtcaatcaatatagattgatccgaaatctgattcaaatccaatatagcacctatgggtacataagaaatgtatcgaagagattctttttaatgaatagatccgatcgcaacttcgaatatggaattcaaagggatcaaataggaaatgatactctgaatcatataactataatgaaatatacgatcaaccaacatttatcgaatttgaaaaagagtcagaagaaatggttcgatcctcttatttctcgaaccgagagatccatgaatcgggatcctaatgcatatagatacaaatggtccaatgggagcaagaatttccaagaacatttggaacatttcgtttctgaacagaagaaccgttttcaagtagtgttcgatcgattacgtattaatcaacattcgattgattggtccgaggttatcgacaaacaagatttgtctaagtcacttcgtttctttttgtccaagtcacttctctttttgtctaagtcacttccttttttctttgtgagtatcgggaatatccccattcataggtccgagatccacatctatgaattgaaaggtccgaatgatcaactctgcaatcagttgttagaatcaataggtgttcaaatcgttcatttgaacaaattgaaacctttcttattagatgatcatgatacttcccaaagatcgaaattattgatcaatggaggaacaatagcacgattttggttcaataagataccaaagtggatgattgactcattccatactaggaataatcgcgggaaatcctttgagaacacggattcctatttctcaatgatatcccacgatcgagacaattggctgaatcccgtgaaaccctttcataggagttcattgatatcttctttttataaagcaaatcaacttcgattcttgaataatccacatcacttctggttctattgtaacaaaagattccctttttatgcggaaaagacccgtatcaataattatgatcttacatatggacaattcctcaatatctcgttcattcgcaacaagatattttctttgtgcgtcggtaaaaaaaaacatgtttttttggagagagatactatttcaccttcgccaattgagtcacaggtatctgacatattcatacctaacgattttccacaaagtggtgacgaaacgtataacttgtacaaatctttccattttccaactcgatccgatccattcgttcgtagagctatttactcgatcgcagacatttctggaacacctctgacagaggaacaaagagtcaattttgaaggaacttattgtcagcctctttcagatctgaatctatctgattcagaagggaagaacttgcatcagtatctcagtttcaattcaaacatgggtttgattcacactccatgttctgagaaatatttaccatccggaaagaggaaaaaacggaatctttgtctaaataaatgcgttgagaaacggcagatgtatagaacctttcaacgagatagtgctttttcaaatatctcaaaatggaatctgttccaaacatatatgccatggttccttacttcgacagggtgcaaatatataaatttcatccttttagatactttttcagacccattgccgatactaagtagcagtcacaaatttgtatccatttttcatgatattatgcatggatcggcatggtcaattcctcagaaaaaattgcgggcgattcttccacaatggaatctgataagtgagatttcgagtaaatgtttacagaatcttcttctgtccgaagaaatgattcatcgaaataatgagtcacccgttccattgatatggacacatctgagatcaccaaatcctcgagagttcttctattcaagccttttccttcttcttgttgctggatatctcgttcgtacacatcttctctttgtttcccgagtctctagtgagttacatacagagttagaaaagatcaaatctttgatgattccatcatacatgatggagttgcgaaaacttctggatagttatcctccacctgaactgaattctttctggttaaagaatctctttctagttgctctggaacaattaggagattctccggaagaaatacggggttctgattctggcggcaacatgctattgggtggcggtcccgcttatggggtcaaatcaatacgttctaagaagaaagatttgaatatcaatctcatcgatatcatcgatctcataagtatcataccaaatcccgtcaatccaatcactttttcgataaatacgagacgtttaagtcgtacgagtaaagagatctattcattgataagaaaaagaaaaaacgtgaacagcgattggattgatgggaaaatagaatcctgggtcgcgaacagtgatttgattgatgatgaagaaagagaattcttggttcagttctccgccttaacgacagaaaaaaggattgatcaaattctatggagtctgactcatagtgatcctttctcaaagaatgactctggttatcaaatgattgaacaaccgggatcaatttacttacgatacttagttgacattcataaaaagtatctaatgaattctgagttcaatagatcctgtttagcagaaagacgaatattccttgctcattatcagacaatcacttattcacaaacctcgtgtggggctaatagttctcatttcccatctcatggaaaacccttttcgctccgcttagacctatccccttctaggggtattttagtgataggttctataggaactggacgatcctatttggtcaaatacctagcgacaaactcctaccttccttccattacggtatctccgaacaagttcctggatgacaagcctaaaggttatcttattgatgatattgatgatagtgacgatatcgatcttgatgatagtaatagtattgatgatagtgacgatgtcgatattggtgatagtgatgatatcgatattgatgatgaccttgatgcggagctgctaactatgacgaatgtgctaactatgtatatgacgccgaaaatggaccggtttgatatcacccctcaattagaattagcaaaagcaatgtctccttgcataatatggattccaaacattcatgatctgtatgtgaatgagtcgaattacttatccctcggtctattagtgaaccatctctccagagattgtgaaagatgttccactagaaatattcttgttattgcttcgactcatattccccaaaaagtggatcccgctctaatagctccgaataaatcaaatacatgcattaagatacgaaggcttcttattccacaacaacgaaagcactttttcattctttcatatactaggggattccacttggaaaagaagatgttccatactaacggattcgggtccataaccatgggttccaatgcacgagatcttgtagcacttaccaatgaggccctatcaattagtattacacagaagaaatcaattatagacactaatacaattagatcagctcttcatagacaaacttgggatttgcgatcccaggtaagatccgttcaggatcatgggatccttttctatcagataggaaggtcctttgcacaaaatgtacttctaagtaattgctccatagatcctatatctacctatatgaagaagaaatcatgtaaggaaggggattcttatttgtacaaatggtacttcgaacttggaacgagcataaagaaattaacgacacttctttatcttttgagttgttctgccggatcggtcgctcaagatctttggtctccacccggacccgatgaaaaaaattggatcacttcttatggattcgttgagaatgattctgatctagttcatggcctattagaaggcgctctggtgggatcctcacggacagaaaaagattgcagtcagtttgataatgatcgagtgacattgcttcttcggtccgaaccaaggaatccgttagatatgatgcaaaatggatcttgttctatcgttgatcagagatttctatatgaaaaatacgaatcggagtttgaagaaggggaaggagaaggaaccctcgacccgcaacagatagaggaggatttattcaatcacatagtttgggctcctagaatatggcgcccttgtggcaatctatttgattgtatcgaaaggcccaatgaatcgagatttccctatcggtccaggtcatttcggggcaagcagatcatttctcataaagaggatgagcttcaagagaatgatttggagttcttgcagagtggaaccatgcagtaccagacacgagatagatcctccaaagaacaagggttttttcaaataagccaattcatttgggaccccgcagatccattctttttcctattcaaagatcagccctttgtctctgtgtttgcacgtcgagaattctttgcagatgaagagatgtcaaaggggcttattacttcccaaacacattctcctacatctatatatgaacgctggttgatcaagaatacgcaagaaaagcacttcgaattgttgattcatcgccagagatggcttagcaccaatagttcattatctaatggatctttccgttctaatacgccatccgagagttatcagtatttatcaaatctgttcctatctaacggaacgctattggatcaaatggcaaagacattgttgagaaagagatggcttttcccggatgaaatgaaacatttgattcatgtaacaggagaaagatttcccattccttagccggaaagaaaagatatgtggccatgaaatagggattaagtggaattgactgggtggtagagtcgtggaaacactcgtttattccatattttggaccttagctccacggaacaatatgctactgctgaaacatggaacaattgaaatcttagatcaaaaaactatgtatggatggtatgaactgcctaaacaagaattcttgaacggcgaacaaccagaacctattactcactacatcaaacaatttccattaatgaaataaatctattggaaaagaaaaaatacgcatgtccgatgaaatggttgttgctatctgctccaataacgaatcattggtttaactgaataactaaatcaaatagatagacctttctcttcgtctcaggtcgatagatcttctcaattggaatatctcctatatggataatacacattccagttgaccgagcctaattctaattgttttgttccgaagcaaagcaaagatatcaacgtaggccggttcgtcctattcagatattcacgaccaagaggcgctgaattctctttcggataggccctggaaggagaaggaaggctggaatgccaacagacgtctattatctaattcacccgatccgatagtacccattttgggaacgtccagtgccaaagtcactgaatggataagtggcaatccctaaaacttactatgtaat

SEQ ID NO: 4725 - DNA, 2978 bp, Amsonia hubrichtii
tttttttaaaaggaaaggtttattattcctcgtctataaatatccaaatttttatgcccaatacaccatagatagttcgaactgtataggaacaataatcaattttagctcgaatggtttgtaggggaaccctaccttctcgaatccattcgacacgtgcaatttcttttccgtcaatacgacccgcaatttgtacttgaattccttttgtatctgcttgttcagttaattcaatagcttttttcattgcttttcgaaatgaaactctattctttaattgtccggctataaattctgcaagaatattagggttcccataaggttttgcaattcttttgatagcaatgttaagttttcggttcatacaatttaactctttttgtatagtcatctgtaattcttcgaccccttgcggtcgactttctagtaagaatttggggaatcccataaagattatgacctggataagatcgattcttttttgaatctctatacgtgcaattccctctaaggcagaagatattttcatattcttttgtacataatccttgatacaatctcttattttttgatcttcttgtaaaccctcaaaataattttttggttgtgcaaaccaaagagaatgatgaccttgggttgtaccaagtctgaaaccaagtggatttattttttgtcccatattcccccactactatacatatcacgatacgtcatagctgtatgcttatttttccatctaggtttttttaacgaatccatctctacatatttatcatctaaagatatatctttcattacaatagttatatgacaggtaggtttttttatcggataactacgcccccgagccctaggttttaatctcttgatggtagtacccttgttgacttcggctttactaatgactaaattggcttcgttggaagccatattgtaactagcatttgctgctgcagaataaaccaatttaaaaatgggataacatgctcgatagggcataagttcgagtatcataagtgtttcttcataggaacgtccgcgaatttggtcaattactcttcgtgctttgtcagcagacatagggatatgttgacctaaagcatatacttctgttttttttctgtcttttttatcataaggtgcctcctactactgaatcatcataagcatcgttatatttcatatttattaattcatatttattaaattaacgaaattaacgacgagatctattatcgccttttgcatgtcctcggaaatttaaagtaggtgaaaattctcccaatttgtggcccaccatacgatctgttatgtaaataggaagatgctcctttccattatggatagcaatggtatgcccgatcattgtggggataatggtagatgctcgggaccaagttacgattatttctttttctgcttttgtgttaagtttatcaattttttttaataaatggttagctacaaaaggattttttttagtgaacgtgtcacagcttactcctattttttctttttgttttgtaaagacgaagaaaaaaattcgattttctctcctatttactatttactacggcgacgaagaatcaaattatcactatatttattcctttttctacttcttcttccaagtgcaggataaccccaaggggttgtgggtttttttctaccaattggggctctcccttcaccacccccatggggatggtctacagggttcataactactcctcttactacaggacgcttacctagccaacgcttagatccggctctacccaaacttttctggttcaccccaacattccccacttgtccgactgttgctgagcagtttttggatatcaaacggacctccccagaaggtaattttaatgtggccgatttcccctcttttgcaatcagtttcgctacagcacccgctgctctagctaattgtccaccctttccaagtgtgatttctatgttatgtatggccgtgcctaagggcatatcggttgaagtagattcttctttttgatcaatcaaaaccccttcccaaactgtacaagcttcttacaaagcatacggctttctggatgtagatgatgatatctatacagatggatcttatatcgtacaatgacccatggttggatatatgaatccaaccgaatgactcatgttatgatcttctacatcctaggtcttcccgttccgtcatctggcttatgttcttcatgtagcattcagaccgaatgactctatgaaattacgtcgatacttccacatattatgggtaacgtaggagacatctctatttttccccccgggaatctttagaattaccactgcttagctttcaattcgcctctgaccatcaaatgaaatgtgaataacccgccctcctctctttgaaagaaggggcgcttccggttctgtcggtgcttgaaacaattttgtcttctccatattactatatctctagagtcaataattttatatgaggaactactgaactcaatcacttgctgccgttactcttcagttttctgttgaggtctatcctgtagaggtactcaaattggatcagtgatcgatttctaggtttcgtcgtaaacctaattggttacttccaattacgtaaatcaatagttcaaaccgcactcaaaggtagggcatttcccatttttataggaacttctgtaccagaaacaatggtatctccaattatagcccccctgggatgtaaaatatatctcttctcaccatccccatagtgtatgagacaaatgtatgcatttcgattagggtcgtattctatggttacgattctaccatatatgtctttttcattccgtcgaaaatcgattttacggtatagacgcttatgacctccccctctatgccctgcggtaatgattcctctggcattacgacctttaccacaacgatgctgtccatagatctaaattatttcgtgtattggatttcacttg

SEQ ID NO: 4726 - DNA, 22816 bp, Aristolochia fimbriata
ttatgcaaggtgacattgcttttgctaattctaattgaagggtgatatcaaattggtccatttccttttttggcgtcatatacatagttagcgcattcgtcatagttagcagctccgtatcaaggtcatcatcaatatcgtcactatcatcaatatcgatagcgtcacgatcatcaatatcgatatcatcaataagataacctttaggcttgttattcaggaacttattcggaaataccgtaatgaaaggaacataggagtttgtcgttaggtatttgaccaaatatgatcgtccagttcctatagaacctatcactaaaatacccctagaaggggatagagctaagcggagcgaaaagggttttccatgagatgggaaatgaaaactattagccccacacgaggtttgtgaataagtgattgtctgataatgagcaaggaatatccgtctttctgctaaacaggatctattgaactcataattcattagacactttttatgaatgtcaactaagtatcgtaagtaaattgatcccggttcttcaatcatttcataaccagagtcattctttgataaatgatcactatgagtcagactcaatagaatttgatcaatccttttttctgtcgttaaggtggagaactgaaccaagaattctctttcttcctcatcaatcgaatcactgttcgcgacccaggattctattttatcatcaatccaatcacctttcacgttttttctttttcttatcaatgaatagatctctttacttgtacgacttagatgtctcgtatttctcgaaaaagtgattcgattgatgggatttggtatgatacttatgagatcgatgatatcaatgagattaatattcaaatatttcttcttagaacgtattgatttgaccccataaacgggacccccacccaatagcatgttgccgccagaagcagaaccccatatttctaccagagaatctcctaattgttccagagcaactagaaagagattctttaaccagaaagaattcagttcagatgtaggatacctatccagaagttttcgcaactcaatcgtgtatgatggaatcatcaaagatttgatcttttctaactctgtctgtaactcactagaggctcgggaaacaaagagaagatgtgtacgaacgagatatccagcaacaagaagaaggaaaaggattgagtagaggaactcccgagcatttggtgatctcagatgtctccatatcaatagaacgggtgactcattatttcgatgaatcatttcttcggacagaagaagattctgtaagcacttactcggcatctcacttatcagattccattgtggaagaatcgccaaccattttttctgaggaattggccatgatatatctgatccatgcataatatcagatacaaatttttgactgctacttagtatcgacaatgggtctgaaaaagtatctaaaagggtgaaatttagatatttgcaccctgtcgaagtaaggaaccatggcatataggtttggaacagattccattttgagagatttgaaaaagcactatctcgttgaaaggttctatacatctgccgtttctcaacgcatttctttagacaaagactccgttttttcctctttccgggtggtaaatatttctcagaacatggagtgtgaatcaaacccatgcttgaattgaaactgagatactgatgaaagttcttcccttctgaatcagatagattcatatctgaaagaggctgacaataagttctttcaaaattgactatttgttcctctgttagaggtgttccagaaatgtctgcgatcgagtaaatagctctacgaacgaatggatcggatcgaattggaaaatggaaagatttgtacaagttatacgtttcgtccccactttgtggaaaatcgttaggtatgaatatgtcagatacctgtgactcgattggtgaaatagtatctctctccaaaaaaaacatgttttttttactgacgcacgaagaaaatattttgttgcgaatgaacaagatattgaggaattgtccatatgtaagatcataattattggtacgggtcttttccacatcaaaagggaatcttttgttacaatagaaccagaagtgatgtggattattcaagaatcgaagtcgatttgctttataaaaagaagatatcaatgaacttctatgaaatggtttcacgggattcagccaattgtctcgatcgtgggatatcattgagaaataggaatccgtgttatcaaaggatttcctgcgattctttctagtatggaatgagtcaatcatccactttggtatcttattgaacaaaaagggtgatattgttcctccattgatcaagaatttcgatctttgggaagtatcatgatcatccaataagaagggtttcaatttattcaaatgaacgatttgaacacctattgattctaacaactgattgcagagttgatcattcggacctttcaattcatagatgtggatctcggacctatgaatgggggtattcccgatactcacaaagaaaaagggaagtgacttagacaaaaagagaagtgacttggacaaaaggagaagtaacttggacaaaaagaaacgaagtgacttagacaaatcttgtttgtcgataacctcggaccaatcaatcgaatattgattaatacgtaatcgatcgaacactacttgaaaacggtgtttctgttcagaaaagaaatggtccaaatgttcctggaaattcttgctcccattggaccatttgtatctatatgcattaggatcccaattcatggatctctcggttcgagaaataagaggatcgaaccatttcttctgactctttttcaaattcgataaatgttggttgatcgtatattttattatagttagatgattcagaggatcatttcctatttgatccctttgaattccatattcgaagttgcgatcggatcgattcattaaaaagaatcgattcgatacatttcttatgtacccataggtgctatattggatttgaatccgatttaggatcaatctatattgattgaccgcctccattatgttgttgctagcaaataccactatttttggttttggatcatcttccaaatcattcccgcaggagatccggaccgatttttttctgatccttcgataaaaagattcattctcttcataaaaaataggaggtagaaccactaaagatttccttttcgactcatccctggagttgaatacctcattcaagaattttttttgatccaatccgtaggaatcaatagaaaaggcaaatcccttatgatacaccagatccggctcggttattgatagagtgaatagatctgccatttcttgaaatctctcttctgattcaaaatcgtggtgtaacgtgtatccccctttgttccggtcatggaatagatgaaataaatcaaaaaatggatttttgttcaagaatgaaatcttattggaactgtccatatccggttcatccctcggaaccatattacatcccggatctgatgaaataggatgaattgagacggtattttgtaaatacgtaattatcttgaatatatcaaccatttctttattttccgatcgcctggaagggacaaaagaaagatcttgttgtttcttcaacaatttctgatctctagtggacctctccgtaggattcgaacccagatgaagttctgaccatctgtcagagaaaaaagaacgaattgatcttgaaggatcccaaagaatcgatctttcttttagttgtggaatctctgtttgattgatcaatgtgtgatattccgaatcctcattcctaatggaatcgaaatgatctctggattgatcagaagatcctttccattggctagaatccgttacttgaacgaaaatagatcttgtggaatcatattgaatatttgacgatacattccgtaccttgctaaaaaaccgatccttgtttaccaaccacgcattgtctaaccaaatccaattttctctcgatacgttcctcaaaaaatccgattcgtgctgattcttcccccaactaacgaagagatcttggcggaattgccacaaatgatattgagcacaattttgcaaagaaataccccacttgtttctcgagaagagatgggaaagatgctcaatatcatttgattgaatagttgcctcagctccttgttgtttgaagaaaccctccacttcaattggtcttttttcacgaaaagcagacatgagataacaaatcaagtgtttcactaagatttcgaagagctgtcccgaattcaagttgattatgtttcgcttcttcctcggagaaagacgatcaaagaattcccaatcagggtccttgcggatcggatcatccgtataggatacaaaaataaactccagatatttgatatctttctctttgaatgagatctcaattccagctatggtttcattagctatcttacaactagaatccctcttttttccgatccggttcctccaccaccgcgaaccccagttagattcaggcatgatacactttttagttattgggagaacccaagtactctctttcgaatccatgaaacaactctcagggatctttttcccttttggaagatacaggagcgaaacaatcaacctattgatattggaagaccaaaaagattcttccaacgtatcatttctgggtccaatggaattcataggtataggaagaagcctcatcaaatagagattttttctttcgaccatattttgattgttaatacaatatataaggaccgctactacaagcagtactacacctttgatcgtgaaatatcgattgcttgttgaaccctgtgaatcacgcgaaagtgaaagtaggatactccaaattcgggggtcaaagagtttcataaaacgttcttggtggaaaaaaatgggagtgaaagatcccgctgaatcgaattgggtccatgaatctaagaaatagtgggaattcttgatctctctcaatatctctctcaattcgaagatccagaatttgaattgatgtcctttcattgattcctcctaaagatttcatttcaattggaatttggttattcacgatgtacgatgatctctgttaagcatccatggctgaatggttaaagcgcccaactcataattggcaaattcgtaggttcaattcctgctggatgcacgccaatgggaacgtccaataagtctaataagtctattggaattggctcggtatcaatggaatttcatcatccatacataacgaattggtatggtatattcataccataacatatgaagagtaaagactcgaattcttatcgatactggaactcatagggaagaaaatggatttatggatggaataaaatatgcagtctttacagaaaaaagtattcggttattggggaacaatcaatatacttctaatgtcgaatcaggatcaactaggaccgaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctcttatagcgaaaagaacttaaatcaaaatacttaataacatggcgatacatttatacaaaacttctaccccgagcacacgcaatggagccgtagacagtcaagtgaaatccaatccacgaaataatttgatctatggacagcatcgttgtggtaaaggtcgtaatgcccgaggcatcattaccacagggcatagaggggggggtcataagcgtctataccgtaaaattgattttcgacggaatgaaaaagacatatctggtagaatcgtaaccatagaatacgaccctaatagaaatgcatgcatttgtctcatacactatggggatggtgagaagagatatattttacatcccagaggggctataattggagataccattgtttctggtacagaagttcctatatcgatgggaaatgccctacctttgagtgcggtttgaactattgatttacgtaattggaagtaaccaattaggtttacgacgaaacctagaaatcgatcacttttgagtacctctatgggatagacctcaacagaaaactgaagagtaacggcagcaagtgattgagttcagtagttcctcatataaaattattgactctcgagatatggtaatatggagaagacaaaattgtttgaagcacggacagaaccgaaagcgccccttgtttcaaagagagggagacggtttattcacatttcatttgatggtcagaggcgaattgaaagctaagcagtggtaattctaaggatctcccgggggaaaaatagagatgtctcctacgttacccgtaatatgtggaagtatcgacgtaatttcatagagtcattcggtctgaatgctacatgaagaacataagccagatgacggaacgggaagacctaggatgtataagatcctaacatgagcgattcggcagatttgaattcctatatatccactcatgtcgtacttcatcatacgattcatataagatccatctgtctagatatcatcatatacatccagaaagccgtatgctttggaagaagcttgtacggtttgggaaggggtttttttgatcaaaaagaagaatctacttcaaccgatatgcccttaggcacggccatacataacatagaaataacacttggaaagggtggaaaattagctagagctgcaggtgctgtagcgaaactgattgcaaaagagggtaaatcggccacattaagattaccatctggggaggtccgtttgatatccaaaaactgctcagcaacagtcggacaagtgggtaatgttggtgtgaaccagaaaagtttgggtaaagccggatctaagtgttggctaggtaagcgtcctgtagtaagaggagtagttatgaaccctgtagaccatccccatgggggcggggaagggagggctccaattggtagaaaaaaacccacaaccccttggggttatcctgcgcttggaagaagaactaggaaaaagaataaatatagtgatatttttattcttcgccgccgtaaataaaataggaagaagaaaataggagggcgaacgactagtcgtctttacctttagaaaaagaagaataagacaaaacaaaaaaaaaggagtaatccgcagtggcgcgttcactaaaaaaaaatccttttgtagctaatcatttattaaaaaaaattgagaagctgaacatggaggagaaaaaagaaataattgtaacttggtcccggtcgtctaccattatacccacaatgatcggccatacaatcgctattcataatggaaaggaacatttacctatttacataacagatcgtatggtgggtcacaaattgggagaattcgcacctactcttactttccggggacacgcgagaaacgataatagatctcgtcgttaatgaagtaaaaagggggctcatcattcagtgttgggaggtaaaccttatggcaggtaagtggaggactagcaatcaaacgtctaataaaaggagtaataaaatcaagagtagacaagtgcaagctttagctcaacatatacgtatgtcggctcacaaaacacgaagagtcattgatcaaattcgcggacgttcttatgaagaaacacttatgctactggaactcatgccttatcgagcatcctatcctatttttaaattgctttattccgcagcagcaaatgctagtcataataggggtttcaacgaaggagatttatacattagtaaagcggaagtcaatgagggtgctatcatgaaaaggttaaaaccccgggcgcgaggacgtagttatccaataaaaaaacccacctgtcatataacaattgtattgaaaaagactactgagaactttcctaatgaagctaatgaagccgaagggttttagggtggtataatagaaagatattaaaaggagaaagagagagaaagagagagatgggaaaaaataaatccacttggtttccgacttggtacaaatcagaatcatcgttccctttggttcgcacaaccaaaaagttattcgagggatctccaggaagatgaaaaaataagggattgtatcaagaattatgtacaaaaaaataggagaatatcctcaggtttcgagggaattgcacacatagagattcaaaaaaaaatagatctgatccaggtcataatccatataggattccctaatttgttaatcgagggtcgaacacgaggaatctatgaattacagactgatgtaaaaaaaggatttcattctgtaaaccggagacttaacattgctatcacaagagttacaaaaccttatgggcagcctaatattcttgcggaatacatagctctccaattaaaaaatagagtttcatttcgaaaggcaatgaaaagggctattgaattaactgagcaagcggatacaaaaggaattcaagtgcaaattggagggcgtattgatggaaaagaaattgcgcgtgtcgaatgggtcagagagggtagggttcccctacaaaccattcgggctaaaattgattattgttcctacccagttcgaactatctatggggtattaggcattaaaatttggatatttgtcgatgagcaataatggacctttcattctttgccattctatccggcaatacaataggagaataaatgaaaaaagagtttcagtctttttttttaccttgaatcaaaatgagcaattctgattctttagaattctatagggttaaataaaaattcaattgaccatttagtaaaattgctatgcttagtgtgtgactcgttggttttttctttagagttgggataaaaaaaaacaataatacacagaccgatcccaaactaataactatagaactaataacctactcatagcttcgtattatcgggatccaagaaatcagtcactatatgatgtgacgatcgtatagttgtagcaactgaaatctttttcttttccacataatggaaaaatcaagctgattatgggttgcaaataaaaaatgagagatgggggtaaatggaaggatgagagaaagagagcaggagaatctcgatgatataaaattccaatatgtatggcctatgaatcatctcataaaaagcagtgtaataaggcattaatgtggattcgcctatactataattcgatgaatccgattcggttcatatttaaaatgataataataaggagccttgagtcaatagagactgagaagattgactctggaacggatttaattggaagctccattgcatatagttcaggcctagccattaatgaagaagctatgggaacgacggaacctgtgactgcagaagattctattgcaaatgaatcctaattattcattgagtgggatggcgaaatggaccagtaaccaattgatttattccgggaagtcgtgggttaaccctgccctaggaaccctaggaatgggtcggatgacagagtaaatattcgcccgcgaaagaaacacaacacttattggattgaaataatttttggctattcagtaaaggtcaaaacagagattcggtataaaaatgaaaggtattttctaccaaatagacgtcctatatcctataaaaaaaaatcgatagatatatatatctagctatatatacaatataagatatacggattcccacgtaacaaacagattaaattaagtatcaaaaaatcccatgattttgtgtaatattcattattcattaaatacatgtgcatcgaatagtatagaatcatttcattcgtgaggagctggatgagaagaaactctcatgtccggttctgtagtagagatggaactgagaaacaaccatcaactataaccccaaaagaaccagattccgtaaacaacatagaggaagaatgaagggaatctcttatcgcggcaatcatatttgttttggtagatatgctcttcaggcactgaaccctcttggattacatctagacaaatagaagccgggcggcgagcaatgacacgatatgcgcgccgcggtggaaaaatatgggtacgtatatttcccgacaagcccgttaccctaagacccacagaaacacgtatgggttccgggaagggatctcccgaatattgggtattcgtcgttaaaccgggtagaatactttatgaaatgggcggagtatcagaaactgtagctagagcggctatgtcaatagctgcatccaaaatgcctatacgaactcaattcattattgcgggataggggtgtggaaacaaagggctatttgtgaggagaaatacaatcgcagattttttgatttctggacaaacaatatttctttcttttttccttcaccctttgcattgaaagagctgataaaaaaaaaacgataatgatatgattcaaactcagacccatttaaatgtagcagacaacagcggagctcgggaattgatgtgtattcgaatcttaggagctagtaatcgccgatatgctcatattggtgacgttattgttgctgtaatcaaagaagcagtgccaaatatgcctctccaaagatccgaggtaattagagctgtaattgtacgtacatgtaaagaactcaaacgcgacaatggcatgataatacgatatgatgacaatgcagcagttgtcattgatcaggaaggaaatccaaaaggaactcgagtttttggagcgatcgctcgggaactgagacagttgaatttcactaaaatagtatcattagctcctgaggtattataaaaaataccagtaaatgagatcgggatcggcatatccatgattatagggtacaaaaaatagattaattaatatagattatgtctcatgcatatacctttaatatttcatatcataaaaaaagtggaacatgttgattatatcaaaacaaagaggcaccaataattatagttcatcatgggtagggacactattgccgatataataacttctataaggaatgctgatatgaataaaaagggaacggttcgaatagcatctactaatatcaccgaaaacattgttagaatacttctacgagaaggttttattgaaaacgttaggaaacatcgagaaaacaataaaaatttcttggtttcaacccttcgacatagaaggaataggaaaggaacatatagaaatattttaaagcgtatcagccgaccaggtttacgaatatattccaactctcaacgaattcctagggttttgggtggaatggggattgtcattctttcgacttcgagggggataatgacggatcgagaggctcgactaaaaaggattggaggagaaattttgtgttatatatggtaattccgcttatatcccgtaacttcccatttgtgaaaaagaaaggaaaggcaggttgtttaatatcacttctcctccattagttgatacttcaagggggttaccgggaatgaaagaacaaaaatttattcatgaaggtttaattactgaatcacttcccaatggtatgttccgggttcgtttagataatgaggatctgattctaggttatgtttcggggaggatccgacgtagttttatacggatattacccggagatagagtcaaaatcgaagtaagtcgttatgattcaaccaagggacgtataatttatagacttcgcaacaaagattcaagcaacaaagattcaagcaacaaagattcgaacaattaggcgcctcttgaaacattcctttcatggggtgcgagtacaattagaggttcaaaatctcaagagacttattttcttccaaggagtgaattcggatttaagataaggaatgacaaatatgaaaataagggcttctgttcgtaaaatttgtgaaaaatgtcgattgatccgtaggcggggacgaattatactaatttgttccaacccgagacataaacagagacaagggtaatccttttaaaatttaaaggggactctctaaaggacctgatgtacaaaaaaaggatctgttttgacacgaaatggatatctccgtatatctctgactcatatttatgagaatgaaaaaatatgacaaaacctataccaagaactggttcacgtaggagtggccgtatcggttcacgtaagactgggcgtagaataccaaaaggagttattcatgttcaagcaagtttcaacaataccattgtaactgttacagatgtacgaggtcgggtggtttcttggtcctccgcgggtacttgtggattcaagggcacaagaagagggacgccatttgctgctcaaaccgcagcaggaaatgctattcgtacagtggtggatcagggtatgcaacgagcagaagtcatgataaaaggtcctggtctcggaagagatgcagcattacgagccattcgtagaagcggtatacttttaagtttcgtacgtgacgtaacccctatgccacataatggatgtagaccccctaaaaaaagacgtgtgtagaaataagaattgaaccctttttattttaatttcaagagaaataaatgattcataaatctgataaaatcatattggtatggttcgagaagaagttgcagtatccactcgaacattacggtggaagtgtgttgaatcaagagtagacagtaagcgctttcattatggtcgtttcattctgtccccgcttttgaagggtcaagcagatatgataggtatcgcgatgcgaaggtctctactcggggaaatagagggagcatgtatcacacgtgcaaaatccaataaggtaccgcatgactattctataatagtcggtattgaagaatcagtacatgaaattttaatgaatttaaaagaaattgtattgagaagtaatctgtatggaactcttgacgcatctatttgcgtcaggggtcctagatacgtaactgctcaagatatcatctcaccaccctctgtggaaatagttgatactacacagcgtatagctagcctgacagacccgattaacttgtgtattgaattaaaaatcgaaaggaatcgcggatatcgtatgaaaaccccatctaactatcaagatggaagttaccctatagatgctgtattcatgcctgttcgaaatgtgaatcatagtattcattcttatgggaatgggaacgagaaacaagaaatacttttcctagaaatatggacaaatgggagtttaacccctaaagaagcacttcacgaagcttcccgtaatttgattgatttatttattccttttttacacgcggaggaacgggacaatcatttagaggacaatcaaaacagggttactttacccctttttccctttgatggtgggttggttaaggctaatataaggaaaaacaaaaaggaaaatgcattgaaatgtatttttattgaccaattagaattgcctcccaggacttataattgtcttaaaaggtccaatatacatacattattggaccttttgagtaacagtcaagaagatcttatgagaattgagcattttcgcatagaagatgtaaaacaaatattggacattttacagaagcatttcgaaattgatttacatttacctaaaaaaagttttaaatccattggaattagttcatttttactaaagaaaaaaagttttgaatctttagcacgatccgtatattttgaatggatccataatgaaatttgagagatgtatctaggggagattcgctttgaagcgactattccctagatacatacgttatgttagtttatttcaatttcacagtaaaatcaatttccattttttttttaaaaaagacctaaagttagagatttatcaataggtaatgttgctccaatacctaaccaaagagctactgcggtgccgatcaaaaaaactgttgtagctactggacgacgaaatgggttttggaatttattaacattctccaaaaaaggtactgtcaataatcccgccggtactgaaaccattaaaagaacacccaacagcttattgggtactgtacggagtatttgaaatacgggaaagaaataccattcgggtaatatttccaagggtgttgcaaatggatccgcgggttcaccaatcattgacggttctagaaccgctagacctacattacatgcaatagtacctagaataactactggaaaaatatataaaagatcattgggccatgcgggttcgccataataattatggcccatccctttagccaatttagctcttaatacaggatcgttcaaatcaggtttctttgttactcccataatccatctctcttgggggaatccacttcaactactcgtatcaaattaaagaatacttttggattagttgagggaaaatttccaactaaaatgtcttattttttttttttatttttcaataatacatatctgtagcaatgaaatactatagttcctcaccaaaacgaaatgatatatgatcgattacaaataagtatgtcttctctataaaggacctgaaataccctgcttacgtatcattaggaagtgcattaacataaatacggcagtaagaagaggtaatacaaaagtgtgtaaactataaaaacgggtcaaagtggattgacccacactagcacttccacgtaatagctctaccaagggcgaacctattacaggaatcgcttcaggtacgcctgtcacgattttgactgcccaataaccaatttggtcccaaggtaaggaataaccagttacaccaaaagatgcagtcaatacagccagaaccacacccgtaacccaagttaattcgcgaggttttttaaatccacctgtgagatagacacgaaatacgtgcaagatcatcattaggaccatcatacttgctgaccatcgatgaactgatcggattaaccagccaaagttggcttcagtcattatgtattgaacagaggcaaaagcctccgtaacagtcggacgatagtaaaaagtcatagcaaaacccgtagcgacttgtactaaaaaacaagtaagtgtgatcccccctagacaataaaatatgttgacatgaggaggaacatatttactagttatatcatcggcaatcgcctgaatctcgagacgttcctcgaaccaatcatatactttattgagataggtaaaccgacagacccccctaagaaccgtatatgaaaatttcatctcgtacggctcaagcgaaaacaccaaaatggttaaaacagatacgtaatagaaagtttgaaatttcttaatcacttggttcaaacatctctgaggatatgaaggaaccaaaatccgaaatccccctttttgatggtaatgccaaaatctcaagtgggctcatccgtctttatattgatcgttacaggcctcttgaattttctcttcccctatttttttatttgatttgttgtttgtgcgtaatatggatttactatttgtattcttttgtttactcttgctaggaattctcttgttgaaaccctatgatttgattgaaacctaagattcatactagaaccacgatgattcaataaagccctaaagctaagccaaaaggttctctgagtaagaaccatttgatcatcacttacttaatgaatagatgttatgactaaaaatccagagacaaatttgtctttcggtcaaaataaacacgattcggaaagagaaaaaatcgttcgatttatgaaatacctctttgaaaattttttgagttggagtccggtcgcgaggtctgaatagtaggtatgaatcatagtttaaatatttctcttgagctattctatgtattccgtgctccagatactcgaataaatatccgacggagcagaaccatctccattgagatgagatgacagacccttttctgcactatcaataggatcaattataacaagtcacacactcatattccggaactaccgaaacaacgaaattccgcggtcgaactaccagaatgatccagaaatccgagtcctaagcgatttttttttgattcaaaagctaggacttcgtttttcttgtgggactaactcattgaaattccatccagtaaaacggaagaattataaatctccaaaataatagataggaatatcgcaaatagagccattgcgacacccattaagggggtagttccccatccaggagctactttaccatattccgaattcaacggtttcaataaatcccctgtaagagttcttcttggcccagatctagaactgtcctcaacggtttgtgtagccataaatccaattgcattggttgagatctgttgactttgtatactattccgttgtaaataaacgatcttgtcgtaatgtagatccactgtatcgtggtcttgaaattttctaataatggaaacagcaaccttagtcgccatctctatatccggttcacttgtaagctttactgggtatgccttatatactgcttttgggcagccctctcaacaactaagagatccgttcgaggaacacggagactagttgaaatgatgaacctcccttattagttgggaggctcattacttcaattgagataataaaaaatcatttctactttttagtagaaatcctaggcggatctcgaaaaaagatagcgaaaaaaattatccctagagtcgaaattaacaggaatgtataaaccaatgcttccatagattcgatcgtggtttacaattatagcttccacacctgttcatttgggatcatttcccagacaaggaaagggtaatatttaaattaaagaaaagcaataatgaaaataaaaatttctctggtaccctacctatacctatgctaaataaaaaaaatggaggcgaatgataccagaccagaacaacgttgtatcaaactacttgtctccttgtagttggatctccaagtttttggaatgtcccaaattcgacttgagcatccaaatctgggtcaatcccagcaaaaacatctctgaacaaggttctagcaccatgccaaatgtgtccgaaaaagaagagcaaagcaaatgaagcatgtccaaaagtgaaccaaccccttggactgctacgaaaaacaccatctgatttcaaagtagcacgatctaattcaaaaatttcacccaattgtgcgcgtctagcatattttttcacagtagccggatcactatagccgattccattgagttcgccaccatagaactcaacagttacgcctacttgttcgacactatattttgattctgcccttctaaaaggaacatcggctcgcacaattccatctccgtctaccaaaacgactggaaatgtttcaaaaaaagtaggcatacggcgtacaaaaagctcatgcccctctttatctctaaagacggggtgccctaaccacccaacagctatcccatccccgttgtccattgagcccgctcggaataatccccctttcgccggattattcccgatgtaatcataaaaagctaatttttcgggaactttcgaccaagcttctgataaactcagattttcggctagtccggcgccaactcttcgatatatttcttgctggaagtacccctgatcccattgataacgggtgggcccaaataattcgatgggggtagttgctgaaccataccacatcgttccagcaactacaaaagctgcaaaaaagacagcagcaatactactggaaaggacagtttcaatattacccatacgtaatcctttgtatagtcgttggggcgggcggacgctaagatggaataggcccgctaatatgcccaatgtccccgctgcaatatgatgggaggctattccccccggaacaaaaggatcaaaaccttccgccccccacgctggatttacaggttgtacttttccggttagaccataggggtcggacacccatattccaggaccatacaagcctgttacatgaaatgcaccaaaaccaaagcaagccaaccctgagagaaataaatgaattccaaagatcttgggcaaatccaaggagggttttcccgtacgttcatcacagaatatttctaggtcccaatacacccaatgccagatggctgctaagaagcacaagccggaaaacacaatatgtgccccggccacaccttcgtaactccaaataccgggattcgctacagttcctcctgtgatactccagccaccccatgaattggttattcctaaacgagtcatgaaaggtataacaaacataccctgtctccacattggatcaagaacagggtcagagggatcaaaaaccgctaattcatatagggccatcgagccggcccaaccagaaactagagctgtatgcattatatggacagaaagtaagcgaccgggatcattcaatacgacggtatgaacacgataccaaggcaaacccatggaaataccccttttttatcaaagaaaaatagacactatgtgactttatcgcattggaaaagactatgctccgcctttcagtggattatctcgaggcaagggtaaatatttattctattcccttcccttccattggaaataattgaacaattctgttcgtaggaacaaagagaaacaaatctattctatacccgataagtaccaatacgcaatgggggtcccatttttgtttttttgagcgaatgcatagagacttgttcatcattcgaatgatccattcgtaataattttcttttccgttattcactctgtcttcctccatgaaccctccaatctatggccaatctatggataaaatccaataaacgtttttgtttttaaaataggataaatgcaaatattagttagtaaggcgagaaacctatttttacgtttccacattaaagtaaaatatagtacttagtgctttttttgtttaacttaatgcccattggtgttccaagagtgccttttcggaatcctggagaggaagatgcagtttggattgacgtatagtgcgacttgtcagacatattgggtcatatgggatttccccgttctctcccccgattgagataccccccgttttgcccaagaaagattgattgaatcattaatcataattcgaattcggagcgtgaagcgcaattagatcaatttatttgttggtttggggatcaaaattatatcaattaatccatattatcaactagaataatttatggttaggttggaccaataagaagtatccaggctccgttcaggaaataccaaatttggaatctacgtatgattatcgcctggatcataatggattcttattatcttattatatttataccaaaaataaaataatatagatatataaaaataaaaatataaaaatatataatataagcgatctcaaactgccaatcaataaagtaatatgatgaatacatcaaatatttggtattggcagaaggtatgaaaccgaccaaattgaaaaaaaaaaaagaagtcgtagcaaaaacaaaaaaaaaagtaggtactgggattatttgcactatatgtgcaaatagaattcgggcatatttttacccggagtagagcataaacctaaaagagttgaggaggcccatttaggaacaagaaaatgacatcgtgattcggatctcgatgaacccaatacatcaatggcaggttagttcgataagttcaatgaattcttttttttttttatattatatttataggttaatataaattcttataggttaaaaggaagcgattcaaaactcacgtttcttaaaaatggaagaaaaagcctcttcgtttagttaggaaaagctttttattttacaaaaaacaaagagggctggaatcaacacattgattctttttttttttaatttcgaaatttggatttttttgaaccgtatgcatctaaaggcgcgtgtgcggttccgaaggaaattttgtcctaatcaaccgactttatcgagaaagattactttttttagggcaacaggttgatagcgagatctcgaatcaaattatgggtctcatgatatatctcagtatagaaaatgtgaacaaggacttttatttgtttataaactctcccggcgggtgggtaatcccgggaatagccatttatgacactatgcaattggtggcaccggctgtacatacaatatgcatcggattagccgcttcaatgggatcttttatcctggtcgggggagaaattaccaaacgtatagcattccctcacgcttggcgccaatgaattttttatttttatttgagagaaaacataagactatgccttcgctatctggaatataaataataagtaataatagcatggcacctcgatctcgatattaacataacaaacctttatttgaatttttttttttccataacatgagattctgtatcgagatagtagtatgaaacaaagattatttcccgatttcatcttatgtatcgggggtctgtttcagcgtcacaaacaaatctttttttgcttttacaccagaagtctctttcctatatttaggttatgaaagagtacgaaagaaaatgaaaaaaaaaaaaaataatttttacttatttgatccgatcagaaagagactttgggattgcagaatcacagacgagataaaataaataaaatatataaagcaacggaaccatcatagtatttttggctcttccgaaaggaaggatggtaaatggagcattcaacgatctggatctgatggatcttatttgtctctttcttcaatggaggggaaaaggaaattccatttaggagccgtatgcaatgcacaaaaaaatatgcctgtacggttgttcaattctatctttttcctcttgcttggtattctttatcccatgcgatcgtgcgagacgagataggggaatccctcattatgttattatatcgccagggttatgatccaccaacctgctagctctttttatgaggcaacaacaggagaatttatcctggaagcggaagaactactaagactacgcgaaaccctcacaagggtttatgcacaaagaacgctaaaacccttatgggttatatccgaagacatggaaagggatgtttttatgtcagcaacagaagcccaagctcacggcattgttgatcttgtagggaccaaaaataccgagggtttcgcataaaaatcctagattctatcttgaaccctaattagaatgattcgtaatttcatatttttattttctgttcttagccaggtaaaaaattaagaagtaattcatcatgatcgggttaggatcgatctaaaccagcctttgtatacgatgcagcatgccaactattaaacaacttattagaaacacaagacagccaatccacaatgttacgaaatcccctgctcttcgaggatgtcctcagcgtcgaggaacatgtactagggtgtatgtgcgacgcgttcagatcatgggctggaacaaatgagacaatttttccagtataaatgaccagtaccaaagaataggatggaatggacgaactccattcaccatataaaaataaagatctatcatatacctatattgtgtatgttgtgtatggaatttatggtttccattggtgcaaatcccatcacctcaatttgagatgaaaagcaattccccattggtagcaagtggtatccattaagcggggaaatggtatttaaaaaacagaaaaattctgttcctactcttgcaagaacggactaacagggtcagctacctagccaaccttcacaattaaatgccgtcactgtatggatagatctagttgtgaaaagacctattactgtataattcatgggtagagccaaagagtgtgaactgtacaagttaccaaaacattgattaaatgagtaaggggctccggtgtatagagaggacctcaccgtttaagaagtaaccatagaaacgatggaagccactatttctattttatttatttatttattcatttactacgtatttattattactattactatttatttgatacttaatatcgatatcgataaaatttattattattttttttttgttttggggcgaaatgcctcgaagaaataaaaaatcgtggttgggaaggttatagtagcaaaagccattggaattttttttttatacattggaagaatccgttttgttattaattaaactaggggaggggaaaagaatgactgaaagaaaagaaatcaattagttattcatcaaagttttatttgattcaatgaccagagttaaacgaggatatatagctcggagacgtcgagcaaaaatgcgtttatttgcatcaacctttcgagaggctcattcaagacttactcgaactattatgcaacagaaaacgagagctttggtttctgctcatcgggatagaggccggcaaaagagagattttcggcgtttgtggatcactcggataaacgcagtaacccgcgaggataaggtatcctatagttatagcagattaatacacgatttgcacaagaggcagttgcttcttaaccgtaaaatacttgcgcaaatagctatatcaaataagaattgtctttacatgatttctaatgaaaacatgatttctaatgaaatcatcaaattaaattaaataaggagattgtaattgtaaggaattcgatggaatgatttaagcggagttccccggagaatgaactccgggaagataaaatggaaattcatatgataaaagtaggaatgaataaacacgtttacaaaaaaaaaaaaaagtacggatgcgttgttaccactgctt

SEQ ID NO: 4727 - DNA, 1726 bp, Malus domestica
taaaattattgactctagagatatagtaatatggagaagacaaaattgtttcaagcacctacagaaccagaagcgccccttgtttcaaagagaggaggacgggttattcacatttcatttgatggtcagaggcgaattgaaagctaagcagtggtaattctaaggattccccccggggaaaaatagagatgtctcctacgttacccgtaatatgtggaagtatcgacgtaatttcatagagtcattcggtctgaatgctacatgaagaacataagccagatgaaggaacgggaagacctaggatgtagaagagcataacatgagttattcggcatattttgattcctatatatccactcatgtggtacttcattatatgatatatataagaattatacgatatatataagatccatctgtatagatatcatcatctacatccagaaagccgtatgctttggaagaagcttgtacagtttgggaaggggttttgattgatcaaaaagaagaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtaaagccggatctaaatgttggctgggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggcgagaaaatagaatttgtttcttcgtctttacaaaaaagaaataaaaacaaaaataggagtaattaattgtgacacgttcactaaaaaaaaatccttttgtagcaaatcatttattaagaaaaataaatacacttaacacaaaagcagaaaaagaaataatagtaacctggtcccgagcgtctaccattataccgacaatgatcgggcatactatcgctatccataatggaaaggagcatttgcctatttatataacggatcgtatggtaggacataaattgggagaatttgcacctactctaaatttccgggggcatgcgaaaaatgataatagatcccgtcgttaataattaataaaaaaataataaaatatagatgcttatcgttcattaatgagaggtgaatcttatgatacagaagagaaaggtgaagaaatatacagaagtatacactttaggtcaacatatatgtatgtctgctcacaaagcgagaagagtaattgatcaaattcgtgggcggtcctatgaagaaacacttatgatactagaacttatgccttatcgagcatgttatgccattttaaaattggtttattctgcagcagcaaatgctaatcacaataagggtttgaacgaaacaagtttaatcattagtaaagccgaagtcaacgagggcacaactgtgaaaaaattaaagccccgggctcgaggacggggttatcctataaaaagatccacttgtcatataactattgtattgaaagatatat

SEQ ID NO: 4728 - DNA, 9844 bp, Malus domestica
ctccaataagtctattggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttctaatgtcgaatcaggatcaactaggacagaaataaagcattgggtcgaactcttctttggtgtcaaggtaatagctatgaatagtcatcgactccccggaaagggtagaagaatgggaactattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaactatagaatacgaccctaatcgaaatgcatacatttgtctcatacactatggggatggtgagaaaagatatattttacatcccagaggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcacctacagaaccagaagcgccccttgtttcaaagagaggaggacgggttattcacatttcatttgatggtcagaggcgaattgaaagctaagcagtggtaattctaaggattccccccggggaaaaatagagatgtctcctacgttacccgtaatatgtggaagtatcgacgtaatttcatagagtcattcggtctgaatgctacatgaagaacataagccagatgaaggaacgggaagacctaggatgtagaagagcataacatgagttattcggcatattttgattcctatatatccactcatgtggtacttcattatatgatatatataagaattatacgatatatataagatccatctgtatagatatcatcatctacatccagaaagccgtatgctttggaagaagcttgtacagtttgggaaggggttttgattgatcaaaaagaagaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtaaagccggatctaaatgttggctgggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggcgagaaaatagaatttgtttcttcgtctttacaaaaaagaaataaaaacaaaaataggagtaattaattgtgacacgttcactaaaaaaaaatccttttgtagcaaatcatttattaagaaaaataaatacacttaacacaaaagcagaaaaagaaataatagtaacctggtcccgagcgtctaccattataccgacaatgatcgggcatactatcgctatccataatggaaaggagcatttgcctatttatataacggatcgtatggtaggacataaattgggagaatttgcacctactctaaatttccgggggcatgcgaaaaatgataatagatcccgtcgttaataattaataaaaaaataataaaatatagatgcttatcgttcattaatgagaggtgaatcttatgatacagaagagaaaggtgaagaaatatacagaagtatacactttaggtcaacatatatgtatgtctgctcacaaagcgagaagagtaattgatcaaattcgtgggcggtcctatgaagaaacacttatgatactagaacttatgccttatcgagcatgttatgccattttaaaattggtttattctgcagcagcaaatgctaatcacaataagggtttgaacgaaacaagtttaatcattagtaaagccgaagtcaacgagggcacaactgtgaaaaaattaaagccccgggctcgaggacggggttatcctataaaaagatccacttgtcatataactattgtattgaaagatatatctttagatgaagaggaagaaatagataaaaggaaattctataaattagagctgaggaatacttaaaggaagaatattttatattataaaaaatacaaatacgctatattatgttatgcttaaaaaaaatcgaatgaataaaaaaaaaatacaaacagatgtcacgtttcacgatatatatagtagtgggggattatgggacaaaaaataaatccacttggtttcagacttggtgcaacccaaggtcatcattctctttggtttgcacaaccaaaaaattattcaaaggatctacaagaagatcaaaaaatacgagattgtatcaaaaattatgtgcaaaataatatgaaaatatcctctaatgtagagggaattgcacgtatagagattcaaaaaagaatcgatttgattcaggtcataatctatatgggattccccaagttattaatagaagacaggactcgaagaatcgaagaattacagacgcatgtacaaaaagaactcaattgtgtaaaccgaaaactcaacattgctattacaagaattgcaaatccttatgggcaccccaatattcttgcagaatttatagccggacaattaaagaatagagtttcatttcgcaaagcaatgaaaaaagctattgaattaactgaacaggcaggtacaaaagggattcaagtacaaattgcagggcgtatcgacggaaaagaaattgcacgtgttgaatggatccgagaaggtagagttcctctacaaaccattcgagctaaaattgattattgttcctatgcagttcgaactatctatggggtattaggcatcaaaatttggatatttgtagacgaggaataataagaacttacttgacttatatttagttatatctggtgataaaacaaaaaatggcaaactctttcattctttttctggtaaataataaaaaaaaagaacaattctataaggttgaataaaaattcgattaatcatttgatataattgctatgcttagtgtgtgactcgttggtttttttagggttgggattcaaaaaaatggacagcccatagtacaaactgataactatagaactaataaccaactcatcacttcgtgttatctggatagaaagaaccagtcaagatatgatatataagtcatatcattgtagcaactgaaatcttttttacataaaaaaaaaaaaaaaaaaacaatctgattatgggttgtaaagcaatataaagtatacagataaatggaagggtgagagaaagatagaaaaagaatattaatgatatataattccaatatgtaaggtctatgagtcatctcatataaagggaatgtaataaagcatcaatactgattgatccataattagacaaatccgtgcatagaacaaaaaatcaagagccccgagccaataaagactgagaaggttgactcaagaataaatttaattggaggctccgttgtaaaattcagacctaatcattaatcgagaagtggtgggaacgacagaacctgtgaatgcataagattctattgaaaacgaatcctaatgattcattgagtaggatggcggaacgaaccagaaacctattcatttattctgagaggtcatgtcatagactaatcttacaactgaatgttgaaagagtaaatattcgcccgcgaatattttttttatttctaaattttagtcgattcgaaataaaaggaaaaacaaaataaagattcattatagcgttctaccaaaacgacattatctataaatagaatacgtgttaaattctatattaaaacacaaaaaatttctaatttataatcgattagatcaaatttcaaagaatcccacgattccatatattattaaccgtgtatttttttttgtttaattatttttaattgtttaattcgcgaggagctggatgagaagaaactctcgtgtccggttctgtagtagagatggatggaattgctaaacaaccatcaactataaccccaaaagaaccagattccgtaaacaacacagaggaagaatgaaaggaatatcttatcgaggtaatcgtatttgcttcggtagatatgctcttcaagcgcttgaacccgcttggatcacatctagacaaatagaagcagggcggcgagcaatgacacgaaatgcacgccgcggtggaaaaatatgggtacgcatatttccagacaaacctgttacagtaagacctacagaaacacgtatgggttcggggaaaggatctcccgaatattgggtagctgtcgttaaacccggtagaatactttatgaaatgagcggagtagcagaaaatatagctagaagggctatttcaatagcggcatcgaaaatgcctatacgaactcaattcattctttctggataggaatgtagaaacaaacgaaaggggtttttgggatgaaaaaaaacaattgcaggtttctttttttgttttgaacaaataatatttctttttttttttttatttatacctttgcaaaagaaaaaaccgataaaaaaaaaatgatatgattcaacctcaaacccatttgaatgtagcggataacagcggggcccgagaattgatgtgtattcgaatcataggagctagtaatcgacgatatgctcatattggtgacattattgttgctgtaatcaaggaagcagtaccaaatacacctctagaaagatcagaagtggtccgagctgtcattgtacgtacttgtaaagaactcaaacgcgacaacggtatgataatacgatatgatgacaacgctgcggttgttattgatcaagaaggaaatccaaaaggaacccgaattttcggcgcgatcgcccgggaattaagacagttaaatttcactaaaatagtttcattagcacctgaagtattataggggaagaccttaataaagtatttgaatgaaattgattaaatttatttaattaattagtaaattgtttatctatcacgtatatatctttaataattcataaatataaaaaaaaaagaattcataaatattaaaaaattcagaaaaaaagaaaaagagcatgttgattatatcaaaattcgggggaaacaaaaatcttagtttatcatgagtaaagacactattgctgacataataacctctatacgaaatgctgacatgaataaaaaaagaacagttcgaataccatctactaacatcactgaaaatattgttaaaatccttttacaagagggttttattgaaaacgtgagaaaacatcaagaaagcaaaaaatattttttggttttaaccctacgacatagaagaaataggaaaggaccatatagaactgttttaaatttaaaacggatcagtcgacccggtctacgaatatattctaactatcaacgaattcctagaattttaggcggaatgggggttgtaattctttctacttctcgaggtataatgacagaccgaaaggctcgactagaaggaatcggcggagaagttttgtgttatatatggtaatctttctaatagccgacacggtcatatttgtgaaaaaagagaaaggacaagtttataatattatccctcttacattagttgatacttcaaagcggttttacctggaatgaaacaacaaaaatggattcatgagggtttaattactgaacaacttaccgatggtatgtatcttccggattcgtttagataacaaaaaaattattctggtttttgtttcgtaaaggatttcatgtagttttatacgtatactaccaggaaatagactaaaaattgaggtaagtccttatgattcaaccaaagggcgtataatttagagactccaaagcaaagacttgaatgattaggcggttttttcaatttcaacattctttcgtgaggatacaattcgaaattaaaaatttcaagaaacttattttcttccaattaagtagattcggaattaaaaaaaggaatgacaaatatgaaaataagggcctctgttcgtaaaatttgtgaaaaatgtcgattgatccgtaggcggggacgaattatagtaatttgttctaacccgagacataaacaaagacaaggataatctttctaaaacaaaaagactctcgaaatctaaaggacccgatgtacagatgtacaaataaataaaataaaaaataaataagtaaaaaaaaaaaaaaaaagaataaggatctgttttgacatgaaatggatatatccatatatctctgacttatatttatgagatgataaaatatggcaaaacctataccaaaaattggttcgcgtagaaatagacgtattggttcacgtaagaatacacgtagaatccccaagggagttattcatgttcaagcaagtttcaacaataccattgtgactgttacagatgtacggggtcgagtaatttcttggtcctctgccggggcttgtggattcaagggtacaagaaggggtacaccatttgccgctcaaaccgcagcaggaaatgctattcggacagtagtggatcaaggtatgcaacgagcagaagttatgataaaaggcccgggtctcggaagagatgcggcattaagagctattcgtagaagtggtatactattaagtttcatacgggatgtaactcctatgccacataatggctgtaggcctcctaaaaaaagacgtgtgtaaaaataaacattgaagagatttcaagagaaataaataattcaatgatttgatcaaataatatactatggttcgagagaaagtaacagtatctactcggacactacagtggaagtgtgttgaatcaagagcagacagtaagcgtctttattatggacgctttattctggccccacttatgaaaggtcaagccgatacaataggcattgcaatgcgaagagctttgctcggagaaatagaaggtacatgtatcacacgcgcaaaatctgagaaaataccacatgaatattctaccatagtaggtattcaagaatccgtacatgaaattttaatgaatttgaaagaaattgtcttgaaaagtaatctgtatggaactcgtaacgcgtctatttgtgtcaagggtcctggatatgtaactgctcaagacattatcttaccaccttctgtggaaattgttgataatacacagtatatagctaacctaacagaaccaattaatttgtgtattgaattacaaatcgagaggaatcgcggatatcgtataaaaacgccaaataactttcaagacggaagttatcctatagatgctgtattcatgcctgttcgaaatgcgaatcatagtattcattcttatgtgaatgggaatgaaaaacaagagatactttttctcgaaatatggacaaatggaagtttaactcctaaagaagcacttcatgaagcctcccggaatttgattaatttatttattccttttttacatgcagaagaagaaaacttacatttagaaaataatcaacacaaagtgactttacccctctttacttatcatgatagattggctaaacaaaggaaaaataaaaaagaaatcgcattgaaatatatttttattgaccaatcagaattgctccccagggtctataattgcctcaaaaggtccaatatacatacattattggaccttttgaataacagtcaagaagatcttatgaaaatgaaacattttcgcatagaagatgtcaaacatatattgaacattctagaaataaaaaagcatttcgaataaatttttatgagttatttactttttttctttttttttttctaaagttttgtctaaacagataaaaattcgttttgaatcttgaatctttagcacaatccatatattccgaataggtccaaaattaaattgaatagatgtatctagggaaaattcactttgaagcgactattccctagatacacacgtcataatatacttttttttatttcacagttgaatcgatttaaaaaagacctaaagttaaggacttatcaataggtagtgttgctccaatacccaaccaaagggctactacagtaccaatcaaaaagacggttgtcgctacgggacgacgaaatggattttggaatttattaacattctccaaaaaaggtactgttaataatcccgcaggtactgaaaccattaaaagaacgcccaataacttatttggcactgtacgaagtatttgaaatacgggaaagaaataccattcaggcaatatttccaaaggagttgcaaatggatccgcgggttcaccaatcattgatggttctagaaccgctaagcctacgttacatgcaatagtacctaaaattactactggaaaaatatataaaagatcgtttggccatgcgggctctccgtaataattatgacccatccctttagccaatttagctcttaacacaggatcgttcaagtcaggtttttttgttattaggataggtgaattattctagatccatcccccgaaagaaccggacatgataatttttcatcatccagctcgagcacgaatcaaacgaatcaaatggatccatataaaaaaattgatatgttatccatatccacacatatatgaatgattctatgtaagaaaacggattccctttttcgcagttgcaacaactaaccattgcaaggaattcagttcttacagataaatgctcaatacccaagtaggcttacaaaattgatcatgatcaaatgctttatgggtcgtctcagatcttgcaattggcctttatcccctaaatatcgagactgtttacatacaaagcaaaggatttacttgttactaatatagtctagcctctgttcttctttagatcccttgtttcactccgatagtatcataaatcgagtcaatgcagaggaaatgaatacatttctatactatttagtaagtgaaatatataaaacataatccggattatgccaatcacttattctactggatcttacggagcctgttcatatcatacacgacatgatcgggtctgatcatagaaaagattctcttcaaacgaaccggcctatcttctgtatggggcttacgcggtggttggaacaaagacacatttttttgttgtgaagtcaaatgtggc

SEQ ID NO: 4729 - DNA, 2367 bp, Tragopogon dubius
tatcaaagaaatctcatcatccatacataacgaattgatgtggtatattcatatcatactatatgaacagtaagaattagtagtcttattgagactagaactcatagggaatcaaatcgatttatggatggaatcaggtatgcagtatttacagacaaaagtattcgtttattggggaaaaatcaatatacttttaatgtcgaatcaggatcaactaggacagaaataaagcattgggtcgaactcttctttggtgtcaaggtaatcgcgatgaatagtcatcgacttcggggaaaggctagaagaatgggacccattatgggacagacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcgtcattgtggtaaaggtcgtaatgccagaggaatcattaccgcagggcatagagggggaggtcataagcgtctataccgtaaaatagattttcgacggaatgaaaaagacatatatggtagaatcgtaaccatagaatacgacccgaatcgaaatgcatacatttgtctcatacactatagggatggtgagaagagatatattttacatcccaggggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccaacagaaccggaagcgccccttctttcaaagagaagaggacggattattcacatttcatttgatggtcagaggcgaattgaaagctaagcagtggtaattctaaagattcccggggggaaaaatagagatgtctcctacgttacccataatatgtggaagtatcaacgtaatttcatagagtcattcggtctgaatgctacatgaagaacataagccagatgatggaacgggaagacctaggatgtagaagatcataacatgagtgattcggcagattttgattcctatatatccacccatgtggtacttcattataccatatatataagatccatctgtatagatatcaccatctacatccagaaagccgtatgctttggaagaagcttgtacagtttgggaaggggttttgattgataaaaaagaagaatctacttcaaccgatatgcccttaggcacggccatacataacatagaaatcacacttggaaagggtggacaattagctagagcagcgggtgctgtagcgaaactgattgcaaaagaagggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgccctgtagtaagaggagtagttatgaaccctgtagaccatccacatgggggtggtgaagggaaggccccaattggtagaaaaaaacccacaaccccttggggttatcctgcacttggaaaaagaagtagaaaaaggaataaatatagtgataatttgattcttcgtcgccgtagtaaataggagagaaaatagaatttctttcttcgtctttacaaaaaaaataggaggaagctgtgacacgttcactaaaaaaaatccttttgtagccaataatttattaaaaaaaataaataagcttaaatttgttaaatttaaatttgggcgaacgacgggaattgaacccgcgcatggtggattcacaatccactgccttgatccacttggctacatccgcccctctgttatgttatataatatctagtattatctagtatttctttatttttccattaacatgaaaaaaaaagaacatataatttctttcttatttcttaaatcaaagtaataaataaacaaaattctcatttttatctattttaaattgaaattaaatgggaaatcaaacttcataaaagattgggaaaggagtatataaacctctaaattactacaaagataaaacacgctaatcgaa

SEQ ID NO: 4730 - DNA, 13741 bp, Malus domestica
aattctcgatgtagatgctacatagttggttctcatccttcagagactacgagtgtaataggagcatccgtcgacaaaaggatcaccctaagatgatcatctcatggctattgagaacgaatcaaatcagatggttctatttctcaatctttctgacttgctcctacggaaccaaggtcgaaaagattgagagtcattcacaaccactgatgaaggattcctcgaaaagttaaggattagtaatcctttttagaaatcgaatggattcggtcttatacatacgcgaggaaggtaatcaaaaaagaaagaagatgagttcttctttcttttatcacttaggagccgtgcgagatgaaagtctcatgcacggttttgaatgagagaaagaagtgaggaatcctcttttcgactctgactctcccactccagttgttgcttttctttctgttacttcgaaagtagctgcttcagcttcagccactcgaatttttgatattcctttttatttctcatcaaacgaatggcatcttcttctggaaatcctagctattcttagcatgatattggggaatctcattgctattactcaaacaagcatgaaacgtatgcttgcgtattcgtccataggtcaaattggatatgtaattattggaataattgttggagactcaaatggtggatatgcaagcatgataacttatatgctgttctatatctccatgaatctaggaacttttgcttgcattgtatcatttggtctacgtaccggaactgataacattcgagattatgcaggattatacacaaaggatccttttttggctctctctttagccctatgtctcttatccttaggaggtcttcctccactagcaggttttttcggaaaacttcatttattctggtgtggatggcaggcaggcctatatttcttggtttcaataggactccttacgagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaacccgattattgaaattgctcaggatacccttttttagcttctagaatctatttcttagttcaagatccctcttactaactggaatcaaagaatttgtagatctgttccgcccaaaatgggaatgggctagggttatgaacttataatctataatctgatgatcgagtcgattccatgattataagttcattccataccggaccagaccggaatagggttatatacattctaattatgagaaggggtcattcgagcgtatctaaataggtactatgtttacatatggatccctacgtcgttacattccatttaggattaggaataggcgtaatcggacctgctttttacatatctctcgttatttgggatgggaccctattcacctcacctctttgggcttctattgaatcgagaaatcggtttgattgtccatctttttgatataataatatatatttttgatataatatatataaggcatcctccggataattcaaatcgaagcaattggatgtccgactcgggcctatatgacatgactgatcaatagaaatactctaacactccacctttgtcatatattccatacatcgcactggataggtatcatattcatggaatacgattcactttcaagatgccttggtggtgaaatggtagacacgcgagactcaaaatctcgtgctaaagagcgtggaggttcgagtcctcttcaaggcataatattgaatattgagaatgctcattgacttggaataagttcggcagcggatcacgaaatcttggtgatcttctctatctaatgaatggggagtctgctttgaaatcgtccgccctgcacccaccccccgagtatatgcttcaacaggaatcacacaagggtagattgatacaatagaaacctctggtaaaatgcccacccgtaatccagcagataaagtacattacatagtccgttttagggattggcgacttacccattcagtgactttggcactggacgttccaaaaatgggtactatcgggtcgggtgaattgaattcaataatagacgcctgttggcattccagccttccttctcctttcagggcctatccgaaagagaatccagtacttcttggtcgtgaatatctgaataggacgaaccgccccgtggatatctttgcttcggaacaaaacaattcgaattagtcggtcaactggaatgtgtattatccatataggggatctttgaattgagaagatccgtcgacctgagacgaagagaaatgtctatctattttatttagttattcagttaaaccaatgagtcgttattgtagcagatagcaacaaccatttcatccgacatgcgtattttttattttccaatggatttacatctttcattaatggaaattttttgatgtagtgagtaatagctctggttgttcgctgttcaagaattcttgtttaggcagttcataccatccatacataatgttttgatctaagatttcaattcttccatgtttcagcagtagttagtatattgttccatggagctaaggtccaaaatatggaagaaacaggtgtttccacgactctaccgcccagtcaattctgttccacttaatccctgtttcatggccacatatctttccggctaaggaatgggaaacctttctcttgttacatgaatccaattttcatttcatccgggaaaagccatctttttctcaacaatgtctttgtcatttgatccaatagcgttccgttagataggaacagctttgataaatactgataactctcggatggagtattagaacgaaaaaatccattagataatgaactattggttctaagccatctctggcgatgaattaacaattcgaagtacctttcttgcgtattcttgataaaccagcgtttatatatagatgtaggaagatccgtttgggaagtaagaagcccctttgacatctcttcatctgcaaagaattctcgatgtgaaaacacaggctgatctttgaataggaaaaagagtggatccgcagggtcccaaatgaattggcttattcgaaaaaagccttgttctttggaagatctatctcgtgtctggtactgcatggttccactctgcaagaactccgaatcattctcttgaagcccatcctcttcatcataaatgatccgcttgccccgaaatgacctgacccaatagggaaatcccaattcattgggcctttcgatacaatcaaatagaaagccccaagggcgccatattctaggagcccaaactatgtgattgaataaatcctcctctatccgttgcgggtcgaggactccttccccttcttcaaactccgattcgtattgttcatagagaaatctctgatcaacgatagaacaagatccattttgcatcatatctaagggattccttggttcgggccgaagaagcaatgtcactcgatcattatcaaactgactgcaatctttttctgtccgtgaggatcccaccggagcgccttctgcttctaataggccatgaactagatcagaatcattctcaacgagtccataagaagtgatcccatttttttcatcgggtcggggtagagaccaaaggtcttgagcgaccgatccggcagaacaactcaaaagataaagaagtatcgttaatttcttcatgctcgttccaagttcgaagtaccatttgtacaaataagaatccccttcgttacatgatttcttcttcatatagatagatataggatctatggagcaattacttagaagtacattttgtgcaacagcccttcctatctgatagaaaaggatcccatgatcctgaaccgatcttacttgggatcgcaaatcccaagtttgtctatgaagagcagatctaattatattagtgtctataattgatttcttctgtgtaatactaatcgatagggcctcattggtaagtgctacaagatctcgtacattggaacccatggttatggacccgaatccattagtatggaacattttcttttccaagtgaaatcccctagtatatgaaagagtgaaaaagtgctttcgttgttgtggaataagaagccttcgtatcttaatgcatgtatttaatttattcggagctattagagcgggatccactttttggggaatatgagtcgaagcaataacaagaatatttctagtggaacatctttcacaatccctggagagatagttcactaatagaccgagggataagtaattcgactcattcacatccagatcatgaatgtttggaatccatattatgcaaggagacattgcttttgctaattcgaattgaagggtgatataaaatcggtctatttccggcatcatatccatagttagcgcattcatcatagttagaagcgccagctccgtatcaaagtcacggtcgtcactatcatcaatatcgtcgctatcatcaatatcgtcactatcatcaacaagaaaacccttgggcttgttagccaggaacttgttcagaaatactgtaatgaaaggaacataggagtttgtcgctaggtatttgaccaaataggatcgtccagttcctatagaacctatcactaaaatacccctagagagggatagggctaagcggagcgaaaagggttttccatgagatgggaaatgaaaactattagccccacaggaggtttgtgaataagtgattgtctgataatgagcaaggaatatccgtctttctgctaaacaggatgtattgaactcataattcattagatactttttatgaatgtcaactaagtatcgtaagtaaattgctcccggttgttcaatcatttgataaccagaatcattctttgataaatgatcactatgagtcagactcaatagaatttgatcaatccttttttctgtcgttaaggtggagaactgaaccaagaattctctttctttatcatcaatcgaatcactgttcgagacccaggattctattttatcatcaatccaatcaccgttcacgttttttctttttcttatcaatgaatggatctctttacttgtatgacttagatgtctcgtatttctcgaaaaagcgattcgattgatgggatttggtatgatacttatgaaatcgatgatatcgatgagattgatattcaaatatttcttcttagaacgtattgatttgaccccataagcgggaccaccaccccatagcatgttgccgccagaagcccgtatttcttctagagaatctcctaattgttcccgagcaactagaaagagattctttaaccagaaagaattcagttcagatgtaggatacctatccagaagttttcgcaactcaatcatgtatgatggaatcatcaaagatttgaccctttcgaactctgtctgtaactcactataggctcgagaaacaaagagaagatgtgtacgaacgagatatccagcaacaagaagaaggaaaaggattgaatagaggaactcccgaacatttggcgatctcagatgtgtcgatatcaatggtgactcattatttcgatgaatcatttcttcggacagaagaagattatgtaaacacttactcgaaatatcacttatcagattccattgtggaagacacaattttttctgaagaattcgccatgatatatctgatccatgcataatatcatgaaaaatggatacaaatttttggctgctacttagtatcggcaataggtctgaaaaagtatctaaaaatatcaaatttagatatttgtatcctgtcgaagtaaggaaccatggcatatatgtttggaatatattccattttgagagagttgaaaaagcactatctcgttgaaaggttctatacatccgccctttctcaaggcatttctttagacaaagaccccgttttttcctcttttcggatggtaaatatttctcagaacatggagtgtgaatcaaacccatgtttgaattgaaattgagatactgatgcaagttcttcccttctgaatcagacagattcatatctgaaagaggttgacaataagttctttcaaaattgactatctgtccctctgttagaagtgttccagaaatgtctgcgatcgagtaaatagctctacgaacgaatggatcggatcgaattggaaaatgtaaagatttgtacaagttatccctttcgtcaccattttgtggaaaatcgttaggtatgaatatgttagacacctgtaactcgattggtgaaatagtatctctctccaaaaaagcatatttttttttaccgccgcacaaagaaaatattttgttgcgaatgaacaagatattgaggaattgtccatacgtaaaatcataattattgatacgagccttttccacataaaaagggaatcctttgttacaatagaagcagaagtgatgtggattattcaagaatcgaagtcgatttgctttataaaaagaagatatcaatgaacttctatgaaatggtttcacgggattcagccaattgtcttgatcgtgggatatcattgagaaataggaatccatgttatcaaaagatttcctgcgattatttctagtatggaatgagtcaatcatccactttggtatcttattgaacaaaaatggtgatattgttcctccattgatcaagaattttgatttttgggaagtatcatgatcatccaataagaagggtttcaattttttcaaatgaacgatttgaagacctattgattctaacaactgattgcagagttgatcattcggacctttcaattcatagatgtggatctcggacctatgaatggggatattcccaaaactcacaaagaaaaaaggaagtgagttagacaaaaagagaagaaacttggacaaaaaaagaagtaacttggacaaaaagaaaggaagtgacttagacaaatcttttttgtcgataacctcagaccaatcaaaatcaatatcaatcgaatattgattaatacgtaatcgatcgaacactacttgaaaatgaaaacggctcttctgctcagaaatgaaatgttccaaatgttcctgtaaattcttgctcccattggaccatttgtatctatatgcattaggatcccgattcatggatctctcggttcgagaaataaaaataagaggatcgaaccatttcttctgactctttttcaaatttgataaatgttggttgatcgtatatttcattatagttctatgattcagagtatcatttcctatttgatccctttgaattccatattcgaagttgcgatcggatctattcattaaaaagaatcgattcaatacatttcttatgtacccataggtgctatattggatttgaatcagatttcggatcaatctatattgattgactgcctccattatgttgttgctagcaaataccactatttttgattttggatcttccaaatcattcccgcaggaggtccggacccatttttttctgatccttcgataaaaagattcattctcttcataaaaaataggaggtagaaccaataaagatttctttttcgattcatccctggagttgaatacctcattcaagaattgtttttgatccaatccaatagaaaaggcaaatcccttatgatacaccagatccggctcggttattgatagagtgaatagatctgccatttctttaaatctctcttctgattcaaaatcgtggtgtaacgtgtatccccccctgttccggtcatggaatagatgaaataaatcaaaaaatggatttttgttcaagaatgaaatcttattggaactgtccatatccaattcatccttcggaaccatatcacatcccggatctgatgaaataggatgaattgagacggtattttgtaaatacgtaattatcttgaatatattaactatttctttattttccgatcgcctggaagggacaaaagaaacatcttgttctttcttcaacaatttctgatctctagtggacctctcagtaggattcgaacccagatgaagttctgaccatctgtcagagaaaaaagaacgaatggatcttgtaggattcccaagaaattcttcgatttcttccggaagcagatgcttattcatctgcttctcacgttccgtgaatagccgggacattgaggaatatccagaaaggcatttagggaatcggtctgattctatctctgttcgttccgtttgaagaaaagaaggatcccaaagaatcgatctttcttttagttgttgaatctctctttgattgatcaatgtgtgatattctgaatcctcattactaatggaatcgaaatgatctctggattgatcagaggatcctttcaattggctagaatccgttacttgaacgaaactagatcttgtggaatcatattgaatatttgacgatgcattccgtaccttgctaaaaaaccgatccttgtttaacaaccacacattgtctaaccaattctctctcgatatgttcctcaaaaaatccgattcgtgcggattcttcccccaactaaagaagagatcttggcggaattgccgcatatgaaattgagcacaattttgcatagcccacttgtttctcgagaagagatgggaaacatgctcaatttcatttgattgaatagttgacccagctccttgttgtttgaagaaaccctccgcttccattggtattttttcacgaaaagcaaacatgagataacaaatccagtctttcactaagatttcgaatagctgtcccgaattcaagttgattatgtttcgcctcttcctcggagaaagacgatcaaacaattcccaatcatggtccttgcggatcggatcatccatataatatacaaaaagaaactccagatatttgatatctttctctttgaatgagatctcaattccagcgacggtttcattagatatcttacaactagaagccctcttttttccgatccagttcctccaccaccgcgaaccccagttagattcaggcatgatacactttttagttattgggagaacccaagtactctctttcggatccaggaaacagctctcagagatcttttttccttttggaagatacaggagcgaaacaatcaacctattgatattggaagacccaaaagattcttccaatgtatcatttctgggtccaatgaaattcataggtataggaagaagccctgtcaaatagagattttttctttcgaccatctttcgattgttaatacgatatataaggaccgctactacaaatagtactacacccttgatcgtgaaatatcgattgcttgttgaaccctgtaaatgtgaattgcgtgaaagtaggatactccaaattcgggagtccaagagttttataaaacgttcttgatggaaaaaaatgtgaataaaagatcccactgaattgaatttggtccatgaatctaagaaatagtgagaattctggatctctctcaatatctctctcaattcgaaaatccaggatttgaattgatgtcctttcattgagtcctcctaaattgcattgatttatcctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttctaatgtcgaatcaggatcaactaggacagaaataaagcattgggtcgaactcttctttggtgtcaaggtaatagctatgaatagtcatcgactccccggaaagggtagaagaatgggaactattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaactatagaatacgaccctaatcgaaatgcatacatttgtctcatacactatggggatggtgagaaaagatatattttacatcccagaggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcacctacagaaccagaagcgccccttgtttcaaagagaggaggacgggttattcacatttcatttgatggtcagaggcgaattgaaagctaagcagtggtaattctaaggattccccccggggaaaaatagagatgtctcctacgttacccgtaatatgtggaagtatcgacgtaatttcatagagtcattcggtctgaatgctacatgaagaacataagccagatgaaggaacgggaagacctaggatgtagaagagcataacatgagttattcggcatattttgattcctatatatccactcatgtggtacttcattatatgatatatataagaattatacgatatatataagatccatctgtatagatatcatcatctacatccagaaagccgtatgctttggaagaagcttgtacagtttgggaaggggttttgattgatcaaaaagaagaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtaaagccggatctaaatgttggctgggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggcgagaaaatagaatttgtttcttcgtctttacaaaaaagaaataaaaacaaaaataggagtaattaattgtgacacgttcactaaaaaaaaatccttttgtagcaaatcatttattaagaaaaataaatacacttaacacaaaagcagaaaaagaaataatagtaacctggtcccgagcgtctaccattataccgacaatgatcgggcatactatcgctatccataatggaaaggagcatttgcctatttatataacggatcgtatggtaggacataaattgggagaatttgcacctactctaaatttccgggggcatgcgaaaaatgataatagatcccgtcgttaataattaataaaaaaataataaaatatagatgcttatcgttcattaatgagaggtgaatcttatgatacagaagagaaaggtgaagaaatatacagaagtatacactttaggtcaacatatatgtatgtctgctcacaaagcgagaagagtaattgatcaaattcgtgggcggtcctatgaagaaacacttatgatactagaacttatgccttatcgagcatgttatgccattttaaaattggtttattctgcagcagcaaatgctaatcacaataagggtttgaacgaaacaagtttaatcattagtaaagccgaagtcaacgagggcacaactgtgaaaaaattaaagccccgggctcgaggacggggttatcctataaaaagatccacttgtcatataactattgtattgaaagatatatctttagatgaagaggaagaaatagataaaaggaaattctataaattagagctgaggaatacttaaaggaagaatattttatattataaaaaatacaaatacgctatattatgttatgcttaaaaaaaatcgaatgaataaaaaaaaaatacaaacagatgtcacgtttcacgatatatatagtagtgggggattatgggacaaaaaataaatccacttggtttcagacttggtgcaacccaaggtcatcattctctttggtttgcacaaccaaaaaattattcaaaggatctacaagaagatcaaaaaatacgagattgtatcaaaaattatgtgcaaaataatatgaaaatatcctctaatgtagagggaattgcacgtatagagattcaaaaaagaatcgatttgattcaggtcataatctatatgggattccccaagttattaatagaagacaggactcgaagaatcgaagaattacagacgcatgtacaaaaagaactcaattgtgtaaaccgaaaactcaacattgctattacaagaattgcaaatccttatgggcaccccaatattcttgcagaatttatagccggacaattaaagaatagagtttcatttcgcaaagcaatgaaaaaagctattgaattaactgaacaggcaggtacaaaagggattcaagtacaaattgcagggcgtatcgacggaaaagaaattgcacgtgttgaatggatccgagaaggtagagttcctctacaaaccattcgagctaaaattgattattgttcctatgcagttcgaactatctatggggtattaggcatcaaaatttggatatttgtagacgaggaataataagaacttacttgacttatatttagttatatctggtgataaaacaaaaaatggcaaactctttcattctttttctggtaaataataaaaaaaaagaacaattctataaggttgaataaaaattcgattaatcatttgatataattgctatgcttagtgtgtgactcgttggtttttttagggttgggattcaaaaaaatggacagcccatagtacaaactgataactatagaactaataaccaactcatcacttcgtgttatctggatagaaagaaccagtcaagatatgatatataagtcatatcattgtagcaactgaaatcttttttacat

SEQ ID NO: 4731 - DNA, 1746 bp, Tropaeolum majus
taaaattaattgactctagagatatagtaatatggagaagacaaaatgtttcaagcaccgacagaaccataagcgccccttgtttcaaagagaggaggacgggttattcacatttcatttgatggtcagaggcgaattgaaagctaagcagtggtaattctaaagattccctgaggaaaaatagagatgtctcctacgttacccataatatgtggaagtatcgacgtaatttcatagagtcattcggtctgaatgctacatgaagaacataagccagatgacggaacgggaagacctaggatgtagaagatcataacatgagttattcggcagattttgattcctatatatccactcgtacttcattgtacgatatatataagatccatctgtatagatatcatcatctacatccagaaagccgtatgctttggaagaagcttgtacagtttgggaaggggttttgattgatcaaaaagaagaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtggggaatgttggggtgaaccagaaaagtttgggtagagccggatctaaatgttggctaggtaagcgtcctgtagtaagaggagtagttatgaaccctgtagaccatccccatggaggtggtgaagggagggctccaattggtagaaaaaaacccgcaaccccttggggttatcctgcacttggaagaagaagtagaaaaaggaataaatatagtgataatttgattctgcgtcgccgtagtaaataggagagaaaatcgaatttctttcttcgtcttaaaaaaaaataggagttacttaactgtgacacgttcactaaaaaaaatccttttgtagcaaataatttattaagaaaaatcgataagcttaatacaaaggcggaaaaagaaataataataacttggtcccgggcatctaccattatacccacaatggttggccatactatagctatccataatggaagggaacacctgcctgtttatataacagatcgtatggtaggacataaattgggagaatttgcaccgactctaaatttccgtggacatgcgaaaaatgataataaatcttctcgttaataaaatgaatatagatataagtagtaagaggtaaacattatgataaagaaaagaaagaagaagtatactacagaagtatatgctttaggtcaaaatagatatatgtcttctacagaagtatatgctttaggtcaacatatatgtatgtctgcccacaaagcacgaagggtaattgatcagattcgtggacgttcctacgaggaaacacttatgatactagaactcatgccttatcgagcatgttatcccattttaaatttggtttattctgcagcagcaaatgctagtcataataagggtctcagcgaaacaagtttaatcattaagaaagccgaagtcaacgagggtactagggtgaaaaaattcaaaccccgagcccgagggcggagttctccgataaaaagacccacttgtcatatagctattgtattggaatatatccgcttctatgaaaaaaagaacgaatatataatgtgctttaaaaa

SEQ ID NO: 4732 - DNA, 1799 bp, Medicago truncatula
catggcgatacatttatacaaaacttctatcccgagcacccgcacacgaaatcgtttgatttatggacagcatcattgtggtaaaggccgtaatgccagaggaatcattaccgcagggcatagagggggaggtcataagcgtctataccgtaaaattgattttcgacgtaatgaaaaagacatatatggtcgaatcgtaactatcgaatacgaccctaatagaaatgcacacatttgtctcatacactatggggatggtgagaaaagatatattttacaccccagaggggctataattggagataccattgtttatggtacagaagttcctataaaaatgggaaatgccctacctttgagtgcggtttgaactattgatttacgtaattggaagtaaccaattaggtttacggcgaaacctatcaatcgatcacggatccaatttgagtacctctacaggatagacttcaacagaaaactgaagagtaacggcagcaagtgattgagttcggtagtttctcatataaaattattgaccctaaagatatagtaatatggagaagacaaaattgtttcaagcaccgacagaacacgaagctctccttgtttcgtttcaaaagggggaagacacgggttattcacatttcatttgatggtcagaggcaaattgaaagctaagcagtggtaattctaaagattccccccgggaaaaatagaaatgtctcctacgttacctgtactatgtgtaagtagcaacgtaatttcatagagtcattcggtctgaatgctacatgaagaacataagccagatgaaggaacagaaagacctaggatgtagaatatcataacatgactgatttggcagatttagattcctatattatatacccactcatgtggtacttcgttatgtcataatataagaattatacaatatatatataagatccagctgtatagatatcataatctacatccagaaagccgtatgctttggaagaagcttgtacagtttgggaaggggttttgattgatcaaaaagaagaatctacttcaaccgatatgcccttaggcacggccatacataacatagaaataacacttggaaagggtggacaattagctagagcggctggtgctgtagcgaaactgattgcaaaagaggggaaatcggcaacattaaaattaccttctggagaggtccgtttgatatcaaaaaactgctcagcaacagtaggacaagtagggaatgttggagtaaaccaaaaaagtttgggcagagccggagctaaacgttggttaggtaagcgtcctgtagtaagaggagtagttatgaaccctgtagaccatccacatggtggtggtgaagggagggccccgattggtagaaaaaaaccctcaactccttggggttatcctgcacttggaagaagaagtagaaaaaaaaataaatatagtgataatttgattcttcgtcgccgtagtaaatagtctagagtagagaaaatagaatttgtttcttcgtctttacaaaagaaaagagaataattaactatgacacgttcacgaaaaaaaaatccttttgtagcaaatcatttattaaaaaaaataaataagcttaacacaaaaggagaaaaagaaataataataacttggtccagaacatctaccattatacctacaatgattggccataccattgctatccataatggaaaagagcatttacctatttatataacagatcgtatggtaggccataagttgggagaattttcacctactctaaacttccgggg

SEQ ID NO: 4733 - DNA, 2050 bp, Medicago truncatula
cgccaatagaaccctacctcccataaagtcgatttttgttcaagaatgaatcaatccgaactgtttgacttaaataacttaactaatttcttgatttccatcattttgaatttacgttcaatttacgtaatttcttgatttccatcattttgaatttacgttcaatttacgtaatttatttatttaactaatttcttgatttccatcattttgaatttacgtaatttatttacttaaataaaaaaaaatttctgatctgtatctgtagtggacctattagcttagtatgatttgaatcgagacgaagttctgaccatctgtcagagaaaaaaagaccgattggctctgtatcaatggaatctcatcatccattataacgaattggtgtggtaaattcaaatttaaatatatgaacagtaaataaaactagtattcgtattgagactagaactcatagggaagaaaatagatttatgaatggaataaaaaatgcaatatttacagacaaaagtattcggttattgggaaaaaatcaatatacttttaatgtcgaatcaggatcaactaggacagaaataaaacattgggtcgaactcttttttggtgtcaaggtaatagctatgaatagtcatcgactcccaataaagggtagaagaatgcgacctattatgggacatagaccgcattacaaacgtatgatcattaccatggcgatacatttatacaaaacttctatcccgagcacccgcacacgaaatcgtttgatttatggacagcatcattgtggtaaaggccgtaatgccagaggaatcattaccgcagggcatagagggggaggtcataagcgtctataccgtaaaattgattttcgacgtaatgaaaaagacatatatggtcgaatcgtaactatcgaatacgaccctaatagaaatgcacacatttgtctcatacactatggggatggtgagaaaagatatattttacaccccagaggggctataattggagataccattgtttatggtacagaagttcctataaaaatgggaaatgccctacctttgagtgcggtttgaactattgatttacgtaattggaagtaaccaattaggtttacggcgaaacctatcaatcgatcacggatccaatttgagtacctctacaggatagacttcaacagaaaactgaagagtaacggcagcaagtgattgagttcggtagtttctcatataaaattattgaccctaaagatatagtaatatggagaagacaaaattgtttcaagcaccgacagaacacgaagctctccttgtttcgtttcaaaagggggaagacacgggttattcacatttcatttgatggtcagagaaagccgtatgctttggaagaagcttgtacagtttgggaaggggttttgattgatcaaaaagaagaatctacttcaaccgatatgcccttaggcacggccatacataacatagaaataacacttggaaagggtggacaattagctagagcggctggtgctgtagcgaaactgattgcaaaagaggggaaatcggcaacattaaaattaccttctggagaggtccgtttgatatcaaaaaactgctcagcaacagtaggacaagtagggaatgttggagtaaaccaaaaaagtttgggcagagccggagctaaacgttggttaggtaagcgtcctgtagtaagaggagtagttatgaaccctgtagaccatccacatggtggtggtgaagggagggccccgattggtagaaaaaaaccctcaactccttggggttatcctgcacttggaagaagaagtagaaaaaaaaataaatatagtgataatttgattcttcgtcgccgtagtaaatagtctagagtagagaaaatagaatttgtttcttcgtctttacaaaagaaaagagtgatttactatgacattatatgatttgattttgtttttttagagattatataattttattttttaaaatataagagaaaaaattcacttttttagaaattataagaggaataattaact

SEQ ID NO: 4734 - DNA, 939 bp, Elaeis guineensis
gacctaggatgtagaagatcataacatgagtgattcggcagatttggattcctatatatccactcatgtggtacttcatcatacgattcatataagatccatctgtctagatatcatcatatacatctagaaagccgtatgctttggaagaagcttgtacagtttgggaaggggtttttattgataaaaagaagaatctacttcaaccgatatgcccttaggcacggccatacataacatagaaatcacacttggaaagggtggacaattagctagagcagcaggtgctgtagcgaaactgattgcaaaagagggtaaatcggccacattaagattaccatctggggaggtccgtttgatatccaaaaactgcttagcaacagtcggacaagtgggtaatgttggggtgaaccaaaaaagtttgggtagagccggatctaagtgttggctaggtaagcgtcctgtagtaagaggagtagttatgaaccctgtagaccatccccatgggggcggtgaagggagagccccaattggtagaaaaaacccacaacccttgggttagtcctgcgcttggaagaagaagtaggaaaggaaaaaataatagtgatagttttatttcttcgtcgccgtaaataggaatattgaaaatacgaatttttttggttaattgttaataaatagtgatggcggaacgaacgggaagtttaaccgtccgcatggtggagttcacaataccacctgccttgtatccaccttggtcgtaccatccgcccccttacttctagctaaaggaattttcttcttttttcctattcatcattattgtatttattctgacctcccatactttagtatcgagatattggacatagaatagccaatctttaaaattagtaaaaaaaggaaaggtaattacagactgttggacacgttactact

SEQ ID NO: 4735 - DNA, 692 bp, Rhizophora mangle
aaggaacgggaagacctaggatgtagaagagcataacatgagtgattgggcagatttggattcctatatattcactcatgtagtactttactacattatacgatatccatctgtatagatatcatcatctacacccggaaagccgtatgctttggaagaagcttgtacagtttgggaagaggttttgattgatcaaaaagaagaatctacttcaaccgatatgcccttaggcacggccatacataacatagaaatcacactgggaaagggtggacaattggctagagctgcaggtgctgtagcaaaactgattgcaaaagaggggaaatcggccacattaaaattaccttctggagaggttcgtttaatatccaaaaactgctcagcaacagtcggacaagtagggaatgctggggtgaaccagaaaagtttgggtagagccggatcgaaatgttggctaggtaggcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggagagaaaatagaatttgtttcttcgtcttttcaaaaaaaaaa

SEQ ID NO: 4736 - DNA, 11450 bp, Euonymus alatus
aaattttttgtatgtagtaagtaatagctctggttgttcgccgttcaagaattcttttaggcagttcataccatccatacatagtgttttgatctaagatttcaattcttccatgtttcagcagtagcctattgttccatgtagctaaggtccaaaatatggaaaaaaacaggtgtttacacgactctaccacccagtcaattctgttccacttaatccctatttcatggccacatatctttccgcctaaggaataggaaacctttctcctgttacatgaatccaattttcatttcatccgggaaaagccatctttttctcaacactgtctttgtcatttgatccaatagcgttccgttagataggaacagatttgataaatactgataactctcggatagagtattagaacggaaaaatccattagataatgaactattggttctaagccatctctggcgatgaatcaacaattcgaagtgcttttcttgcgtattcttgataaaccagcgtttatatatagatgtggggggatccccctgggaagtaagaagcccctttgacatctcttcatctgcaaagaattctcgatgtgaaaacacagagacaaagggctgatctttgaataggaaaaagagtggatcggcagggtcccaaatgaattggcttattcgaaaaaagccttgttccttagaagatctatctcgtatctggtactgcatggttccactctgcaagaactccgaatcattctcttgaagctcatcctcttcatcataaatgatccgcttaccccgaaatgacctggcccaatagggaaatcccaattcattgggcctttcgatacaagcaaatagaaagccccaatagcgccatattctaggagcccaaactatgtgattgaataaatcctcctctctctgttgcgggtcgaggactccttctccttccacttcttcaaactccgattcgtatttttcatagagaaatctctgatcaacgatagaacaagatccattttgcatcatatctaagggattccttggttcgggccgaagaagcaatgtcactcgatcattatcaaattgactgcaatctttttctgtccgtgaggatcccaccagagcgccttctacttctaataggccatgaactagatcagaatcattctcaacgagtccataataagtgatcccatttttttcatcgggtccgggtagagaccaaaggtcttgagcgaccgatccggcagaacaactcaaaagataaagaagtatcgttaatttcttcatgctcgttccaagttcgaagtaccatttgtacaaataggaatccccttcgttacatgatttcttcttcatatagatagatataggatccatggtacaattacttagaagtacgttttgtgcaacagcccttcctatctgataaaaaaggatcccatgatcctgaaccgatcttacctgggatcgcaaatcccaagtttgtctatgaagagcagatctaattatattagtgtctataattgatttcttctgtgtaatactaatcgatagggcctcattggtaagtgctacaagatctcgtaccttggaacccatagttatggacccgaatccattagtatggaacattttcttttccaagtgaaatccccgagtataggaaagagtgaaaaagtgctttcgttgttgtggaataagaagccttcgtatcttaatgcatgtatttaatttattcggagctattagagcgggatccacttttttgggaatatgagtcgaagcaataacaagaatatctctagtggaacatctttcacaatccctggagagatagttcactaatagaccgagggataagtaattcgactcattcacgttcagatcatgaatgcttggaatccatattatgcaaggagacattgcttttgctaattcgaattgaagggtgatataaaatcggtctatttcaagcatcatatccatagttagcgcattcatcctagttagaagctccagctccgtatcaaggtcacggtcaatatcgtcactcagatcaatatcgtcactatcatcaataagaaaacccttaggcttgttatccaggaacttgttcagaaatactgtaatgaaaggaacataggagttttccgctaggtatttgaccaaataggatcgtccagttcctatagaacctatcactaaaatagccctagggggggatagggctaagcggagcgaaaagggttttccatgagatgggaaatgaaaactattagccccacacgagatttgtgaataagtgattgtctgataatgagcaaggaatagccgtctttctgctaaacaggacgtattgaattcataatgcattagatactttttatgaatgtcaactaagtatcgtaagtaaattgctcctggttgttcaatcatttgataaccagagtcattctttgataaatgatcactatgagtcagactcaatagaatttgatcaatccttttttctgtcgttaaggtggagaactgaaccaagaattctctttctttatcatcaatcgaatcgctgttcgcgaccaaggattcgattttatcatcaatccaatcaccgttcacgttttttctttttcttatcaatgaatagatctctttacttgtatgacttagatgtctcgtatttctcgaaaaagtgattcgattgatgggatttggtatgatacttatgagatcgatgagattgatattcaaatatttcttcttagaacgtattgatttgaccccataagcgggaccaccaccccatagcatgttgccgccagaagcagaaccccgcatttcttctagagaatctcctaattgttccagagcaactagaaagagattctttaaccagaaagaattcagttcatacctatccagaagttttcgcaactcaatcatgtatgatggaatcatcaaagatttgaccttttcgaactctgtctgtaactcactataggctcgggaaacaacgagaagatgtgtacgaacaagatatccagcaacaagaagaaggaaaaggattgaatagagcaactcccgaacatttggcgatctcagatgtgtcgatatcaatggtgactcattatttcgatgaaccatttcttcggacaaaagaagattatgtaaacacttactcgaaatatcacttatcagattccattgtggaagaccccattttttctgaagaattcgccatgatatatctgatccatgcataatatcccgaaaaatggatacaaatttttgactgctacttagtatcggcaataggtctgaaaaagtatctaaaaatctccaatttagatatttgtaacctgtcgaagtaaggaaccatggcatatatgttttgaatagattccattttgagagagttgaaaaagcactatctcgttgaaaggttctatacatctgccctttctcaacgcatttctttagacaaagactccgttttttcctcttttcggatggtaaatatttctcagaacatggagtgtgaatcaaacccatgtttgaattgaaattgagatactgatgcaagttcttcctttctgaatcagatagattcatatctgaaagaggttgacaatcagttttttcaaaattgactatttgttcctctgtgagaggcgtgccagaaatgtctgcgatcgagtaaatagctctacgaacgaatggatcggatcgaattggaaaatggaaagatttgtacaagttatacctttcgtcaccactttctgaaaaatggttaggtattaatatgttagatacctgtgactcgattggtgaaatagtatctctctccaaaaaagcatgtttttttttaccggcgtacaaagaaaatattttgttgcgaatgaacaagatattgaggaattgtccatacgtaaaatcataattattgatacgggccttttccacataaaaagggaatcttttgttacaatagaagtagaagtgatgtggattcttcaagaatcgaagtcgatttgctttataaaaagaagatatcaatgaacttatatgaaatggtttcacgggattcggccaattgtcttgatcgtgggatatcattgagaaataggaatccgtcttatcaaaagatttcccgcgattatttctagtatggaatgagtcaatcatccactttggtatcttattgaacaaaaaaggtgatattgttcctccattgatcaagaatttcgatttttgggaagtatcatgatcatccaataagaagggtttccattttttcaaatgaacgatttgaagacctattgattctaacaactgattgcagagttgattattcggacctttcaattcatagatgtggatctcggacctatgaatggggatattcccgaaactcacaaagaaaaaaggaagtgagttagacaaaaagagaagaaacttggacaaaaaaagaagtaacttggacaaaaagaaacgaagtgacttagacaaatcttttttgtcgataacctcagaccaatcaatcgaatattgattaatacgtaatcgatcgaagactacttgaaaatgaaaatggctcttcggctcagaaatgaaatgttccaaatgttcctggaaattcttgttcccattggaccatttgtatctatatgcattaggatcccgattcatggatctctcggttcgagaaatccaaataagagggtcgaaccatttcttctgactctttttcaaattcgataaatgttggttgatcgtatatttcattatagttctatgattcagagtatcatttcctatttgatccctttgaattacatattcgaagttgcgatcgggtctattcattaaaaagaatcgattcaatacatttcttatgtacccataggtgctatattggatttgaatcagatttcggatcaatctatattgattaactgcctccattatgttgttgctagcaaataccactctttttgcttttggatcttccaaatcattcccgcaggagatccgaacccatttttttctgatccttcgataaaaagattcattctcttcataaaaaataggaggtagaaccaataaagatttctttttcgattcatccaatacctcattcaagaattgtttttgatccaatccgtaggaatcaatagaaaaggtaaatcccttatgatacaccagatccggctcggttattgatagagtgaatagatccgccatttcttgaaatctctcttctgattcaaaatcgtggtgtaaggtgtatccccccctgttccggtcatggaatagatgaaataaatccaaaaatggatttttgttcaagaatgaaatcttattggaactgtccatatccagttcatccttcggaaccctatcacatcccggatctgataaaataggatgaattgagacggtattttgtaaatacgtaatgatcttgaatatattaactatttctttattttccgatcgcctggaagggacaaaagaaacatcttgttctttcttcaacaatttccgatctctggtggacctctcagtaggattcgaacccagatgaagttctgaccatctgtcagagaaaaaagaacgaatggatcttgtaggattcccaagaaattcttcgatttcttccggaagcagatgattattcatctccttctcacgttccgcgaatagccgggacattgaggaatatacagaaaggcatttagggaatcggtctgattctatctctgttagttccgtttgaagaaaggaaggatcccaaagaatcgatctttcttttagttgttgaatctctctttgattgatcaatgtgtgatattccgaatcctcattactaatggaatcgaaatgatctctggattgatcagaagatcctttcaattggctagaatcccttacttgaacgaaactagatcttgtggaatcatattgaatatttgacgatacattccgtaccttgctaaaaaaccgatccttgtttaccaaccacacattgtataaccaaatccaattctctctcgatatgttcctcaaaaaatccgattcgtgcggattctttccccaactaacgaagagatcttggcggaattgccacatatgaaattgagcacaatttttcaaagaaatagcccacttctttctcgagaagagatgggaaacatgctcaatctcatttgattgaatagttgacccagctccttgttgtttgaagaaaccctccacttcaattggtattttttcacgaaaagcaaacatcagataacaaatccagtctttcactaaaatttcgaatagccgtcccgaattcaagttgattatgtttcgcctcttcctcggagaaagacgatcaaacaattcccaatcctggtccttgcggatcggatcatccatataatatacaaaaagaaactccagatatttgagatctttctctttgaatgagatctcaattccagcgacggtttcattagatatcttacaactagaatccctcttttttccgatccagttcctccaccaccgcgaactccagttagattcaggcatgatacactttttagttattgggagaacccaagtactctctttcggatccaggaaaccgctctcagagatcttttttccttttggaagatacaggagcgaaagaatcaacctattgatattggaagacccaaaagattcttccaatttctcatttctgggtccaatggaattcataggtattggaagaagccctgtcaaataaagattttttctttcgaccatctttctattgttaatacgatatataaagaccgctactacaaataagactacacccttgatcgtgaaatatcgattgcctgttgaaccctgtgaattgcgtgaaagtaggatactcaaaattcgggagtccaagagttttataaaacgttcttgatggaaaaaaatgtgaatgaaagatcccactgaattgaattcggtccatgaatctaagaaatagtgagaattcttgatctctctcaatatctctctcaattcgaaaatccaggattggaattgatgtcctttcattgattcctcctaaattgcattgatttatctgccggatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctcttggaattggctctgtatcaatggaatctcatccagacataacgaattggtgtggtatattcatatcataacatatgaacagtaagaactagcattcttattcagactagaactcatagggaagaaaagagatttatggatggaatcaaatatgcagtatttacagacaaaagtattcggttattggggaaaaatcaatatacttttaatgtcgaatcaggatcaactaggacagaaataaagcattgggtcgaactcttctttggtgttaaggtaatagctatgaatagccatcgacccccgggaaagggtagaagaatgggacctattgtgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaataaacgaaataatttgatctatggacagcatcgttgtggtaaaggtcgtaatgccagaggaatcattaccgcagggcatagagggggaggtcataagcgtctataccgtcaaatcgattttcgacggaaggaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgacctacctttgagtgcggtttgaactattgatttacgtaattggaagtaaccaattaggtttacgacgaaacctagaaatcgatcactgatccaattttagtacctctacagggtagacctcaacagaaaactgaagagtaacggcagcaagtgattgagttcagtagttcctcatataaaattattgactctagagatatagtaatatggagaagacaaaattgtttcaagcaccggcagaagcgccccttgtttcaaagagaggaggacgggttagtcacatttcatttgatggtcagaggcgaattgaaagctaagcagtggtaattctaaagattccccaggggaaaaatagagatgtctcctaagttacccgtaatatgtggaagtatcgacgtaatttcatagagtcattcggtctgaatgctacatgaagaacataagccagatgaaggaacgggaagacctaggatgtagaagatcataacatgagcgattcggcagatttggattcctatatatccactcatgtggtacttcattatacgatgtatatataaattctacgatatatataagatccatctgtatagatatcatcatctacatccagaaagccgtatgctttggaagaagcttgtacagtttgggaagaggttttgattgatcaaaaagaagaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtagggaatgttggagtgaaccagaaaagtttgggtaaagccggatctaaatgttggctgggtaagcgtcctatagtaagaggagtagttatgaaccctgtagaccatccccatgggggtggtgaagggagggccccaattggtagaaaaaaacccgtaaccccatggggttatcctgcacttggaagaagaagtagaaaaaggaataaatatagcgataatttgattcttcgtcgccgtagtaaataggagagaaaatagaatttgtttcttcatcttaaaaaaaaaaaaagaaatgggagtaattaactgtggcacgttcactaaaaaaaatccttttgtagcgaatcatttattgggaaaaataaataagcttaacacaaaggcggaaaaagaaataatagtaacttggtcccgggcatccaccattatacccacaatgatcggacataccattgctatccacaatggaaaggaacatttgcctctttatataacagatcggatggtaggacataaattgggagaatttgcacctactctaaatttccggggacatgcaaaaaatgataatagatctcgtcgttaataataataaataaaaaaaaaaagaaatatgggcgaacaacgggaaacaggaaatagttaattaaaaaatagttaattaaaaagagtatgataaaaaaaaaagaaatatacaccatatacaaaagtatacgcaataggtcagcatatgtctatgtctgctcacaaagcaaaaatagtaattgatcagattcgtggacgtttttacgaggaaacacttaggatactcgaactcatgccttttgaaagatgttatcccgtttttaaattggtttattctgcagcagcaaacgcgagtcacaatattgagtccaacaaatcaaacttaatcattagtaaagccgaagtcaacgaaggtggaactctgaaaaaatttaaacctagagctcgaggacgaagttatccgataaaacgacgcacttgtcatataactattgtattgaaagatatatctttagttgaatataaagaatctaaaaactataacgatatatgaagactatgaaaaaaataatataatatagcatatacttaccaaaaccggaccggataaagaattgataaagaaaaaatataggatgtgtcatgatatgtatattagtgggggattatgggacaaaaaataaatccacttggtttcagacttggcacaaaccaaagtcatcattctctttggtttgtgcaaccaacaaattattccgaaggtctgcaagaagatcaaaaaatacgaaactttatcaaaaactatgtacaacaaaacataaaaatatcttccggtgttgagggaattgcacgtatagagattcaaaaaagaattgatctgattcaggtactaatatatataggattcccgaagttattactggagagtaggactcgaagaatagaagaattacagaggaagttacaaaaagaattaaattgtatgaaccgaaaactaaacattgctattacaaggattgcaaatccttatggacatcctactattcttgcagaatttctagccggacaattaaaaagccgagtttcatgtcgtaaagcaatgaaaaaagctattgaattagctgaacaggcgaatacaaaaggaattcaagtacaaattgcagggcgtatcaacggaaaagaaattgcgcgtgttgaatggatccgagaaggtagggttcctctacaaacaattcgagctaaaatcgattattgttcctatactgctcaaacgctttatggggtactgggaatcaaaatttggatatttggagacgaggaataataaacctttacttgacttgttttgatttttatgttgtaaccccgaacagaaactaacaaactttttaagtcgttttctcttgaataaaaaaaatgagcaattctagcaatttaaaattctattctatagggttgaataaaaatgcgattgagaatttcatcttgatataattgccatgcttagtcccaaaagaaccagattccgtaaacaacatagaggaagaatgaaaggaatatcttatcgaggtaatcatattgctttcggtagatatgctcttcaggcacttgaacccgcgtggattacatctagacaaatagaagcgggtcggcgagcaatgacacgaaatgtacgccgcggtggaaaaatatgggtacgtttatttccagacaaaccggttacggtaagacctacagaaacacgtatgggttcggggaaaggatctcctgaatattgggtagttgtcgtgaaaccaggtagaatactttatgaaatggacggagtaggagaaaatatagctcaaaaagctctttcaatagcggcttcaaaaatgcctatacgaactcaattcattatttcggtatagaaatgtagaatgtaaaacccacccaaacccaagaaaagg

SEQ ID NO: 4737 - DNA, 2883 bp, Ricinus communis
cgtaggttcaattcctactggatgcacgccaatgggaccctccaataagtctactggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagccatcgactcccgggaaagggtagaagaatgagacctattatgggacatacaatgcattacagacgtatgatcattactcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatacacgaaatacacgaaataatttgatctatggacagcatcgttgtggtaaaggccgtaacgccagaggaatcattaccgcaaggcatagagggggaggtcataagcgtctataccgtaaaatcgattttcgacggaatgaaaaagacatatatgggagaatcgtaaccatagaatacgaccctaatcgaaatgcatacatttgtctcatacactatggggatggtgagaagagatatattttacatcccagaggggctataattggagataccattatttctggtacagaagttcctataaaaatgggaaatgccctacctttgagtgcggtttgaactattgatttacgtaattggaagtaaccaattaggtttacgacgaaacctagaaatcgatcactgatccaaattgagtacctctacaggatagacctcaacagaaaactgaagagtaacggcagcaagtgattgagttcagtagttcctcatagaaaattattgactctagagatatagtaatatggagaagacaaaattgtttcaagcaccgacagaaccggaagcaccccttgtttcaaagagaggaggacgggttattcacatttcatttgatggtcagaggcgaattgaaagctaagcagtggtaattctaaagattccccggggaaaaaatagaaatgtctcctacgttacccctaatatgtggaagtatcgacgtaatttcatagagtcattcggtctgaatgctacatgaagaacataagccagatgaaggaacgggaagacctaggatgtagaagagcataacatgagcgattcagcagattttgattcctatatatccactcatgtagtactttttttcattttacgatatataagatccatctgtatagatatcatcatctacacccagaaagccgtatgctttggaagaagcttgtacagtttgggaagaggttttgattgatcaaaaagaagaatctacttcaaccgatatgcccttaggcacggccatacataacatagaaatcacatttggaaagggtggacaattagctagagctgcaggtgctgtagcgaaactgattgcaaaagaggggaaatcggccacattaaaattaccttctggggaggttcgtttaatatccaaaaactgctcagcaacagtcggacaagtagggaatactggggtgaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataggagaaaaaatagaatttgtttcttcgtcttttcaaaataaataaaaaaaaaaaaaaaaaaaataggagaaattcactgtgacacgttcaactaaaaaaaaatccttttgtagcaaatcatttattaaaaaaaataaataagcttaacacaaaagcagaaaaagaaataatagtaacgtggtcccgggcatctaccattatacccacaatgatcggccatactattgctatccataatggaaaggagcatttacctatttatataacagatcgtatggtgggccataaattgggagaatttgcacctactctaaatttccggggacatgcaaaaaatgataataaatctcgtcgttaattcgttaatcttaattcctaaataattaatatttaaaattaataaaatgaatatttcattttaaatttaaataaatatttaaatattaaataaaaaatgaatattaatattattaaataaaaatattaatattattaaataaaaaaagattgaaattaatattaaataaaattaataaaattaatattaaatataaataaaaaaataaataaaaaaagaaaatttcaatttaattgaaaattttctttcattttaaaagtttcatttaaattgaaaaggaaaatatagatatttgaatagtgaatagtattttgtaatttagatttagagtaatagtaatttagaattaaagatatgtatatttattagtttcattttacaatttaaattttttttctgacttttctcgttcattaaaattattactttatttatgacattaaaaaaaaaagaggttaataaatcttatgataaataaaagaaagaaaaagagagggcggaatgacgggaattgaacccgcgcatggtggatt

SEQ ID NO: 4738 - DNA, 1468 bp, Zea mays
tatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaacgggaacggtctattggaattggctctctatccatggaatctcatccatcatccatacataacgaattggtatggtatattcataccataacataagaacaataagaactcgaattcttatcgatactggaactcagagcataggggggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccatagacaggcaagtgaaatccaatccacgaaataaattgatccatggacggcaccattgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagg

SEQ ID NO: 4739 - DNA, 1844 bp, Sorghum bicolor
atggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggttaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaaattgcaataatgcgatgggcgaacgacgggaattgaacccgcgcatggtggattcacaatccactgccttgatccacttggctacatccgccccttatccagctaaaggattttctcttttttccattcattattattctatttattctgacctacatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaagaaata

SEQ ID NO: 4740 - DNA, 1121 bp, Cucurbita pepo
acgaaacctagaaatcgatcactgatccaatttgagtacctccacaggatagactcaacagaaaacagaagagtaacggcagcaagtgattgagttcagtagttcctcatataaaattattgactctagagatatagtaatatggagaagactaaattgtttcaagcaccgacagaaccagaagcgtcccttgtttcaaagagaggaggacgggttattcacatttcatttgatggtcagaggcaaattgaaagctaagcagtggtaattctaaggattcccgaggggaaaaatagagatgtctcctacgttacccgtaatatgtggaagtatcgacgtaatttcatagagtcattcggtctgaatgctacatgaagaacataagccagatgaaggaacgggaagacctaggatgtagaagatcataacatgagtgattcggcggatttggattcctatatatccactcatgtggtacttcattggacgatatatataagatccatatgtatagatatcatcatctacatccagaaagccgtatgctttggaagaagcttgtacagtttgggaaggggttttgattgatcaaaaagaagaatctacttcaaccgatatgcccttaggcacggccatacataacatagaaatcacacttgggaaggggggacaattagctagagcagcaggtgctgtagcgaaactgattgcaaaagaggggaaatcggccacattaaaattaccttctggggaggtccgtttgatatccaaaaattgctcagcaacagtcggacaagtggggaatgctggggtaaaccagaaaagtttgggtagagccggatctaaatgttggctaggtaagcgtcctgtagtaagaggagtagttatgaaccctgtagaccatccccatgggggtggtgaagggagggccccaattggtagaaaaaacccgcaacccttggggttatcctgcacttggaagaagaagtagaaaaggaataaatatagtgataattttattcttcgtcgccgtagtaaataagagagaaaatagtaatttttttcttcgtctttactttacaaacaaaaaaaataggagggaaattcactgtggcgcgctc

SEQ ID NO: 4741 - DNA, 1995 bp, Prunus persica
ctccaataagtctattggaattggctctgtatcaatggaatctcatcatccatacataacgaattggtgtggtatattcatatcataacatatgaacagtaagaactagcattcttattgagactagaactcatagggaagaaaatagatttatggatggaatcaaatatgcagtatttacataaaaaagtattcagttattggggaaaaatcaatatacttctaatgtcgaatcaggatcaactaggacagaaataaagcattggttcgaactcttttttggtgtcaaggtaatagctatgaatagtcatcgactcctgggaaagggtagaagaatgagacctattatgggacatacaatgcattatagacgtatgatcattacgcttcaaccgggttattctattccacctcttagaaagaaaagaacttaaatcaaaatacttaatagcatggcgatacatttatacaaaatttctaccccgagcacacgcaatggagccgtagacagtcaatccaatccacgaaataatttgatctatggacagcatcgttgtggtaaaggtcgtaatgccagaggaatcattaccgcagggcatagagggggaggtcataagcgtctataccataaaatagaatttcgacggaatgaaaaagacatatatggtagaatcgtaactatagaatacaaccctaatcgaaatgcatacatttgtctcatacactatggggatggtgagaaaagatatattttacatcccaaaggggctataattggagataccattgtttatggtacataagttcctataaaaatgggaaatgccctacctttgagtgtggtttgaactattgatttacgtaattggaagtaaccaattaggtttacgacgaaacctagaaattgatcactgatccaatttgagtacctctacaggatagacctcaacagaaaactgaagagtaatggcagcaagtgattgagttcagtagttcctcatataaaatgattgactctagagatatagttatatggagaagacaaaattatttcaagcacctacagaaccagaagcggcccttgtttcaaagagaggaggacgggttattcacatttcatttgatggtcagaggcgaattgaaagctaagtagtggtaattctaagaattcccccggagaaaaatagagatgtctcctacgttacccgtaatatctggaagtatcgaggtaatttcatagagtcattcggtctgaatgctacatgaagaacataagccagatgaaggaacgggaagacctaggatgtagaagatcataacatgagttattcggcagattttgattcctatatatccactcatgtggtacttcattatatgatatataagaattataagatatatataagatccatctgtatagatatcatcatctacatccagaaagccgtatgctttggaataagcttgtacagtttgggaaggggttttgattgatcaaaaagaagaatctacttcaaccgatatgcccttaggcacggccagacataacatagaaatcacttgaaaagggtggacaattagctagagcagcaggtgctgtagcgaaactgattgcaaaagaggggaaatcggccacattaaaattaccttctggagaggtccgtttgatatccaaaaactgcacagcaacagtcggacaagtggggaatgttggggtgaaccagaaaagtttgggtaaagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtaataggtgagaaaatataattttgtttcttcgtctttacaaaaaataaataa

SEQ ID NO: 4742 - DNA, 576 bp, Zea mays
ggatttggattccttttctatatatccactcatgtggtacttcatcatacgattcatataagatccatctgtctagagatcgtcatatacatctagaaagccatatgctttggaagaagcttgtatagtttgggaaggggttttttgagaaaaaagaagaatctacttcaaccgatatgcccttaggcacgaccatacataacatagaaatcacacgtggaaggggtgggcaattagctagagcagcaggtgctatagcgaaactgattgcaaaagagggtaaattggccactttaagattaccatctggggaggtccgtttggtatcccaaaactgcttagcaacattcggacaagtgggtaatgttggggtgaaccaaaaaagtttcggttgagacggatctaagtgttggctaggtaaatgccccgtagtaagaggggtagttatgaaccctgtggaccacccccatgggggtggtgaagggaaagcccccattggtagaaaaaacccacaaccccttggggttatcctgcgcttggaagaagaactaggaaaaggaaaaaatatagtgatag

SEQ ID NO: 4743 - DNA, 1274 bp, Salvia sclarea
ggggtacctctacgggatagacctcaacagaaaactgaagagtaacggcagcaagtgattgagttcagtagttcctcatataaaattattgactctagagatatagtaatatggagaagacaaaattgtttcaagcaccgacagaaccggaagcgccccttctttcaaagagaggaggacgggttattcacatttcatttgatggtcagaggcgaattgaaagctaagcagtgggaattctaaagattccccggggaaaaatagagatgtctcctacgttacccataatatgtggaagtatcgacgtaatttcatagagtcattcggtctgaatgctacatgaagaacataagccagatgacggaacgggaagacctaggatgtagaagatcatcccatgagtgattcggcagatttggattcatatagatatccacccgtgtggtacttcattgtaccatatatataagatccatctgtatagatatcatctacatccagaaagccgtatgctttggaagaagcttgtacagtttgggaaggggttttgattgatcaaaaagaggaatctacttcaaccgatatgcccttaggcacggccatacataacatagaaatcacacttggaaagggtggacaattagttagagcagcgggtgctgtagcgaaactgattgcaaaagaggggaaatcggccacattaaaattaccttctggggaggtccgtttgatatccaaaaactgctcagcaacagtcggacaagtggggaatgttggggcgaaccagaaaagtttgggtagagccggatccaagcgttggctgggtaagcgtcctgtagtaagaggagtagttatgaaccctgtagaccatccccatggggggtggtgaagggcgagccccaattggtagaaaaaacccacaaccccttggggttatcctgcacttggaagaagaagtagaaaaaggaataaatatagtgataatttgattgttcgtcgccgtagtaaataggcgataaaatcgaatttatttcttcgtctttacaaaaacaaaaaaaataggagtaagctgtgatacgttcactaaaaaaaaatccttttgtagccaaaaatgtattaaaaaaaatttcaaaacttaatcaaaaagcagaaaaagaaataattgtaacttggtctcgtgcatctaccattatacctacaatgattggccatacgattgccgttcataatggcaaagagcatttgcctatttatataacagatcgtatggtagg

SEQ ID NO: 4744 - DNA, 11897 bp, Cannabis sativa
tcgaaaaagagattcgattgatgggatttggtatgatacttatgaaatcgatgatatcgatgagattgatattcaaatatttcttcttagaacgtattgatttgaccccataagtgggaccgccaccccatagcatgttgccgccagaagcagaaccctgtatttcttctagagaatctcctaattgttcccgagcaactagaaagagattctttaaccagaaagaattcagttcagatgtaggatacctatccagaagttttcgcaactcaatcatgtatgatggaatcatcaaagatttgaccctttcgaactctgtctgtaactcactataggctcgagaaacaaaaagaagatgtgtacgaacgagatatccagcaacaagaagaaggaaaaggattgaatagaggaactcccgaacccgaacatttggcgatctcagatgtgtcgatatcaatggtgactcattatttcgatgaatcatttctttggacagaagaagattatgtaaacacttactcgaaatctcacttatcagattccattgtggaagacagaattttttctgaagaattcgccatgatatatctaatccatgcataatatcatgaaaaatggatacaaattttgggctgctacttagtatcggcaataggtctgaaaaagtatctaaaaatatcaaatttagatatttgtatcctgtcgaagtaaggaaccatggcatatatgtttggaatatattccattttgagagagttgaaaaagcactatctcgttgaaaggttctatacatctgccctttctcaaggcatttctttagacaaagaccccgttttttcctcttttcggatggtaaatatttctcagaacatggagtgtgaatcaaacccatgtttgaattgaaattgagatactgatgcaagttcttctcttctgaatcagacagattaatatctgaaagaggttgacaataagttctttcaaaattgactatttgtccccctgttagaagtattccagaaatgtctgcgatcgagtaaatagctctacgaacgaatggatcggatcgaattggaaaatggaaagatttgtacaagttatacctttcgtcaccattttgtggaaaatcgttaggtatgaatatgttagacacctgtaactcgattggtgaaatagtatctctctccaaaaaagcatatttttttttaccgccgcgcaaagaaaatattttgttgcgaatgaacaagatattgaggaattgtccatacgtaaaatcataattattgatacgggccttttccacataaaaagggaatcctttgttacaatagaagcagaagtgatgtggattattcaagaatcgaagtcgatttgctttataaaaagaagatatcaatgagcttctatgaaatggtttcacgggattcagccaattgtcttgatcgtgggatatcattgagaaataggaatccgtgttatcaaaagatttcctgcgattatttctagtatggaatgagtcaatcatccactttggtatcttattgaacaaaaatggtgatattgttcctccattgatcaagaatttcgatttttgggaagtatcatgatcatccaataaaaagggtttccatttttttaaatgaacgatttgaagacctattgattctaacaactgatggcagagttgatcattcggacctttcaattcatagatgtggatctcggacctatgaatggggatattcccgaaactcacaaagaaaaaaggaagtgagttagacaaaaagagaagaaacttggacaaaaaaagaagtaacttggacaaaaagaaaggaagtgacttagacaaatcttttttgtcgataacctcagaccaatcaatcgaatattgattaatacgtaatcgatcgaacactacttgaaaatgaaaacggctcttctgctcagaaatgaaatgttccaaatgttcctgtaaattcttgctcccattggaccatttgtatctatatgcattaggatcccgattcatggatctctcggttcgagaaataaaaataagaggatcgaaccatttcttctgactctttttcaaatttgagaaatgttggttgatcatatatttcattatagttctatgattcagagtatcgtttcctatttgatccctttgaattacatattcgaagttgcgatcggatctattcattaaaaagaatcgattcaatacatttcttatgtacccataggtgctatattggatttgaatcagatttcggatcaatctatattgattaactgcctccattatgttgttgctagcaaataccattatttttggttttggatcttccaaatcattcccgcaggaggtccggacccatttttttctgatccttcgataaaaagattcattttcttcataaaaaataggaggtagaaccaataaatatttctttttcgattcatccctggagttgaatacctcattcaagaattgtttttgatccaatctgtaggaatcaatagaaagggcaaatcccttatgatacaccagatccggctcggttattgatagagtgaatagatctgccatttcttgaaatctctcttctgattcaaaatcgtggtgtaacgtgtatccccccctgttccggtcatggaatagatgaactaaatcaaaaaatggatttttgttcaagaatgaaatcttattggaactgtccatatccagttcatccttcggaaccatatcacatcccggatctgatgaaataggatgaattgagacggtattttgtaaatacgtaattatcttgaatatattaactatttctttattttccgatcgcctggaagggacaaaagaaacatcttgttctttcttcaacaatttctgatctctagtggacctctcagtaggattcgaacccagatgaagttctgaccatctgtcagagaaaaaagaacgaatggatcttgtaggattcccaagaaattcttcgatttcttccggaagcagatgaataatcatctgcttctcacgttccgtgaatagccgggacattgaggaatatccagaaagacatttagggaatcggtctgattctatctctgttcgttccgtttgaagaaaggaaggatcccaaagaatcgatctttcttttagttgttgaatctctctttgattgatcaatgtgtgatattctgaatcctcattactaatggaatcaaaatgatatctggatcgatcagaagatcctttcaattggctataatccgttacttgaacgaaactagatcttgtggaatcatattgaatatttgacgatacattccgtaccttactaaaaaaccgatccttgttttccaaccacacattgtctaaccaaatccaattctctctcgatatgttcctcaaaaaatccgattcgtgcggattcttcccccaactaaagaagagatcttggcggaattgccacatatgaaattgagcacaattttgcaaagaaatagcccacttgtttctcgagaagagatgggaaacatgctcaatatcatttgattgaatagttgacccagctccttgttgtttgaagaaacccttcgcttcaattggtattttttcacgaaaagcaaacatgagataacaaatccagtctttcactaagatttcgaatagctgtgccgaattcaagttgattatgtttcgcctcttcctcggagaaagacgatcaaacaattcccaatcatggtccttgcggatcggatcatccatataatatacaaaaagaaactccagatatttgatatctttctctttgaatgagatctcaattccagcgacggtttcattagatatcttacaactagaatccctcttttttccgagccagttcctccaccatcgcgagccccagttagattcaggcatgatacactttttagttattgggagaacccaagtactctcttttggatccaggaaacagctctcagagattttttttccttttggaagatacaggagcgaaacaatcaacctattgatattggaagaccaaaaagattcttccaatgtatcatttctgggtccaatgaaattcataggtataggaagaagccctgtcaaatagagattttttctttcgaccatctttcgattgttaatacgatatataaggaccgctactacaaatagtactacacccttgatcgtgaaatatcgattgctcgttgaaccctgtaaatgtgaattgcgtgaaagtaggatactccaaattcgggagtccaagagttttataaaacgttcttgatggaaaaagatgtgaatgaaagatatcactgaattcaattgggtccatgaatctaagaaatagtgagaattcttgatctctctcaatatctctctcaattcgaaaatccaggatttgaattgatgtcctttcattaagattaagtcctcctaaattgcattgatttaccctaaagatttcatttcaattggaatttggttattcaccatgtacgaggatccccgctaagcatccatggctgaatggttaaagcgcccaactcataattggcgaattcgtaggttcaattcctactggatgcacgccaatgggaccctccaataagtctattggaattggctctgtatcaatggaatctcatcatccatacataacgaattggtgtggtatattcatatcataacatatgaacagtaagacctaacagtcttattgagactagaactcatagggaataaaatttatggatggaatcaaatatttcgtagttacagacaaaagtattcggttattgctgaaaaatcaatatacttctaatgtcgaatcaggatcaactaggacagaaataaagcattgggtcgaactcttctttggtgtcaaggtaatagctatgaatagtcatcgactaccgggaaagggtagaagaatgggacctattatgggacatacaatgcattacaaacgtatgatcattacgcttcaaccgggttattctattccacctcttataacgaaaagaacttaaatcaaaatacttaatagcatggcgatacatttatacaaaacttctaccccgagcacacgcaaaggagccgtagacaggcaagtgaaatccaatccacgaaataatttgatctatggacagcatcgttgtggtaaaggtcgtaatgccagaggaatcattaccgcagggcatagagggggaggtcataagcgtctataccgtaaaatagattttcgacggaatgacaaagacatatatggtaaaatcgtaactatagaatacgaccctaatcgaaatgcatacatttgtctcatacactatgggggtggtgagaaaagatatattttacatcccagaggggctctaattggagataccattgtttctggtacagaagttcctataaaaatgggaaatgccctacctttgagtgcggtttgaactattgatttgcgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccaaccagaagcgccccttgtttcaaagagaggaggacgggttattcacatttcatttgatggtcagaggcgaattgaaagctaagcagtggtaattctgaggattccccgggggaaaaatagagatgtctcctacgttacccgtaatatgtggaagtatcgacgtaatttcatagagtcattcggtctgaatgctacatgacgaacataagccagatgaaggaacgggaagacctaggatgtagaagatcataacatgattgattcggcagattttgattcctatatatccactcatgtggtacttcattatatcgtatatataagaattatacgatagatagaagatccatctgtatagatatcatcatctacatccagaaagccgtatgctttggaagaagcttgtacagtttgggaaggggttttgattgatcaaaaagaagaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatacccaaaaactgctcagcaacagtcggacaagtggggaatgttggggtgaaccagaaaagtttgggtagagccggatctaaacgttggctaggtaagcgtcctgtagtaagaggagtagttatgaaccctgtagaccatccccatgggggtggtgaagggagggccccaattggtagaaaaaaaccctcaaccccttggggttatcctgcacttggcagaagaagtagaaaaaggaataaatatagcgataatttgattcttcgtcgccgtagtaaataggagagaaaatagaatttgtttcttcgtctttataatataaaaaaaaataggagtaattaattgtggcacgttcactaaaaaaaaatccttttgtagccaatcatttattaagaaaaatgaatatgcttaacacaaaagcggaaaaagaaataatagtaacttggtcccgagcgtctaccattatacctacaatgatcgggcatactattgctgttcataatggaaaagaacatttgcccatttatataacagatcgtatggtaggccataaattgggagaatttgcacccactctaaatttccggggacatgcaaaaaatgataatagatctcgtcgttagttaatatttagttaataaataatgtatggtaggccataaattgggagaatttgcacccactctaaatttccggggacatgcaaaaaatgataatagatctcgtcgtcagttaatatttagttaataaataataataataaaatgaaatatagatgcttatcgttcattagtgaggagtgatagaaatcaaatacatgtttactagaactaatgccatatcgagcatgttatccaattttaaaattggttaattccgcggcagcaaacgccactcacaatatgcgcttcaacgaagctactttaattattagtaacgctgaggtcaacgaaggcaacactgtgaaaaaattaaaaccgcaagctcggggacggggctatccaataaaaagacacacttgtcatataactattgtactgaaagacttatacgtagaaaaagaaaatttatattaatatattatatgaatatgatatattttttatatttatataagatttaatattcataaggtcagtctatgtatacattatatgtatagtaatactagcggggattgtgggacaaaaaataaatcgacttggtttcagacttggtgcaacccaagctcatcgttctctttggtttgcacaaccaaaaaattattctaaggatctacaagaagatcgaaaaatacgaaattgtatcaagaattatgtacaaaaaaatatgaaaatatcttctagtgtcgaggggattgcatggatagagattcaaaaaaaaatcgacttgattcatgtcataatctatatgggattcccaaaattattaatagcccccaaaaaatggaagaattacagatgaatgtaaaaaaagaactacattcgatgaaccggaaacttgacattgctattacaagaatagcaaatccttatggacaccctaatattctagcaggatttatagccggacaattaaaaaatagagtttcatttcgcaaagcaatgaaaaaggctattgaattaactgaacaagcaggtacaaaaggaattcaaatacaaattgcagggcgtatcgacggaaaagaaattgcacgtgtcgaatggatccgagaaggtagggtacccctacaaaccattcgagctaaaattgattactgttcctatacagttggaactatctatggggtattaggtatcaaaatttggatatttgtcgatgaggactaataatcctttacttgacttatctttagatcgatcaggtaatataccaaaaaaacaaaaaagaaaaaacacttttttctattaaatcaaaacaaaaataaataattctataaggttgaataaaaattctattaatcagttgatttaatataattgctatgcttagtgtgtgactcgttggtttttttagggttagatttaaaaacaaaaatagaccagcccataagtatgaattaataaccaactcatcgtttcgcattatctggatataaagaaccagtcgagatatgatatattagtcatatcattgtagcgactgaaatctgttttgtataaaaaaaaaaagaaaaacaagattgattaggagttgtgaaacaataaaagttaaagtgtgtggataaatgaaaagatgagagaaagagagtggtatctccaattagagcccctctgggatgtaaaatatatcttttctcaccacccccatagtgtatgagacaaatgtatgcatttagaaaaagtttgattcagagggagaagaagaggcaaaaattagaacaaaaatataattcgattcggggatcctcaaaaaaagaaataagaaagatatgtttaatttctgaaccacttccgtgagtgcataagattctattgaaaacgaatcctaatgactcattgggtaggatggcggaacgaaccaggaaccaattcatttattctgaaaaagtcatggcataaactaatcttataaaattgaaataaagagtaaatattcgcccgcaaaattttttatttttaagaaaacaaaattttctataaatagaaatcaaatacatgtttacttctatgtcaaataaagatatccaaattgataataacttatcaaaatcaaagactctcaggcttcaatatgtttaatcaatatattattgattaaatatatgtatattattttatgatcatttccttcgcgaggagctggatgagaagaaactctcatgtccggttctgtagtagagatggaattaataaaaaaccctcaactataaccccaaaagaacccgaatccgtaaacaccatagaggaagaatgaaaggaatatcttatcgaggtaatcgtatttgcttcggtagatatgctcttcaagctcttgaacccgcttggatcacatctagacaaatagaagcagggcgacgagctatgacacgaaacgcccgccgcggcggaaaaatatgggtacgtatacttccagacaaaccagttacagtaagacctacagaaacacgtatgggttcgggaaaaggatctcccgaatattgggtagctgtcgttaaaccgggtagaatcctttatgaaatgagtggggtagccgaaaatatagccagaaaggctatttcaatagcggcttccaaaatgcctatacgaactcaatacattatttcaggatagagatgtagaaccaaaagaaaaaggtttttggatgaaaaaagacaattgcaggattctttttttgttttgaataaacaacattttttttttttacttcgccctttgcattgaaaaaacagatcaaaaatgatatgattcaacctcaaacccaattgaatgtagcggatcacagcggagccagaaaattgatgtgtattcgaatcataggagctagtaatcgacgatatgctcatattggtgacgttattgttgctgtatcaaagaagcaataccaaatccaccgctggaaagatccgaagtaatcagagctgtaattgtacgtacttgtaacgaactcaaacgcgacaacggtatgataatacgatatgatgacaatgctgcggttgttattgatcaagaagaaaatccaaaaggaactcgaatttttggcgcaattgcccgagaattaagacaattaaatttcactaaaatagtttcgttagcacctgaagtattataagatgagaccgtaaagacactttttattttatagtatttgaatgaaattaatttagtagatttagtagattgtttgtgtctcatgtatatgcctttaattttctaattaagaaaaaaaaaaagagcatgttgattatatccaaatttggggacaaccaatatcttcatttattatgagtaaagacactattgctaatatactaacctctatacgaaatgctgacacgaataaaaaaagaacagttcgaataccatatactaatatcgctgacaccacttattcaatgaatacactattgctaatatactaacctctatacgaaatgctgacatgaataaaaaaagaacagttcgaataccatatactaatatcaccgaaaatattgttaaaatccttttacgagaaggttttattggaaacatgaggaaacatcaggagaacaacaaatactttttggttttaaccctacgacatagaaggaataggaaagggccatctagaactgttttaaatttaaaatgtatcagtcgacctggtctacgaatttattctaactatcaaggaatccctagaattttaggcgggatggggattgtaattgtttctactttgcggggtataatgacgcacagagaggctcgactagaaggaatcggcggagaaattttgtgctatatatggtaatctttcttttctgatatccaaattatatacagaactttcctatttcatatttgtgaaaaaaaaaaagaaatagagaaagtgtggttttcaaatattacgcttcccacattagttaatccctcaagtgaaagaacaaaaaaggttcatgaaggtttaatttctgaaccacttcccatggtatactttaggttcatttaaataatgaaaatcagagcctccgttcgtaaaatttgtgaaaaatgtcgactgatccgtaggcgaggacgaattatagtaatttgttccaacccaagacataaacaaagacaaggataatttttaaaatccgtaggcgaggacgaattatagtaatttgttccaaccaaagacataaacaaagacaaggataatttttagaaaaaagaggagaggggattctagaaatcgaaaggccctactgttcaaataatagaaataaataataaattaaaggctctgttttgacatgaaacggatatatctctatatctctgacttagcttagatttatgagatgatataattatggcaaaagctataccaagaagtggttcacgtaagaatagacatacgggttcacgtaaaaatgcacgtagaataccaaagggagttattcatgttcaagcaagtttcaacaatactattgtaactgttaccgatgtacgggggcgggtaatttcttggtcctccgccggtacttgtggattcaagggtacaagaagagggacaccatttgccgctcaaaccgcagcaggaaatgctattcggacagtagtagatcaaggtatgcaacaagcagaagtcatgataaaaggcccgggtctcggaagagatgcggcattaagggctattcgtagaagtggtatactattaagtttcatacgagatgtaacccctatgccacataatggctgtaggccccctaaaaaaaggcgtgtgtaaaaataaacattgaagatatttcaaaagaaataaataattcaatgatttgatcaaataatatcactatgggtcaagagaaagtaatagtatctactcggccactacagtggaaatgtgttgaatcaagagcagacagtaagcgtctttattatggacgctttattctggctccac

SEQ ID NO: 4745 - DNA, 1502 bp, Citrullus lanatus
cggaagaaaagaaggctttgaggggaattgatagaatacgaccctaatcgaaatgcatacatttgtctcatacactatggggatggtgagaaaagatatattttacatcccagaggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctccacaggatagacctcaacagaaaactgaagagtaacggcagcaagtgattgagttcagtagttcctcatataaaattattgactctagagatatagtaatatggagaagactaaattgtttcaagcaccgacagaaccagaagcgtcccttgtttcaaagagagcaggacgggttattcacatttcatttgatggtcagaggcaaattgaaagctaagcagtggtaattctaaggattcccgaggggaaaaatagagatgtctcctacgttacccgtaatatgtggaagtatcgacgtaatttcatagagtcattcggtctgaatgctacatgaagaacataagccagatgaaggaacgggaagacctaggatgtagaagatcataacatgagtgattcggcggatttggattcctatatatccactcatgtggtacttcattgtacgatatatataagatccatatgtatagatatcatcatctacatccagaaagccgtatgctttggaagaagcttgtacagtttgggaaggggttttgattgatcaaaaagaagaatctacttcaaccgatatgcccttaggcacggccatacataacatagaaatcacacttgggaaggggggacaattagctagagcagcaggtgctgtagcgaaactgattgcaaaagaggggaaatcggccacattaaaattaccttctggggaggtccgtttgatatccaaaaattgctcagcaacagtcggacaagtggggaatgctggggtaaaccagaaaagtttgggtagagccggatctaaatgttggctaggtaagcgtcctgtagtaagaggagtagttatgaaccctgtagaccatccccatgggggtggtgaagggagggccccaattggtagaaaaaaacccgcaaccccttggggttatcctgcacttggaagaagaagtagaaaaaggaataaatatagtgataatttgattcttcgtcgccgtagtaaataagagagaaaatcgaatttgtttcttcgtctttacaaacaaaaaaaataggaggtaaattcactgtatttatcttatcagttatatattctataactatatattatgggcgaacgacgggaattgaacccgcgcatggtggattcacaatccactgccttgatccacttggctacatccgccccctaccctatatataagtagaaatcctaaaaaaaa

SEQ ID NO: 4746 - DNA, 3147 bp, Ricinus communis
ctttattgaccgcaacttctgtatttattatcgctttcattgctgcccctccggtagatattgatggtattcgtgaacctatttctggatctttactttatggaaacaatattatttctggtgccattattcctacttctacagctataggtttgcatttttacccaatatgggaagcggggtctgttgatgaatggttatacaatggcggtccttatgagctaattgttctacacttcttacttggtgtagcttgttacatgggccgtgagtgggagcttagtttccatctgggtatgcgcccttggattgctgttgcatattcagctcttgttgcagctgctactgctgttttcttgatctatccaatcggtcaaggaagtttttctgatggtatgcctctcccacacaacatccttatgcacccatttcatatgttaggcgtagctggtgtattcggcggctccctattcagtgctatgcatggttccttggtaacctctagtttgatcagggaaaccacagaaaatgaatctgctaatgaaggttatagattcggtcaagaggaagaaacttataatatcgtagctgctcatggttattttggccgattgatcttccaatatgctagtttcaacaactctcgttctttacacttcttcctagctgcttggcctgtagtaggtatttagttcactgctttaggtattagcactatggctttcaacctaaatggtttcaatttcaaccaatctgtagttgatagtcaaggtcgtgtaattaatacctgggctgatattatcaaccgtgctaaccttggtatggaagttatgcatgaacgtaatgctcataacttccctctagacctagctgctgtcgaagctctatctacaaatggataagactttggtcttagtatgcgtgagttcttgaaaataaaataaaaaaaggagcaatagccaatttcttgttctatcgagaggattggtattgctcctttttttagtaattatattttagtaatatatagatgtttattttacataaacataaaaaaaacagataaaaaagtttattttttttttattttctttaatctttaaaattaaaaaataaaagaatcttttagaaaaaaaaatctttttatgggtcgctttctgaagattatatatatagtttatgtacttattttaaattgagtatatgttcttctcaatctttttttttctgaagttctttttttttttcgattgaaaataaaagatataaaagataaagcttttatttttatgtctttttatttttatagttttattttattcttgtatttgtatcttataaaatcttttaagagagataaaattgaaatttaaatgctagaaattgaagcccttctacttctaatatttaattacttctaatatttaatcgaatatttatttttaaatagagttataggattaggggcggatgtagccaagtggatcaaggcagtggattatgaatccaccatgcgcgggttcaattcccgtcattcgcccatagtcataaattttttttttaatgtcataaataaagtaataattttaatgaacgagaaaagtcagaaaaaaaatttaaattgtaaaatgaaactaataaatatacatatctttaattctaaattactattactctaaatctaaattacaaaatactattcactattcaaatatctatattttccttttcaatttaaatgaaacttttaaaatgaaagaaaattttcaattaaattgaaattttctttttttctttatttatttatttatttatatttaatattaattttatttaatattaatttcaatctttttcatttaataatattaatatttttttttaataatattaatattttttttaataatattaatatttttatttaataatattaatattcattttttatttaatatttaaatatttatttaaatttaaaataaaatattcattttattaattttaaatattaattatttaggaattaagattaacgaattaacgacgagatttattatcattttttgcatgtccccggaaatttagagttggtgcaaattctcccaatttatggcccaccatacgatctgttatataaataggtaaatgctcatttccattatggatagcaatagtatggccgatcattgtgggtataatggtagatgcccgggactacgttactattatttctttttctgcttttgtgttaagcttatttattttttttaataaatgatttgctacaaaaggattttttttaggaacgtgtcacggtgaatttctcctattttttttatttattttgaaaagacgaagaaacaaattctattttttctcctatttactacgacgacgaagaatcaaattatcactatatttattcctttttctacttcttcttccaagtgcaggataaccccaaggggttgcgggtttttttttctaccgattggggccgtcccttcaccacccccatggggatggtctacagggttcataactactcctcttactacaggatgcttacctagccaacatttagatccggctctacccaaacttttctggttcaccccagtattccctacttgtccgactgttgctgagcagtttttggatattaaacgaacctccccagaaggtaattttaatgtggccgatttcccttcttttgcaatcagttttgctacagcacctgcagctctagctaattgtccaccctttccaaatgtgatttctatgttatgtatggccgtgcctaagggcatatcggttgaagtagattcttctttttgatcaatcaaaacctcttcccaaactgtacaagcttcttccaaagcatacgactttctgggtgtagatgatgatatctatacagatgaatcttatatatcgtaaaatgaaaaaagtactacatgagtggatatataggaatcaaaatctgctgaatcactcatgttatgctcttctacattctaggtcttcccgttccttcatctggcttatgttcttcatgtagcattcagaccgaatgattctatgaaattacatcgatacttctacatattaggggtaacataggagacatttctattttttccc

SEQ ID NO: 4747 - DNA, 4222 bp, Carpinus betulus
ccacgaatctaagaaatagtgagaattcttgatctctctcaatatctctctaaattcgaaaatccaggatttgaattgatgtcctttcattgagtcctcctaaattgcattgatttatcctaaagatttcatttcaattggaatttggttattcaccatgtacgaggatccccgctaagcatccatggctgaatggttaaagcgcccaactcataattggcgaattcgtaggttcaattcctactggatgcacgccaatggaccctccaataagtctattggaattggctcggtatcaatagaatctcatcatccatacataacgaattagtgtggtatattcatatcataacatatgaacagtaagaactagcattcttattgagactaaaactcatagggaagaaaatagatttatgaatggaatcaaatatatagtattgacagacaaaagtattcggttattggttaaaaatcaatatacttttaatgtcgaatcgggatcaactaggacagaaataaagcattgggtcgaactcttctttggtgtcaaggtaatagctatgaatagtcatcgactcccgggaaagggtagaagaatgggacctattatgggacatacaatgcattacagacgtatgatcattacgcttcaaccgggttattctattccacctattataaagaaataaagaaaagaacttaaatcaaaatacttaatagcatggcgatacatttatacaaaacttctacctcgagcacacgcgatggagccgtagacagtcaagtgaaatacaatccacgaaataatttgatctatggacagcatcattgtggtaaaggtcgtaattccagaggaatcattaccgcaggacatagaggggaggtcataagcgtctataccgtaaaatcgattttcgacggaatgaaaaagacatatatggtagaatcgtaaccatagaatacgaccctaatcgaaatgcatacatttgtctcatacactatggggatggtgagaaaagatatattttacatcccagaggggctataattggagataccattgtttctggtacagaagttcctataaaaatgggaaatgccctacctttgagtgcggtttgaactattgatttacgtaattggaagtaaccaattaggtttaaaacgaaacctagaaatcgatcactgatccaatttgagtacctctacaggatagacctcaacagaaaactgaagaggaacggcagcaagtgattgagttcagtagttcctcatataaaattattgactctagagatatagtaatatggagaagacaaaattgtttcaagcaccgacaaaaccagaagcgccccttgtttcaaagagaggaggacgggttattcacatttcatttgatggtcagaggcaaattgaaagctaagaagtggtaattctaaggattcccccgggggaaaatagagatgtctcctacgttacccgtaatatgtggaagtatcaacgtaatttcatagagtcattcggtctgaatgctacatgaagaacataagccagatgaaggaacgggaagacctaggatgtagaagatcataacattactgattcggcagatttggattcctatatatcactcatgtggtacttcattatacgatatatatatataagaattatacgatatgtataagatccatctgtatagatatcatcatctacatccggaaagccgtatgctttggaaaaagcttgtacagtttgggaagaggttttgattgatcaaaaagaagaatctacttcaaccgatatgcccttaggcacggccatacataacatagaaatcacacttggaaagggtggacaattagctagagcagcaggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaagtgttggctaggtaagcgtcctgtagtaagaggagtagttatgaaccctgtagaccatccccatgggggtggtgaagggagggccccaattggtagaaaaaaacccgcaaccccttggggttatcctgcacttggaaggagaagtagaaaaaggaataaatatagtgataatttgattcttcgtcgccgtagtaaataggatagaaaatcgaatttgtttcttcgtctttacaaaaaaaaaaaaaaaataaggagtaattaactgtgacacgctcactaaaaaaaatccttttgtagcgaatcatttattaagaaaaataaataaacttaacacaaaggcggaaaaagaaataataataacttggtcccgagcgtctaccattatacccataatgatcggccatactattgctatacataatggaaaggagcatttgcctatttatataacagatcgtatggtgggccataaattgggagaattcgtacctactctaaatttccgaggacacgcgaaaaatgataatagatctcgtcgttaaaaaaataaaaaaatgaaaaataacgtaaatatagatgcttatcgttcattagtaagaggtgacttttatgataaagaaaagaaagaggaatccatatacagaagtatgtgctttaggtaaacatatacgtatgtctactaacaaagcacaaagagtaattgatcagattcgtggacgttcctacgaagaaacgcttatggtactagaacttatgccttgtcgagcatattatccacttttaaaattggtttattctgcagcagcaaatgctattcacaatatgggtttaaacgaagcaagtttaatcattagtaaagtggaagtcaacgagaacgagggtactactgttaaaaaattaaaacctcgaactcgaggacgtatttatccgatttatccgataaaaagacccacttgtcatataactattgtattaaaagatgtatctgtaaacgaacaatattataaaagatccgaatacaccatattatgcttaaaaaaccctggatggataaataaaaataagtacacagatatgacgtgtcatgatatatatagtatcgggggattatgggacaaaaaataaatccacttggtttcagacttggtgcaacccaaggtcatcattctctttggtttgcacaaccacaagattattccgaaggtttacaagaagatcaaaaaatacgagattgtattaagaattatgtacaaaaaaatattagaatatcctctggtattgagggaattgcatgtatagagattcaaaaaagaatcgatctgattcaggtcataatctatatgggatttcccaaattactaatagaaggtcggcctcgaagaattgaagaattacagatggatgtacaaaaagaacttaattgtgtaaaccgaaaactcaacattgctgttacaagaattacaaacccttatggacaccctaatattctcgcagaatttatagccggacaattaaagaatagagtttcatttcgaaaagcaatgaaaaaggctattgaattaactgaacaggcaggtacaaaaggaattcaagtacaaattgcagggcgtatcgacggaaaagaaattgcgcgtgtcgaatggatcagagagggtagggttcctctacaaaccattcgagctaaaattgattattgttcctatacagttggaactatctatggggtattaggcatcaaaatttggatatttgtagacgaggaagaataaacctttatttgacttgtctttacgttctatcggcaatacaaaaaaaaagaaaaaatgacaaactctttcattttttttatgttaaataaaaacaaaaatgggcaattctataaggttgaataaaaattcaattaattttttgatattgagataattgctatgcttagtgtgtgactcgttggtttttttagggttaggattcaaaaacacggaccggcccatacatagtatgaactaataactatagaactaataaccaactcatcgcttcatattatctagatagaaagaaccggtcacgatatgatatattggttatatcattgtagcaacggaaagtttttttgcataataaaaaaaaaaaaaacaaattttattataagttgtgaagcaataacaataaaaatgcggataaa

SEQ ID NO: 4748 - DNA, 8161 bp, Solanum lycopersicum
ataacgaattgatgtggtatattcatatcataatatatgaacagtaagaactagcattcttattgagactataactcatagggaagaaaatagatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgacttccgggaaagagtagaagaatgggacctattatgggacatacaatgcattacagacgtatgatcattacgcttcaaccgggttattctattccacctcttagaaagaaaagaacttaaataaaaatacttaatagcatggcgatacatttatacaaaacttctaccccgagcacacgcaatggaaccgtagacagtcaagtgaaatccaatccacgaaataatttgatctatggacagcgtcgttgtggtaaaggtcgtaatgccagaggaatcattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactattgatttacgtaattggaaataaccaattaggtttacgacgaaacctagaaatcgatcactgatccaatttgagtacctctgcaggatagacctcaacagaaaactgaagagtaacggcagcaagtgattgagttcagtagttcctcatataaaattattgactctagagatatagtaatatggagaagacaaaattgtttcaagcaccgacagaaccggaagcgccccttctttcaaagagaggaggacgggttattcacatttcatttgatggtcagaggcgaattgaaagttaagcagtgggaattctaaagattccccgggggaaaaatagagatgtctcctacgttacccataatatgtggaagtatcgacgtaatttcatagagtcattcggtctgaatgctacatgaagaacataagccagatgacggaacgggaagacccaggatgtagaagatcataacatgagtgattcggcagatttggattcatatatatatccacccatgtggtacttcattctacgatatatataagatccatatgtatagatatcatcatctacatccagaaagccgtatgctttggaagaagcttgtacagtttgggaaggggttttgattgatcaaaagaagaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaggaataaatatagtgataatttgattcttcgtcgccgtagtaaataggagagaaaatagaatttaattattcgtttttacaaaaactttacaaaaaaaaataggagtaagcttgtgacacgttcactaaaaaaaaatccctttgtagccaatcatttattaaaaaaaattgataagcttaacacaaaagcagaaaaagaaataatagtaacttggtcccgggcatctaccattatacccacaatgatcggtcatactattgctatccataatggaaaagagcatttgcctatttatataacggatagtatggtaggccacaaattgggagaatttgcacctacattaaattttagaggacatgcaaaaagcgataatagatctcgtcgttaatattaataaaaaaatctagatacttatgattcagtagtaggagacaaaccttatgctaaagaagaaaaaaacagaagtatatgctttaggtgaacatatatctatgtctgctgacaaagcacgaagagtaattgatcaaattcgcggacgttcctatgaggaaacgcttatgatactagaactcatgccctatcgagcatgttatcccattttgaaattggtttattctgcagcagcaaatgctagttacaatatgggttccagcgaaaccaatttagtcattagtaaagccgaagtcaatgaaggtactactgtgaagaaattgaaacctcgagctcgaggacgtagttttccgataaaaagatcgacctgtcatataactattgtaatgaaagatatatctttagatgatgaatatggcgagatgtcttcgttaaaaaaaacgagatggaaaaaaaaatctacagctatgacgtatcgtgatatgtataatagcgggggattatgggacaaaaaataaatccacttggtttcagactgggtacaacccaaggtcatcattccctttggttttcacaacccaaaaattattctgagggtttacaagaagataaaaaaatcagagattgtatcaagaattatgtacaaaaaaatatgagaacgtcctctggcatcgagggaattgcacgtatagagattcaaaaaagaatcgatctgatccaggtcataatctttatgggattcccaaaattattaatagaaagtcgaccgcgcggaatcgaagaattacaaatgaccttacaaaaagaatttaattgtgtaaaccgaaaactgaacattgctgtcacaagaattgcaaaaccttacggaaaccctaatattcttgcagaatttatagctggacaattaaagaatagagtttcatttcgaaaagcaatgaaaaaggctattgaattaacagaacaagcggatacaaaaggaattcaaatacaaattgcggggcgtatcgacggaaaagaaattgcacgtgtcgaatggatcagagaaggcagggttcccctacaaacgattcgagctaaaattgattattgctcttatacagttcgaactatctatggaatattgggcatcaaaatttggatatttctagacgaggaataattttactacttgtctttcccttctatccaatgattgaacaaaaaaaaagaccaattcattctttttctaatcaaggggaacatttctaattcttaattctttctaattcttaattctataaggttgaataaaaattcgattgaccatttgatataattgctatgcttagtgtgtgactcgtgggttttgttagggttaggattaaaaaaacccagcccacatagtatgaacgaaaaactatagaactaataaccaacccatcacttcgcattatctggatctaaagaaccagtcaagatatgatatataggtcatatctttgtagcaactgaaatcttttgcataaacaaaaaaaatctgattctaagttgtaaagcaaaatagacaaaaaagatgtggataaagggaaggatgagagaaagagagaaaaagaataccaatgatataaaattccaatatgtaaggtctatgagtaatctcataaaagacagtgtaataaagcatcaatacgcattcataccatactaaaaagaatcttcttatagaaatagaacaaaaaatcaagagcttcgagccaataaagactaagaagattgactcaagaaccaatttgattctgagctccattgtagaattcggacctaaccattaagtaagaagtgatgggaacgacggaacttgtgaatgcaaaagattctattgaaaaaggaatcttaatgattcactggtcgggatggcggaacgaaccatagattaattcatgtattctgagatctgagaagtcacgagttaaccctacaaatgaaatagggattgaaagagtaaatattcgcccgcgaaaacttttttattgcaaaatttaggacaatacaataaaggacaaaataaggatttggtataataatacaattttttttatttctctttagaaaactacaaagtttagttatctattcaaacaagatatacaaattactaatagatttaatgaaatctcaaagaagcccacgttcaaggtattactcagtaaatacatatatatcttatatatcttaacttaagatttactattctagcttaattcaaattgaatttttttgaatccttttatttgcgaggagctggatgagaagaaactctcacgtccggttctgtagtagagatggaattcagaaccaaccatcaactataaccccaaaagaaccagattccgtaaacaacatagaggcagaatgaagggaatatcttatcgaggtaatcgtatttctttcggtaaatatgctcttcaggcacttgaacctgcttggattacatctcgacaaatagaagcaggccgacgggcaatgacacgaaatgcacgtcgtggtggaaaaatatgggtacgtatatttccagacaaacctgttacattaagaccggcagaaacccgtatgggttcaggaaaaggatcccctgaatattgggtagctgttgttaaaccggggcgaatactttatgaaatgggtggagtaacagaaaatatagccagaagggctatttcactagcagcatccaaaatgcctatacgaactcaattcattatttcgtaatgtaatagaaaaaaatgtagaaagggctcttagatatgaaagaaaaccgcatgtttcttttttttggacaaaaatatttctttttttttcttcgccctttgcattcaaagaacggattaaaaaaatgattcaacctcagacccatttaaatgtagcggataatagcggggctcgagaattgatgtgtattcgaatcataggagctagcaatcgtcgatatgctcatattggtgacgttattgttgctgtgatcaaagaagcagtaccaaatatgcccctagaaagatcagaagtagtcagagctgtaattgtgcgtacctgtaaagaactcaaacgtgacaacgggatgataatacgatacgatgacaatgctgcagttgttattgatcaagaaggaaatccaaaaggaactcgaatttttggtgcaatcgcccgggaattgagagaattaaattttactaaaatagtttcattagctcccgaggtattataaaatgaaattgtgatctgtttcgagtggggtatttgaaagaaatagattaattagtagattgtgtctcacgcatatatctttaataattcatatcatattcaaaaataaataagtaaaaaacacgttgattatatcaaatttggagaccccaataattttagttcatcatgggcagggacactattgctgagataataacttctatacgaaatgctgatatggatcgaaaaagggtggttcgaatagcatctactaatattaccgaaaatattgttcaaatacttttacgagagggttttatcgaaaacgtgagaaaacatcgagaaaacaacaaatactttttggttttaaccctgcgacatagaaggaataggaaaagaccctatagaaatattttaaatttaaaacgaatcagtcgacctggtctacgaatctattctaattatcaacgaattccgcgaattttaggtggaatggggattgtaattctttctacttctcgaggtataatgacagaccgagaggctcgactagaaggaataggtggagaaattttgtgttatatctggtaatcctttataatatgcaaattggattcgaaacttcctatttgcgaaaaagggggggagagttatctaatatctttcgcattagttgatacctcaaaggaactttgttttatacagatactgccaggagatagagtcaaaattgaagtaagtccttatgattcaaccaaaggacatataatttatcgactccacaacaaagatttgaaggattaggttttcaacttcaccattcctttcgtgggaatacaattcgagatgaaaaatttcaagaaacttattttcttccaagaaatagattcagaattaaggtaaggaatgataaatatgaaaataagagcttccgttcgtaaaatttgtgaaaaatgtcgactaatccgtaggagggggcgcattatagtaatttgttccaacccgagacataaacaaagacagggctaatcagacttgccagaagagccgatgtacaaataaagaatctgttttgacatgaaatggatatatccatatatctctgactcatatttacgagatgataaaatatggcaaaagctataccgaaaattagttcgcgtcggaatggacgtattagttcacgtaagggtgcacgtagaataccaaagggagttattcatgttcaagcaagtttcaataataccattgtcactgttacagatgtacggggtcgagtagtttcttggtcctcagctggtacttctggattcaaaggtacgagaagaggaacaccgtttgctgctcaaaccgcagcagcaaacgctatccgtacagtagtggatcaaggtatgcaacgagcagaagtcatgataaaaggtcccggtctcggaagagatgcagcattacgagctattcgtcgcagtggtatactattaactttcgtacgggatgtaactccgatgccacataatggctgtagacctccgaaaaaaagacgtgtgtagaactgaacattgaagaaatctcaagagaaataaaagattcgatgatctaatcaaataatagtactatggttcgagagaaagtaacagtatctactcggacactacagtggaagtgtgttgaatcaagaacagacagtaaacgcctttattatggacgctttattctgtctccacttatgaaaggccaagccgacacaataggcattgcgatgcgaagagctttacttggggaaatagaaggaacatgtatcacacgtgtaaaatctgagaaagtaccacatgaatattctaccataacgggcattcaagaatcggtacatgaaattttaatgaatttgaaagagattgtattgagaagtaatttatatggaacttctgaggcgtctatttgtgtcaagggtcctggatatgtaactgctcaagatatcatcttgccaccttatgtggaaatcgttgataatacacaacatatagctagtttaacggaaccaattgatttttgtattggattacaaatagagagaaatcgtggatatcttataaaaacgccacataactttcaagatggaagttatcctatagatgctgtattcatgcctgttcgaaacgcgaatcatagtattcattcttatgggaatgggaatgaaaaacaagagatactttttatcgaaatatggacaaacggaagtttaactccgaaagaagcacttcatgacgcatcccgaaatttaattgatttatttattccctttttacatatggaggaagacaacttatatttacaggacaatcaacacacggttcctttatccccttttacctttcatgataaattggctaaactcataaaaaacaaaaaaaaaatagcattgaaatcgatttttattgaccaatcagaattgtcttccaggatctataattgcctcaaaatgtccaatatatatacattattggaccttttgaataacagccaagaagatcttatgaaaattgaacattttcgtagcgaagatataaaacagatattggacattttagaaaaatatttcgtaattgatttagcaaaaaataagttttaaatctattggacttacttagtgaaaatagattgaaaaagcacaatttagcacaattaatatatcatatattagatatta

SEQ ID NO: 4749 - DNA, 1232 bp, Momordica charantia
agataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctccacaggatagacctcaacagaaaactgaagagtaacggcagcaagtgattgagttcagtagttcctcatataaaattattgactctagagatatagtaatatggagaagactaaattgtttcaagcaccgacagaaccagaagcgtcccttgtttcaaagagaggaggacgggttattcacatttcatttgatggtcagaggcaaattgaaagctaagcagtggtaattctaaggattcccgaggggaaaaatagagatgtctcctacgttacccgtaatatgtggaagtatcgacgtaatttcatagagtcattcggtctgaatgctacatgaagaacataagccagatgaaggaacgggaagacctaggatgtagaatatcataacatgagtgattcggcagatttggattcctatatatccactcatgtggtacttcattgtacgatatatataagatccatatgtatagatatcatcatctacatccagaaagccgtatgctttggaagaagcttgtacagtttgggaaggggttttgattgatcaaaaagaagaatctacttcaaccgatatgcccttaggcacggccatacataacatagaaatcacacttgggaaggggggacaattagctagagcagcaggtgctgtagcgaaactgattgcaaaagaggggaaatcggccacattaaaattaccttctggggaggtccgtttgatatccaaaaattgctcagcaacagtcggacaagtggggaatgctggggtaaaccagaaaagtttgggtagagccggatctaaatgttggctaggtaagcgtcctgtagtaagaggagtagttatgaaccctgtagaccatccccatgggggtggtgaagggagggccccaattggtagaaaaaacccgcaaccccttggggttatcctgcacttggaagaagaagtagaaaaaggaataaatatagtgataatttgattcttcgtcgccgtagtaaataagagagaaaatttaatttgtttcttcgtctttacaaaacaaaaaaaaaaataaggaggtaaattcactgtggcgcg

SEQ ID NO: 4750 - DNA, 3440 bp, Papaver somniferum
tacttccacatctgggtccctctttatcataaggttaacctcccaccaatgaacgacgagcacccatattcactttattattattaacattaacgacgagatttattatcgcttctcgcatgtccccggaaatttagagtaggtgcaaattctcccaatttgtgacccaccatacgatctgttatataaataggcagatggtcttttccattatgaatagcaattgtatggccgatcattgtgggtataatggtagatgcccgggaccaagttactattatttctttttctcctcttatgttgagcttttcaatttttcctaataaatgattagcaacaaaaggatttttttttagtgaacgtgtcacagctaattactcctatctttttttcttttgtaaagacgaagaaacatattctcgattttctctcctatttagtacgtcgacgaagaatcaaactatcactatatttattcctttttctacttcttcttccaagcgcaggataaccccaaggggttgtgggttgttttctaccaattggggcccttccttcaccacccccatggggatggtctacagggttcataactacccctcttactacaggacgcttacctagccaacgcttagatccggctctacccaaacttttctggttcaccccaacattacccacttgcccgactgttgctgagcagtttttggatatcaaacggacctccccagacggtaattttaatgtggccgatttaccctcttttgcaatcagtttcgctacagcacctgctgctctagctaattgtccaccctttccaagtgtgatttctatgttatgtatggccgtgcctaagggcatatcggttgaagtagattcttctttttgatcaatcaaaaccccttcccaaactgtacaagcttcttccaaagcatacggctttctggatgtatataatgatatctagacagatggatcttatatgaatcgtatgatgaagtaccacatgagtggatatataggaatccaaatctgccgaatcactcatgttatgatcttctacatcctaggtctccccgttccatcatctggcttatgttcttcatgtagcattcagaccgaatgactctatgaaattacgtcgatacttccacatattacgggtaacgtaggagacatctctatttttccccgggggtagaattaccactgcttagctttcaattcgcctctgaccatcaaatgaaatgtgaataacccgtcctcctctctttgaaacaaggggcgcttccggttctgtcggtgcttcaaacaattttgtcttctccatattaccatatctctagagtcaataattttatatgaggaactactgaactcaatcacttgctgccgttactcttcagttttctgttgaggtctatcccgtagaggtactcaaattggatcagtgattgatttctaggtttcgtcgtaaacctaattggttacttccaattacgtaaatcaatggttcaaaccgcactcaaaggtagggcatttcccattgagataggaacttctgtaccagaaacaatggtatctccaattatagcccctctgggatgtaaaatatatctcttctcaccatccccatagtgtatgagacaaatgtatgcatttcggttggggtcgtattctatggttacgattctaccagatatgtctttttcatttcgtcgaaaatctattttacggtatagacgcttatgacctccccctctatgccttgcggtaatgatgcctctggcattacgacctttaccacaatgacgctgctgtccagagatcaaattatttcgtgaattggatttcacttgactgtctacggccccattgcgtgtgctcggagtagaagttttgtataaatgtatcgccgtgttattaagtattttttttttaagttcttttctttctaagaggtggaatagaataacccggttgaagcgtaatgatcatacgtttgtaatgcattgtatgtcccataggtcccattcttctaccctttcccgggagtcgatgactattcatagctattaccttgacaccaaagaagagttcgacccaatgctttatttctgtcctagttgatcctgattcgacattagaagtatattgattgttccccaataaccgaatacttttgtctgtaaatactgcatatttgattccatccataaatccattttcttccctatgagttccagtattgataagaattctagttcttactgttcatatgttatggtatgaatataccataccaattcgttatgtatggatgatgagattccattgatacagagccaattccaatagacttattgaacgttcccattggcgtgcatccagcaggaattgaacctacgaatttgccaattatgagttgggcgctttaaccattcagccatggatgcttaacagggatcatcgtacatcgtgaataaccaaattccaattgaaatgaaatctttaggaggaatcaatgaaacaggaatcaatgaaacgacatcaattcaaatcctggatcttcgaattgagagagatattgagagagatcaagaattctcactatttcttagattcatggaccaaattcgattcagtgggatctttcactcacatttttttccaccaagaacgttttatgaaactctttgacccccgaatttggagtatcctcctttcacgcgattcacagggttcaacaagcaatcgatatttcacgatcaaaggtgtagtactgcttgtagtagcggtccttatatatcgtattaacaatcgaaatatggtcgaaagaaaaaatctctatttgatggggcttcttcctatacctatgaattccattggacccagaaatgatacatcggaagaatctttttggtcttccaatattaataggttgattgtttcgctcctctatcttccaaaagggaaaaatatctctgagagttgtttcatggatccgaaagagagtacttgggttctcccaataacgaaaaagtgtataatgcctgactctaactggggttcgcggtggtggaggaaccggatcggaaaaaggtggaattctagttgtaagatatctaaggaaaccgtagctggaattgagatctcatttaaagagaaagatatcaaaatatctggagtttcttttttgtatcctatacggatgattcgatccgcaaggaccatgattgggaattgtttgatcgtctttctctgagaaagaagcgaaacataatcaacttgaattcgggacagctattcgaaatcttagtgaaacactggatttgttatctcatgtctgcttttcgtgaaaaaagaccaattgaagtggagggtttcttcaaacaacaaggagctgagtcaactattcaatcaaatgagattgaacatgt

SEQ ID NO: 4751 - DNA, 7923 bp, Euphorbia peplus
atattcatatcataacatatgaacagtaagaactagcattcttattgagactagaattcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagccatcgactcccgggaaagggtagaagaatgagacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatacacgaaataatttgatctatggacagcatcattgtggtaaaggccgtaatgccagaggaataattaccgcaaggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattatttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatagaaaattattgactctagagatatagtaatatggagaagacaaaattgtttcaagcaccgacagaaccagaagtgccccttgtttcaaagagaggaggacgggttattcacatttcatttgatggtcagaggcgaattgaaagctaagcagtggtaattctaaagattccctggggaaaaatagaaatgtctcctacgttacccctaatatgtggaagtatcgacgtaatttcatagagtcattcggtctgaatgctacatgaagaacataagccagatgaaggaacgggaagacctaggatgtagaagagcataacatgagtgattcagcagatttggattcctatatacccactcatggaataatttcattttacgatatataagatccatctgtatagatatcatcatctacacccagaaagccgtatgctttggaagaagcttgtacagtttgggaagaggttttgattgatcaaaaagaagaatctacttcaaccgatatgcccttaggcacggccatacataacatagaaatcacacttggaaagggtggacaattagctagagctgcaggtgctgtagcgaaactgattgcaaaagagggtaaatcggccacattaaaattaccttctggggaggttcgtttaatatccaaaaactgctcagcaacagtcggacaagtagggaatactggggtgaaccagaaaagtttgggtagagccgggtctaaatgttggctaggtaagcgtcctgtagtaagaggagtggttatgaaccctgtagaccatccccatgggggtggtgaagggagggccccaattggtagaaaaaacccgcaaccccttggggttatcctgcacttggaagaagaagtagaaaaaggaataaatatagtgataatttgattcttcgtcgccgtagtaaataggagaaaaaatcgaatttgtttcttcgtaacaaaaaaaataggagaaattaactgtgacacgttcactaaaaaaaaatccttttgtagcaaatcatttattaaaaaaaataaataagcttaacacaaaagcagaaaaagaaataatagtaacgtggtcccgggcatctaccattatacctacaatgatcggccatactattgctatccataatggaaaggagcatttacctatttatataacagatcgtatggtgggccataaattgggcgaatttgcacctactttaaatttccggggacatgcaaaaaatgataataaatcccgccgttaaaagaacaaatcaaatagaaatatttatcattcattaaaaagaggtgaatcttatgataaataaaaaaatagacccatacacagaagtatatactttaggacaacatatacgtatgtccgctcacaaagcacgaagaataattgatcaaattcgtggacgttcttacgaagaaacacttatgatactagaactaatgccttatcgagcatcttatcccattttaaaattgatttcttctgcagcagcaaatgctagtcacaatatggctttcaacgaaaccgatttaataattagtaaagccgaggttaaccacggtactactgtgaaaaaattaaaacctcaggctagaggacggggttatctaataaaaaaatccacttgtcatataactattgtattaaaaaatatatccttataattataattaaagaatatgaagatccttatcgttaacgaatatgaagaatctcgcatattcttttaaaaccgggactggataaaaaaacaaaatttacagatatgatatttgacaatatgtatagttaagtagtgggggattatgggacaaaaataaataccacttggtttcagacttggtacaacccaaagtcatcactctctttggtttgcacaaccaaaaaattactctgagggtctacaagaagatcaaaaaataagaaactgtatcaagaattttgtaaaaaaaaatacaaaaatatcttctggcgttgagggaattgcacgtatagagattcaaaaacgaatcgatgtgattcaagtcataatatatatgggattcccaaaattattaatagaaaatagacctaaacgaatcgaagaattacagatacatgtacaaaaagaactaaattttgtaaaccgaaaactcaatattgttatcacaagaattgcaaatccttatagcaaccctaatattcttgcagaatttatagctggacaattaaagaatagagtttcttttcgtaaagcaatgaaaaaagctattgaattaactgaacaggcggatacaaaaggaattcaagtccaaattgcgggacgtcttgatggaaaagaaattgcacgagtcgaatggattagagagggtagggttcctctacaaaccattcgagctaaaattgattattgttcgtatacagttagaactatttatggggtattaggcataaaaatttggacatttctagacaaaaaataataagcccttaattgacgtgtcttttgattctatccattgatagaagaaaacaaaaaatgacaaactctttcatttttttgtttaatcaaacaaaagaatgaattagaattctattaactattatattaatttaataattttgaatttcactagaataattaattgaatattaataattttttaataatttaactatatacgtctatttctaattcttcgaattctatttctataaggttgaataaaataataaaataataaaattgattgatataattgctatgcttagtcccaaaagaacccgattccgtaaacaacatagaggaagaatgaaaggaatatcttttcgaggcaatcgtatttgttttggaagatatgctcttcaagcacttgaacccgcttggattacatctagacaaatagaagcggggcgacgagcaatgacacgaaatgcacgccgtggtggaaaaatatgggtacgtatatttcccgacaaacccgttactttaagacctacggaaacacgtatgggttcggggaaagggtctcctgaatattgggtagctgtcgttaaaccgggtagaatactttatgaaatgggcggagtggcagaaaatatagcgagaaagtctatttcaatagcagcatccaaaatgcctatacgaactcaattccttatttcaaaataagaatctagaaccaaaggaaaaagacccttttgatactaaaaaaaaagcgcaagtttcttttttgttttggacaaacaatatatcttttttgttcctttgcatttaaataacagataaaaaaaaaacgatatgatccaatctcagacccatttgaatgtagcagataacagtggagcccgagaattgatgtgtattcgaatcatagggactagtaatcgccgatatgctcatatcggtgacgttattgttgctgtgatcaaggaagcagcacccaattcacctctagaaagatccgaagtaatcagagctgtaattgtacgtacttgtaaagaacttaaacgtaataacggtataataatacgatatgatgacaatgctgcagttgtcattgatcaagaaggaaatccaaaaaggaacacgaatttttggtgcaattgcccgggaattgagacagtttaaattttactaaaatagtttcattagcacctgaggtcttatagaataaaaattagaagatataagatcgcaaatttgagattaagaagagaccatgatacagttatagtatttagtattctagttatagtatttgaattaattgaataaaaaacaaaaaaaattatttgtgtttcatgcatataccttataattaaataataataaaatgaaaattgagagattaataaataaaaagattaaaaaaaaaaacaaagagtatgttgattatatcaaaactagataaaaaaaattagtagtttatcatggtagggatcctattgctgacataataacctctatacgaaatagctgacatgaatcgaaaaggaaccgttcaaatagcagctactaacatcaccgaaaacattataaaattactcttacgagagggttttattgaaaatgtcaggaaacatcaggaaggcaacaaaaaatttttggttttaactctacgccatagaaggaaaaacaaaggaccatatagaactagtctaaattttaaaacggataagccggccgggtctacgaatctattctaactatcaaaaaaattcctagaattttgggcgggatgggcattgtaattctttctacttctcggggtatactgacagaccgggaagctcgactcgaaagaatcggcggagaaatcttgtgttatatatggtaatctttttgctatccgaagtcgatccagacttcttatttcttaaaaaaaaaaaaaaagcaaggaataggtttctaataacattcctcttacattagttaatacttcacgaggatttgcaatggaatgaaagatcaaaagtggcctcaggaaagtttaattactgaagcactttttcaatttcaataatatgttgcaagttcctttagataatcaagatctgtttttaggttatcttttagccgaggctagttttttttttttcaactttcaaattccttttgcctttcgtaggaatataattgaagatttcaaaattgaaagaaacttagtttcgtcaaaaaaaatagatatattcaaaaattaagggatggcaaatatgaaaataagagcttctgttcgtaaaatttgtgaaaaatgccgactgatacgtagacgaggacgaattatagtaatttgcttcaacccaagacataaacaaagacaaggataatctttctaagcaagaacactctaaaggatccgagaaaaaaaaaaaggatccgttttgacataaaatggatatatccatagacccctgacttatatttatgagatgctaaaatatggcaaaacctttaccacgaattggttcacgcagaactggacgcattggttcacgtaagaatgcacgtaaaataccaaaaggagttattcatgttcaagcaagtttcaacaatactattgtgaccgttacagatgtacggggacgagtaatttcgtggtcctccgctggaacttgtggattcaaaggcacaagaagaggaacaccatttgctgctcaaaccacagcaggaaatgctattcgaacagtagtggatcaaggcatgcaacgagcagaagtcatgataaaaggtccgggtctcggacgcgatgcggcattaagagctattcgcagaagtggtatactattaactttcgtccgggatgtaacccctatgccacataatggctgcagacccccgaaaaaaaggcgcgtgtaaaaagaaatagtgaagagatttcaagagaaataaataattcaatcaattcacaataagaatattattatggttcgagagaaagtaacaatatctactcggacactgcagtggaaatgtgttgaatcaagaaaggacaataagcgtctttattacggacgctttattctatctccgcttatgaaaggccaatccgatacgataggcattgcgattcgaagagctttacttggagaaatagaaggaacctgtatcacacgtgcaaaatttgagaaaatatcacacgaattttctactataacaggtattcaagaatcaatacatgaaattttaatgaatttgaaagaaattatattgagaagcaatttgtatggaacttgtgacgcgtctatttgtgtcaagggtcctggatatgtaactgctcaagacatcattctaccaccttttgtggaaatcattgataatacacagcatatcgctagcttaacagaaccaattgatttgtgtattcgattacaaatcgagaggaatcgtggctatcgtataaaaccaacaaaaacctttcaagacggaagttttcctctagatgctgtattcatgccagttcgaaatgcaaatcatagtgttcattcttatggaaatgggaatgaaaagcaagagatgctttttctcgaaatatggacaaacggaagtttaactcctaaagaagcacttcatgaggcttcccgtaatttgattgatttatttattccttttctacatgcagacgaacaaaacttacctttagaaaaaaatcaacacaacgttactttacccctttttatttttcatgatagattgactaaattaataaaaaaaaaaagaataccattgaaatacatttttattgaccaattcgaattgactcctaagatctataattgcctcaaaaggtctaatatacatacattatcggaccttttgaataagagtcaagaagatcttatacaaattgaagattttcacatagacgatgtaaaacatatattgggtattttagaaataaaaaaaaatttcgtaatggagtgactaaagaataaaatcgaaatccattggatttcgattcattttggtcttctttagaaacaaaaaaagataaaaattttgaatctttagcacaatccatagatttgcaaaatatatccaaatttaaattgaatagatgttatctagggagaattcactttgaagtgactattccctagatatacacgtgatgatattttatttttcaattaaatcaacttaaaaaagacctaaagttagagatttctcaataggtaatgttgctccaatacctaaccaaacgggctactacagtaccaatcaaaaatacggttgtcgcaactggacgacgaaatggatttggaatttattaacattctctaaaaaaggtactgttaataagcctgtaggtactgaaaccattaaaagacacccaataacttattgggtactgtacggagtatttgaaatcaggaaagaaataccggattcaggcaatatttccaaaggagttgcaaatggatccgcacggttcaccaatcattgatggtttctagaaccgcctaatcctaccattacatggcaatagtac

SEQ ID NO: 4752 - DNA, 1411 bp, Capsicum annuum
gcacgggaattctaaagatctccccgggggaaaaatagagatgtctcctacgttacccataatatgtggaagtatcgacgtaatttcatagagtcattcggtctgaatgctacatgaagaacataagccagatgacggaacgggaagacccaggatgtagaagatcataacatgagtgattcggcagatttggattcatatatatatccacccatgtggtacttcattctacgatatatataagatccatatgtatagatatcatcatctacatccagaaagccgtatgctttggaagaagcttgtacagtttgggaaggggttttgattgatcaaaagaagaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttggatagagccggatctaagcgttggctaggtaagcgtcctgtagtaagaggagtagttatgaaccctgtagaccatccccatgggggtggggaagggagagccccaattggtagaaaaaaacccacaacccctgggggttatcctgcacttggaagaagaagtagaaaaaggaataaatatagtgataatttgattcttcgtcgccgtagtaaataggagagaaaatcgaatttaattctttgtttttacaaaaactttacaaaaaaaaaaaaaaaaataggagtaagcttgtgacacgttcactaaaaaaaatccctttgtagccaatcatttattaaaaaaaattgataagcttaacacaaaagcagaaaaagagataatagtaacttggtcccgggcatctaccattatacccacaatgatcggtcatactattgctatccataatggaaaagagcatttgcctatttatataacggatagtatggtaggccacaaattgggagaatttgcacctacattaaattttagaggacatgcaaaaagcgataatagatctcgtcgttaacgttaatattaataaaaaaatctagatgcttatgattcagtagtaggaggaaaaccttatgctaaagaagaaaaaaacggaagtatatgctttaggtcaacatatatctatgtctgctgacaaagcacgaagagtaattgatcaaatccgcggacgttcctatgaggaaacgcttatgatactagaactcatgccctatcgagcatgttatcccattttgaaattggtttattctgcagcagcaaatgctagttacaatatggggttccag

SEQ ID NO: 4753 - DNA, 3474 bp, Tabernaemontana elegans
gcgcccaactcataattggcgaattcgtaggttcaattcctactggatgcacgccaatgggaccctccaataagtctattggaattggctctgtatcaatggaatctcatcatccatacataacgaattggtgtggtatattcatatcataatatatgaacagtaagaactagcattcttattgagactagaactcatagggaagaaaatagatttatggatggaatcaaatatgcagtatttacagacaaaagtattcggttattggggaaaaatcaatatacttttaatgtcgaatcgggatcaactaggacagaaataaagcattgggtcgaactcttctttggtgtcaaggtaatagctatgaatagtcatcgacttccgggaaagggtagaagaatgggacctattatgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggaaccgtagacagtcaagtgaaatccaatccacgaaataatttgatctatggacagcatcgttgtggtaaaggtcgtaatgccagaggaatcattaccgcagggcatagagggggaggtcataagcgtctataccgtaaaatcgattttcgacggaatgaaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactattgatttacgtaattggaagtaaccaattaggtttacgacgaaacctagaaatcgatcactgatccaatttgagtacctctacaggatagacctcaacagaaaactgaagagtaacggcagcaagtgattgagttcagtagttcctcatataaaattattgactctagagatatagtaatatggagaagacaaaattgtttcaagcaccgacagaaccggaagcgccccttctttcaaagagaggaggacgggttattcacatttcatttgatggtcagaggcgaattgaaagctaagcagtggtaattctaaagattcccgggggaaaaatagagatgtctcctacgttactcataatatgtggaagtatcgacgtaatttcatagagtcattcggtctgaatgctacatgaagaacataagccagatgacggaacgggaagacctaggatgtagaagatcataacatgaggcattcggttggattcacccatgggtcattgtacgatataagatccatctgtatagatatcatcatctacatccagaaagccgtatgctttgtaagaagcttgtacagtttgggaaggggttttgattgatcaaaaagaagaatctacttcaaccgatatgcccttaggcacggccatacataacatagaaatcacacttggaaagggtggacaattagctagagcagcgggtgctgtagcgaaactgattgcaaaagaggggaaatcggccacattaaaattaccttctggggaggtccgtttgatatccaaaaactgctcagcaacagtcggacaagtggggaatgttggggtgaaccagaaaagtttgggtagagccggatctaagcgttggctaggtaagcgtcctgtagtaagaggagtagttatgaaccctgtagaccatccccatgggggtggtgaagggagagccccaattggtagaaaaaaacccacaaccccttggggttatcctgcacttggaagaagaagtagaaaaaggaataaatatagtgataatttgattcttcgtcgccgtagtaaataggaaagaaaatcgaattttttcttcgtctttacaaaacaaaaagaaaaaaaaaataggagtaagctgtgacacgttcactaaaaaaaaatccttttgtagccaaccatttattacaaaaaattgataaacttaacacaaaagaagaaaaagaaataatcgtaacttggtcccgagcatctaccattatacccacaatgatcgggcataccattgctatccataatggaaaagagcatctgcctatttatataacagatcgtatggtcggccacaaattgggagaatttgcacctacattaaatttccgaggacatgcaaaaagcgataatagatctcgtcgttaatttttaatttaataaatattaaaagaattatgcttatgatgatttagtagtaggaggtaccttatgctaaaaagaaaaagacagaaaaaaaacagaagtatatactttaggtcaacatatctctatgtccgctgacaaagcacgaagagtaattgaccaaattcgcggacattcctatgaagaaacacttatgatactcgaacttatgccctatcgagcatgttatcccatttttaaattggtttattctgcagcagcaaatgctagttacattatgacttctaacgaaaccaatttagtcattagtaaggccgaagtgaacaggggtactaccatcaagaaattcaaacccagagctcggggacgtagttatccaataaaaaaacctacctgtcatataactattgtaatgaaagatatatctttagatgataaatatgtagagatggattcgttaaaaaaacctaggtggaaaaacaagcatacagctgtggcgtatcgtgatatgtatagtagtgggggtgagggaatatgggacaaaaaataaatccacttggtttcagacttggtacaacccagggtcatcattctatttggtttgcacaaccaaaaaattattttgagtatttacaagaagatcaaaaaataagagattgtatcaagaattatgtacaaaagaatatgaaaatatcttctgcggtagagggaattgcacgtatagagattcaaaaaagaatcgatctgatccaggtcataatctttatgggattccccaaattcttactagaaagtcggccgcggggagtcgaagaattacagatgactctacaaaaagagtttaattggatcaaccaaaaacttaacattgctatcaaaagaattgcaaaaccttatgggaaccctaatattcttgcagaatttatagccggacaattaaagaatagagtttcatttcgaaaagcaatgaaaaaagctattgaattaactgaacaagcagatacaaaaggaattcaagtacaaattgcgggtcgtattgacggaaaagaaattgcacgtgtcgaatggattcgggagggtagggttcctctacaaaccattcgagctaaaattgattattgttcctatacagttcgaactatctatggtgta

SEQ ID NO: 4754 - DNA, 1667 bp, Brassica rapa
ttatacaaaacttctaccccgagcacacgcaatggagccgtagacagtcaagtgaaatccaatccacgaaataatttgatctatgggcagcatcattgtggtaaaggtcgtaatgccagaggaatcattaccgtaaggcatagagggggaggtcataagcgtctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactatttgatttacgtaattggaagtaaccaattaggtttacgacaaaacctagaaatcgatcactgatccaatttgagtacctctgcaggatagacctcaacagaaaactgaagagtaacggcagcaagtgattgagttcagtagttcctcatataaaattattgactctagagatatagtaatatggagaagacaaaattgtttcaagcaccgacagaaccataagcgccccttgtttcaaagagaggaggacgggttattcacatttcatttgatggtcagaggcgaattgaaagctaagcagtggtaattctaaagattcccccggggaaaaatagagatgtctcctacgttacccataatatgtggaagtatcgacgtaatttcatagagtcattcggtctgaatgctacatgaagaacataagccagatgacggaacgggaagacctaggatgtagaagatcataacataagttattcggcagattttgattcctatatatccactcgtgtggtacttctaccatatatagaagaattctacgatatatataagataagatccatccgtatagatatcatcatctacattcagaaagccgtatgctttggaagaagcttgtacagtttgggaaggggttttgattgatcaaaaagaagaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaaacccgtaaccccctggggttatcctgcgcttggaagaagaactagaaaaaggaaaaaatatagtgagactttgattcttcgtcgccgtagtaaataggagagaaaatcgaatttctttcttcgtcttaaaaaaaataggagttaattaactgtgacacgttcactaaaaaaaaatccttttgtagcaaagcatttattaagaaaaatagagaagcttaatacaaaggcggaaaaagaaatcataataacttggtcccgggcatc

SEQ ID NO: 4755 - DNA, 8426 bp, Brassica rapa
gtatcaatggaatcttctcatcatctatacataacgaattggtgtggtatattcatatcataacataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatgggcagcatcattgtggtaaaggtcgtaatgccagaggaatcattaccgtaaggcatagagggggaggtcataagcgtctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactatttgatttacgtaattggaagtaaccaattaggtttacgacaaaacctagaaatcgatcactgatccaatttgagtacctctgcaggatagacctcaacagaaaactgaagagtaacggcagcaagtgattgagttcagtagttcctcatataaaattattgactctagagatatagtaatatggagaagacaaaattgtttcaagcaccgacagaaccataagcgccccttgtttcaaagagaggaggacgggttattcacatttcatttgatggtcagaggcgaattgaaagctaagcagtggtaattctaaagattcccccggggaaaaatagagatgtctcctacgttacccataatatgtggaagtatcgacgtaatttcatagagtcattcggtctgaatgctacatgaagaacataagccagatgacggaacgggaagacctaggatgtagaagatcataacataagttattcggcagattttgattcctatatatccactcgtgtggtacttctaccatatatagaagaattctacgatatatataagataagatccatccgtatagatatcatcatctacattcagaaagccgtatgctttggaagaagcttgtacagtttgggaaggggttttgattgatcaaaaagaagaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaaacccgtaaccccctggggttatcctgcgcttggaagaagaactagaaaaaggaaaaaatatagtgagactttgattcttcgtcgccgtagtaaataggagagaaaatcgaatttctttcttcgtcttaaaaaaaataggagttaattaactgtgacacgttcactaaaaaaaaatccttttgtagcaaagcatttattaagaaaaatagagaagcttaatacaaaggcggaaaaagaaatcataataacttggtcccgggcatctactattatacccacaatgattggccatactatcgctatacataatggaagggaacacttacccgtttatataatcgaccttatggtaggacataaattgggagaattttcacctactataaattttagaggacacgcgaaaaatgataatagatctcgtcgttaattaaatgaattcaaaaaaatgaataatgaatataatttttttttttagtgagaggtaaaccttatgataaagaagaaaaagaagaaatcatatacttccgtatatgctttagggcaatatatatctatgtctgcccacaaagcacggagagttattgatcagatccgtggacgttcctacgaagaagcacttatgatattagaacttatgccgtatcgaggatgttatcccatttttaaattagtttattctgcagcagcaaatgctagtcacaataagggtttcaaagaaaccaatttagtcattagtaaagctgaagtgaatcaaggaaatacggtgaaaaaattaaaacctcgggcacgaggacggagttacccaataaaaagatccacttgtcatataactatcgtattggaagatatatccttatatcaacaatatgaagaatatttaatgtatttaaaaaaacctggatgcagcaatgaaaacataaatctaacatgttacgatacatatagtagtggaggcccatgggacaaaaaataaatccacttggtttcagacttggtacaacccaaagtcatcattctatttggtttgcacaaccaaaaaagtattctgaaggtttagaagaagataaaaaaatacgagactgtattaaaaattatgtccaaaaaaatataagaatatcctctggtatggagggaattgcacgtatcgaaattcaaaaaagaatcgatctcattcagatcataatctatatgggatttcctaaattattaattgaagataaaccccgaagaatcgaagaattacagatgaatgttcaaaaagaacttaattgtgtcaatagaaaactcaacattgctattacccgaatttccaatccgtatgggcatcctaatattcttgcagaatttatagctggccaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggttttaggaataaaaatttggatattcgtagacgaagaataaaaaaactttatttgtctttacattttatccaatgataaaaaacgaaaactatgtagtataacactataaagaaataaaaataaaaacttgtagtctttttttttatgtttaagaaaaaaaaatgagcaattctataaggttgaataaacatttccatcaaaactcctttgatataattgctatgcttagtgtgtgactcgttggtttagggttagattacgataaaaaaaaaaagaacttaccaactaataactacagcattaataaataacctaagcaactcattgcttcgcattatctggatccaaaaaattagtcaagatatgataggctgatcatatcattggagcaactgactaaaaaaaaagaataaagaaagatgattattaagttatgaaaggtaatcaaaaagtatgcggataaatggaaggatgaaagaaagagcgaaaaaattgaatattaatgatatatgattccaatttggaaaatctatgaggtcactgtaagaaaagcaatgtaataaagcatcaatacagattcattcataataattagataaatctgttccgaaaacaaaaaattaagagccttgagccaataaaaactgagaaaattgcctcaaaaaaaaaaaaagaaattcaaaatttcatgtaaaagctccattgtagaattcaggcctaatgattaatcaagaagcgatgggaacgacggaacccatgaatatataggattctagtgaacaagaaatcttagtaattcattggacaggatggcggaataaaccagaaactttattatctattctgatttctgattttgattctgagacctcgggggataaacagcaaacttaaatagatattgaaagagtaaatattcgccggcgaaaaattggtttttttttcaaataaaaacagtaataaaagatgaaaaaaacaatgaaaaaaataaaataaggatttgttataatattctaactctaataaaaattacatttgtaatgatgatattacgttatttttaaataaatcgaaataaaattgatctttgattctatttcaaaaaagacatacacaaatttagaagagataagatgaaataaaaaaaaaataccatgattaataggattaatcattaactacatctatatcttaattaatccttttattcgcgaggagctggatgagaagaaactctcacgtccagttctgcagtagagatggaatttctcatttagaaaaaacccatcaactataacccaaaaagaaccaaatttcgtaaacaacatcgaggaagactaaaaggaatatcctctcgtgggaatcgtatttgttttggcagatatgctcttcaaacacttgaacccgcttggattacatctagacaaatagaagcagggcgacgagcaatgacacgaaatatacgacgtggtggaaaaatttgggtacgtatatttccagacaagccagttacagtaagacccgcggaaacgcgtatgggttctgggaaaggatccccagagtactgggtagctgtggttaaaccaggtaaaatcctttatgaaatgggtggtgtaccagaaaatatagccagaaaagctatttcaatcgcggcatcaaaaatgcctataaaaacccaattcattatttctgaataggaatatagaatgaaaaagctaaataacatttaaggataaaaagattataagtttttttttgacaaacaatattttttttacttcgtcctttgcactaaaagaagagatacaaaaatatgattcaaccacaaacctatttgaatgtagcagacaacagcggggctagaaaattgatgtgtattcgaataataggagctagtaatcgccgctatgctcatattggtgacgttattgttgctgtaatcaaggaagcaatcccaaatactactctagaaagatcagaagtggtcagagctgtaattgtacgtacttgtaaagaactcaaacgtaagaatgggacgataatacgatatgacgacaatgccgcagttgtcattgatcaagaaggaaatccaaaaggaactcgcgtttttggggcgatcccacgggaattgagacaattaaactttactaaaatagtttcattagctcctgaagtattataagacctaaatatcgatagttaatataggataggattaaaaaaatggtattgaaatcaaattaattataattaatagattgtgtatcacgcatatacccttaataattttatatattaataattgaattcatatattaatatataattcgtctctatttttatataaataaaagaaaaataacatgttgattatatcaaaattatagaacaattaaggaattttaacttatcatggggaaagacactattgctgatataataacctctatacgaaatgctgacatgaatagaaaaggaacagttcggataggatcgactaacatcaccgaaagcattgttaaaatacttttacaagagggttttatcgaaaacgtaaggaaacatcgcgaaaacaatcaatattttttgattttaaccctaagacatagacgaaataagaaagaatcctataaaacgattttaaatttaaagagaataagccgaccgggtctacgaatctattctaactctcaacgaattccacgaattttaggcggaataggaattgtaatcctttcaacttctcaaggtataatgacagatcgagaagctcgactaaaaagaatcggcggagaaattttgtgttatatatggtaatccttctaatatcaaaattggatatccggaacttagcatttgtgaaaaaaaagggggggggttgtgtaataccacccctgctaaaaaagtttagaattttttaccccgaatgaaattaaagaaaaaaatgaattaatgaaagttttctttatgaatcacttccgaacggtatggttcgattttgtttagatactaaagattttttttattttaggtcatgcttctgaaaggattcgacatatttttgtataggtatacctataggagaaaaaggggtaaaaattttagtaagttcttaggtattaagttaatcggggaacagccactttctagactccataacaaggattcaaataagtcagtggttttttgaaattcaacattcctttcacgaagatacaattcaagattcaaaaatatcaagaaacctttttttcgtccaacaataagtatattaagagaattaaggaataacaactatgaaaataagggcttccgttcgtaaaatttgtgaaaagtgtcggctaatccgtaggaggggacgaattatagtaatttgttccaacccgaggcataaacaaagacaaggataatcttactaaaggaaaaggcacttccaaggagctagtaaaaaaaaggtccgttttgacatgaaatggatatatccatatatttcttgtgaaatgaaaaaatatggcaaaacctatattaagaattggttcacgtaaaaatacccgtagtggttcacgtaaaaatgtacgtagaataccaaagggagttattcatgttcaagcaagtttcaacaataccattgtgaccgttacagatgtacggggtcgggtgatttcttggtcctccgcgggtacttgtggattcaggggtacaagaagaggaacaccttttgctgctcaaaccgcagcaggaaatgctattcgagcagtagtggatcaaggtatgcaacgagctgaagtaaggataaaaggccctggactaggaagagatgcagcattacgagctattcgtagaagcggtatacttttaagtttcgtacgagatgtaacccctatgccacataatggttgtagaccccctaaaaaacgacgtgtatagaactaaataaaggctgaaagggtttcaagagaaataaatgattcaatgatctgatcaaataaaattactatggttcgagagaaagtcaaagtatctactcggacactacagtggaagtgtgttgaatcaagaagagacagtaagcgtctttattatggacgctttattctgtctccacttatgaaaggtcaagccgacacaataggcattgcgatgcgaagagctttacttggcgaaatagaaggaacatgtattacacgtgcaaaatctgagaacataccacatgactattctaacatagtcggtattcaagaatcagtacatgaaattttaatgaatttgaacgagattgtattaaaaagtaatctatatggaacgcgcaacgcgcttatttgtgtccaaggtcccggatatataactgctcgagacatagttttaccgccctctgtggaaatcgttgataatacacagcatatagctaccttaacggaaccaataaatttgtgtattggattaaaaatcgagaggaatcgcggatatagtttaaaaatgtcaaataactttgaagaccgaagttatcctatagatgctgtattcatgcctgttcaaaatgcgaatcatagtattcattcttatgggaatgggaatgaaaaacaagagattctttttctagaaatatggacaaatggaagtttaactcctaaagaagcacttcatgaagcctcccggaatttgattaatttatttattccttttctacatgtagaagaagaaacgttctatttagagaacaatcaacatcaagttactttacccctttttccttttcataatagattagttaacctaagaaaaaaaaaaaaagaactagcgtttcaatatatttttattgaccaattagaattgcctcccagaatctataattgtctcaaaaagtccaatatacatacattattggatcttttgaataacagtcaagaagaccttatcaaaatggaacattttcacatagaagatgtaaaaaagatattagacattttagaaaaaaaataaaaaaagcattaaaaaaaatttg

SEQ ID NO: 4756 - DNA, 2957 bp, Brassica juncea
gatccatccgtatagatatcatcatctacattcagaaagccgtatgctttggaagaagcttgtacagtttgggaaggggttttgattgatcaaaaagaagaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaaacccgtaaccccctggggttatcctgcgcttggaagaagaactagaaaaaggaaaaaatatagtgagactttgattcttcgtcgccgtagtaaataggagagaaaatcgaatttctttcttcgtcttaaaaaaaataggagttaattaactgtgacacgttcactaaaaaaaaatccttttgtagcaaagcatttattaagaaaaatagagaagcttaatacaaaggcggaaaaagaaatcataataacttggtcccgggcatctactattatacccacaatgattggccatactatcgctatacataatggaagggaacacttacccgtttatataatcgaccttatggtaggacataaattgggagaattttcacctactataaattttagaggacacgcgaaaaatgataatagatctcgtcgttaattaaatgaattcaaaaaaatgaataatgaatataatttttttttttagtgagaggtaaaccttatgataaagaagaaaaagaagaaatcatatacttccgtatatgctttagggcaatatatatctatgtctgcccacaaagcacggagagttattgatcagatccgtggacgttcctacgaagaagcacttatgatattagaacttatgccgtatcgaggatgttatcccatttttaaattagtttattctgcagcagcaaatgctagtcacaataagggtttcaaagaaaccaatttagtcattagtaaagctgaagtgaatcaaggaaatacggtgaaaaaattaaaacctcgggcacgaggacggagttacccaataaaaagatccacttgtcatataactatcgtattggaagatatatccttatatcaacaatatgaagaatatttaatgtatttaaaaaaacctggatgaaaacataaatctaacatgttacgatacatatagtagtggaggcccatgggacaaaaaataaatccacttggtttcagacttggtacaacccaaagtcatcattctatttggtttgcacaaccaaaaaagtattctgaaggtttagaagaagataaaaaaatacgagactgtattaaaaattatgtccaaaaaaatataagaatatcctctggtatggagggaattgcacgtatcgaaattcaaaaaagaatcgatctcattcagatcataatctatatgggatttcctaaattattaattgaagataaaccccgaagaatcgaagaattacagatgaatgttcaaaaagaacttaattgtgtcaatagaaaactcaacattgctattacccgaatttccaatccgtatgggcatcctaatattcttgcagaatttatagctggccaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggttttaggaataaaaatttggatattcgtagacgaagaataaaaaaactttatttgtctttacattttatccaacgataaaaaacgaaaactatgtagtataacactataaactaataaaaataaaaaattgcagtcttcgtttttatgtttaagaaaaaaaatcagcaattctataaggttgaataaacatttccatcaaaactcctttgatataattgctatgcttagtgtgtgactcgttggtttagggttagattacgatattaataaataacctaagcaactcattgcttcgcattatctggatccaaaaaattagtcaagatatgataggctgatcatatcattggagcaactgacttaaaaaaaaaagaataaagaaagatgattattaagttatgaaaggtaatcaaaaagtatgcggataaatggaaggatgaaagaaagagcgaaaaaattgaatattaatgatatatgattccaatttggaaaatctatgaggtcactgtaagaaaagcaatgtaataaagcatcaatacagattcattcataataattagataaatctgttccgaaaacaaaaaattaagagccttgagccaataaaaactgagaaaattgcctcaaaaaaaaaaaagaaattcaaaatttcatgtaaaagctccattgtagaattcaggcctaatgattaatcaagaagcacgacggaacccatgaatatataggattctagtgaacaagaaatcttagtaattcattggacaggatggcggaataaaccagaaactttattatctattctgatttctgattttgattctgagacctcgggggataaacagcaaacttaaatagatattgaaagagtaaatattcgccggcgaaaaattggttttttttttcaaataaaaacagtaataaaagatgaaaaaaacaatg

SEQ ID NO: 4757 - DNA, 8330 bp, Brassica oleracea
aacataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggattaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatgggcagcatcattgtggtaaaggtcgtaatgccagaggaatcattaccgtaaggcatagagggggaggtcataagcgtctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactatttgatttacgtaattggaagtaaccaattaggtttacgacaaaacctagaaatcgatcactgatccaatttgagtacctctgcaggatagacctcaacagaaaactgaagagtaacggcagcaagtgattgagttcagtagttcctcatataaaattattgactctagagatatagtaatatggagaagacaaaattgtttcaagcaccgacagaaccataagcgccccttgtttcaaagagaggaggacgggttattcacatttcatttgatggtcagaggcgaattgaaagctaagcagtggtaattctaaagattcccccggggaaaaatagagatgtctcctacgttacccataatatgtggaagtatcgacgtaatttcatagagtcattcggtctgaatgctacatgaagaacataagccagatgacggaacgggaagacctaggatgtagaagatcataacataagttattcggcagattttgattcctatatatccactcgtgtggtacttctaccatatatagaagaattctacgatatatataagataagatccatccgtatagatatcatcatctacattcagaaagccgtatgctttggaagaagcttgtacagtttgggaaggggttttgattgatcaaaaagaagaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaaacccgtaaccccctggggttatcctgcgcttggaagaagaactagaaaaaggaaaaaatatagtgagactttgattcttcgtcgccgtagtaaataggagagaaaatcgaatttctttcttcgtcttaaaaaaaataggagttaattaactgtgacacgttcactaaaaaaaaatccttttgtagcaaagcatttattaagaaaaatagagaagcttaatacaaaggcggaaaaagaaatcataataacttggtcccgggcatctactattatacccacaatgattggccatactatcgctatacataatggaagggaacacttacccgtttatataatcgaccttatggtaggacataaattgggagaattttcacctactataaattttagaggacacgcgaaaaatgataatagatctcgtcgttaattaaatgaattcaaaaaaatgaataatgaatataatttttttttttagtgagaggtaaaccttatgataaagaagaaaaagaagaaatcatatacttccgtatatgctttagggcaatatatatctatgtctgcccacaaagcacggagagttattgatcagatccgtggacgttcctacgaagaagcacttatgatattagaacttatgccgtatcgaggatgttatcccatttttaaattagtttattctgcagcagcaaatgctagtcacaataagggtttcaaagaaaccaatttagtcattagtaaagctgaagtgaatcaaggaaatacggtgaaaaaattaaaacctcgggcacgaggacggagttacccaataaaaagatccacttgtcatataactatcgtattggaagatatatccttatatcaacaatatgaagaatatttaatgtattttaaaaaacctggatgcagcaatgaaaacataaatctaacatgttacgatacatatagtagtggaggcccatgggacaaaaaataaatccacttggtttcagacttggtacaacccaaagtcatcattctatttggtttgcacaaccaaaaaagtattctgaaggtttagaagaagataaaaaaatacgagactgtattaaaaattatgtccaaaaaaatataagaatatcctctggtatggagggaattgcacgtatcgaaattcaaaaaagaatcgatctcattcagatcataatctatatgggatttcctaaattattaattgaagataaaccccgaagaatcgaagaattacagatgaatgttcaaaaagaacttaattgtgtcaatagaaaactcaacattgctattacccgaatttccaatccgtatgggcatcctaatattcttgcagaatttatagctggccaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggttttaggaataaaaatttggatattcgtagacgaagaataaaaaaactttatttgtctttacattttatccaatgataaaaaacgaaaactatgtagtataacactataaagaaataaaaataaaaacttgtagtcttcttttttatgtttaagaaaaaaaaaataagcaattctataaggttgaataaacatttccatcaaaactcctttgatataattgctatgcttagtgtgtgactcgttggtttagggttagattacgataaaaaaaaaagaacttaccaactaataactacagcattaataaataacctaagcaactcattgcttcgcattatctggatccaaaaaattagtcaagatatgataggctgatcatatcattggagcaactgactaaaaaaaaagaataaagaaagatgattattaagttatgaaaggtaatcaaaaagtatgcggataaatggaaggatgaaagaaagagcgaaaaaattgaatattaatgatatatgattccaatttggaaaatctatgaggtcactgtaagaaaagcaatgtaataaagcatcaatacagattcattcataataattagataaatctgttccgaaaacaaaaaattaagagccttgagccaataaaaactgagaaaattgcctcaaaaaaaaaagaaattcaaaatttcatgtaaaagctccattgtagaattcaggcctaatgattaatcaagaagcgatgggaacgacggaacccatgaatatataggattctagtgaacaagaaatcttagtaattcattggacaggatggcggaataaaccagaaactttattatctattctgatttctgattttgattctgagacctcgggggataaacagcaaacttaaatagatattgaaagagtaaatattcgccggcgaaaaattggtttttttttcaaataaaaacagtaataaaagatgaaaaaaacaatgaaaaaaataaaataaggatttgttataatattctaactctaataaaaattacatttgtaatgatgatattacgttatttttaaataaatcgaaataaaattgatctttgattctatttcaaaaaagacatacacaaatttagaagagataagatgaaataaaaaaaaaataccatgattaataggattaatcattaactacatctatatcttaattaatccttttattcgcgaggagctggatgagaagaaactctcacgtccagttctgcagtagagatggaatttctcatttagaaaaaacccatcaactataacccaaaaagaaccaaatttcgtaaacaacatcgaggaagactaaaaggaatatcctctcgtgggaatcgtatttgttttggcagatatgctcttcaaacacttgaacccgcttggattacatctagacaaatagaagcagggcgacgagcaatgacacgaaatatacgacgtggtggaaaaatttgggtacgtatatttccagacaagccagttacagtaagacccgcggaaacgcgtatgggttctgggaaaggatccccagagtactgggtagctgtggttaaaccaggtaaaatcctttatgaaatgggtggtgtaccagaaaatatagccagaaaagctatttcaatcgcggcatcaaaaatgcctataaaaacccaattcattatttctgaataggaatatagaatgaaaaagctaaataacatttaaggataaaaagattataagtttttttttgacaaacaatattttttttacttcgtcctttgcactaaaagaagagatacaaaaatatgattcaaccacaaacctatttgaatgtagcagacaacagcggggctcgaaaattgatgtgtattcgaataataggagctagtaatcgccgctatgctcatattggtgacgttattgttgctgtaatcaaggaagcaatcccaaatactactctagaaagatcagaagtggtcagagctgtaattgtacgtacttgtaaagaactcaaacgtaagaatgggacgataatacgatatgacgacaatgccgcagttgtcattgatcaagaaggaaatccaaaaggaactcgcgtttttggggcgatcccacgggaattgagacaattaaactttactaaaatagtttcattagctcctgaagtattataagacgctaaatatcgatagttaatataggataggattaaaaaaaatggtattgaaatcaaattaattataattaatagattgtgtatcacgcatatacccttaataattttatatattaataattgaattcatatattaatatataattcgtctctatttttatataaataaaagaaaaataacatgttgattatatcaaaattatagaacaattaaggaattttaacttatcatggggaaagacactattgctgatataataacctctatacgaaatgctgacatgaatagaaaaggaacagttcggataggatcgactaacatcaccgaaagcattgttaaaatacttttacaagagggttttatcgaaaacgtaaggaaacatcgcgaaaacaatcaatattttttgattttaaccctaagacatagacgaaataagaaagaatcctataaaacgattttaaatttaaagagaataagccgaccgggtctacgaatctattctaactctcaacgaattccacgaattttaggcggaataggaattgtaatcctttcaacttctcaaggtataatgacagatcgagaagctcgactaaaaagaatcggcggagaaattttgtgttatatatggtaatccttctaatatcaaaattggatatccggaacttagcatttgtgaaaaaaaggggggggttgtgtaataccacccctgctaaaaaagtttagaattttttaccccgaatgaaattaaagaaaaaatgaattaatgaaagttttctttatgaatcacttccgaacggtatggttcgattttgtttagatactaaagattttttttattttaggtcatgcttctgaaaggattcgacatatttttgtataggtatacctataggagaaaaaggggtaaaatttttagtaagttcttaggtattaagttaatcggggaacagccactttctagactccataacaaggattcaaataagtcagtggttttttgaaattcaacattcctttcacgaagatacaattcaagattcaaaaatatcaagaaacctttttttcgtccaacaataagtatattaagagaatttaggaataacaactatgaaaataagggcttccgttcgtaaaatttgtgaaaagtgtcggctaatccgtaggaggggacgaattatagtaatttgttccaacccgaggcataaacaaagacaaggctaatcttactaaaggaaaaggcacttccaaggagctagtaaaaaaaaaggtccgttttgacatgaaatggatatatccatatatttcttgtgaaatgaaaaaatatggcaaaacctatattaagaattggttcacgtaaaaatacccgtagtggttcacgtaaaaatgtacgtagaataccaaagggagttattcatgttcaagcaagtttcaacaataccattgtgaccgttacagatgtacggggtcgggtgatttcttggtcctccgcgggtacttgtggattcaggggtacaagaagaggaacaccttttgctgctcaaaccgcagcaggaaatgctattcgagcagtagtggatcaaggtatgcaacgagctgaagtaaggataaaaggccctggactaggaagagatgcagcattacgagctattcgtagaagcggtatacttttaagtttcgtacgagatgtaacccctatgccacataatggttgtagaccccctaaaaaacgacgtgtatagaactaaataaaggctgaaagggtttcaagagaaataaatgattcaatgatctgatcaaataaaattactatggttcgagagaaagtcaaagtatctactcggacactacagtggaagtgtgttgaatcaagaagagacagtaagcgtctttattatggacgctttattctgtctccacttatgaaaggtcaagccgacacaataggcattgcgatgcgaagagctttacttggcgaaatagaaggaacatgtattacacgtgcaaaatttgagaacataccacatgactattctaacatagtcggtattcaagaatcagtacatgaaattttaatgaatttgaacgagattgtattaaaaagtaatctatatggaacgcgcaacgcgcttatttgtgtccaaggtcccggatatataactgctcgagacatagttttaccgccctctgtggaaatcgttgataatacacagcatatagctaccttaacggaaccaataaatttgtgtattggattaaaaatcgagaggaatcgcggatatagtttaaaaatgtcaaataactttgaagaccgaagttatcctatagatgctgtattcatgcctgttcaaaatgcgaatcatagtattcattcttatgggaatgggaatcaaaaacaagagattctttttctagaaatatggacaaatggaagtttaactcctaaagaagcacttcatgaagcctcccggaatttgattaatttatttattccttttctacatgtagaagaagaaacgttctatttagagaacaatcaacatcaagttactttacccctttttccttttcataatagattagttaacctaagaaaaaaaaaaaaaagaactagcgtttcaatatatttttattgaccaattagaattgcctcccagaatctataattgtctcaaaaagtccaatatacatacattattggatcttttgaataacagtcaagaagaccttatcaaaatggaacattttcacatagaagatgtaaaaaagatattagacattttag

SEQ ID NO: 4758 - DNA, 2561 bp, Brassica rapa
gtatcaatggaatcttctcatcatctatacataacgaattggtgtggtatattcatatcataacataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatgggcagcatcattgtggtaaaggtcgtaatgccagaggaatcattaccgtaaggcatagagggggaggtcataagcgtctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactatttgatttacgtaattggaagtaaccaattaggtttacgacaaaacctagaaatcgatcactgatccaatttgagtacctctgcaggatagacctcaacagaaaactgaagagtaacggcagcaagtgattgagttcagtagttcctcatataaaattattgactctagagatatagtaatatggagaagacaaaattgtttcaagcaccgacagaaccataagcgccccttgtttcaaagagaggaggacgggttattcacatttcatttgatggtcagaggcgaattgaaagctaagcagtggtaattctaaagattcccccggggaaaaatagagatgtctcctacgttacccataatatgtggaagtatcgacgtaatttcatagagtcattcggtctgaatgctacatgaagaacataagccagatgacggaacgggaagacctaggatgtagaagatcataacataagttattcggcagattttgattcctatatatccactcgtgtggtacttctaccatatatagaagaattctacgatatatataagataagatccatccgtatagatatcatcatctacattcagaaagccgtatgctttggaagaagcttgtacagtttgggaaggggttttgattgatcaaaaagaagaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaaacccgtaaccccctggggttatcctgcgcttggaagaagaactagaaaaaggaaaaaatatagtgagactttgattcttcgtcgccgtagtaaataggagagaaaatcgaatttctttcttcgtcttaaaaaaaataggagttaattaactgtgacacgttcactaaaaaaaaatccttttgtagcaaagcatttattaagaaaaatagagaagcttaatacaaaggcggaaaaagaaatcataataacttggtcccgggcatctactattatacccacaatgattggccatactatcgctatacataatggaagggaacacttacccgtttatataatcgaccttatggtaggacataaattgggagaattttcacctactataaattttagaggacacgcgaaaaatgataatagatctcgtcgttaattaaatgaattcaaaaaatgaataatgaatataatttttttttttagtgagaggtaaaccttatgataaagaagaaaaagaagaaatcatatacttccgtatatgctttagggcaatatatatctatgtctgcccacaaagcacggagagttattgatcagatccgtggacgttcctacgaagaagcacttatgatattagaacttatgccgtatcgaggatgttatcccatttttaaattagtttattctgcagcagcaaatgctagtcacaataagggtttc

SEQ ID NO: 4759 - DNA, 2152 bp, Brassica napus
atacttttaatgtcgaatcaggattaactaggacagaaataaagcattgggtcgaactcttctttggtgtcaaggtaatagctatgaatagtcatcgactcccccggaaaggttaaaagaatgggacctattctgggacatacaatgcatcacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatgggcagcatcattgtggtaaaggtcgtaatgccagaggaatcattaccgtaaggcatagagggggaggtcataagcgtctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactatttgatttacgtaattggaagtaaccaattaggtttacgacaaaacctagaaatcgatcactgatccaatttgagtacctctgcaggatagacctcaacagaaaactgaagagtaacggcagcaagtgattgagttcagtagttcctcatataaaattattgactctagagatatagtaatatggagaagacaaaattgtttcaagcaccgacagaaccataagcgccccttgtttcaaagagaggaggacgggttattcacatttcatttgatggtcagaggcgaattgaaagctaagcagtggtaattctaaagattcccccggggaaaaatagagatgtctcctacgttacccataatatgtggaagtatcgacgtaatttcatagagtcattcggtctgaatgctacatgaagaacataagccagatgacggaacgggaagacctaggatgtagaagatcataacataagttattcggcagattttgattcctatatatccactcgtgtggtacttctaccatatatagaagaattctacgatatatataagataagatccatccgtatagatatcatcatctacattcagaaagccgtatgctttggaagaagcttgtacagtttgggaaggggttttgattgatcaaaaagaagaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaaacccgtaaccccctggggttatcctgcgcttggaagaagaactagaaaaaggaaaaaatatagtgagactttgattcttcgtcgccgtagtaaataggagagaaaatcgaatttctttcttcgtcttaaaaaaaataggagttaattaactgtgacacgttcactaaaaaaaaatccttttgtagcaaagcatttattaagaaaaatagagaagcttaatacaaaggcggaaaaagaaatcataataacttggtcccgggcatcacgggcgaacgacgggaattgaacccgcgatggtgaattcacaatccactgccttaatccacttggctacatccgcccctactctactatacatcatatcttgtttgtattgtctaaaataaacacgcagcaatattttagactatacatcatatcttgtttgtattgtctaaaatattgctgcgtgtttattttagactatacatcatatcttgtttgtattgtcggacgcgtgg

SEQ ID NO: 4760 - DNA, 24328 bp, Brassica rapa
ctcgagaagagatgggaaacatgctcaatatcatttgattgaatagttgacccagctccttgttgtttgaagaaaccctccacttcaattggtattttttcacgaaaagcaaacatgagataacaaatccagtctttcactaagatttcgaatagctgtcccgaattcaagttgattatgtttcgcctcttattcggagaaagacgatcaaacaattcccaatcatggcccttgcggatcggatcatccatataatatacaaaaagaaactccagatatttgatatctttctctttaaatgagatatcaattccagcgacggtttcattagatatcttacaacaaaaatccctcttttttccgatccagttcctccaccaccgcgaactccagttagattcaggcatgatacactttttagttattgggagaacccgagtactctctttcggatcccggaaacagctctcagagatcttttttccttttgtaaaatacaggagcgaaacaatcaacctattgatattggaagacccaaaagattcttccgatgtatcatttctgggtccaatggaattcataggtataggaagaagccctttcaaatagagatttttgctttcgaccatatttcgattgttaatacgatatagaagggccgctactacaaatagtactacacccttgatcgtgaaatatcgattgcttgttgaaccctgtgaattgcgcaaaagtaggatactaaaaattcgagggtccaagagttttctaaaacgttcttggtggaaaaaaatatgaatgaaagatcccactgaattgatttgggtccatgaatctaagaaatagtgagaattcttgatctctctcactatttctctcaattcgaaaatccaggatttgaattgatgtcctttcattgattcctcctaaattgcattgatttatcctaaagatttcatttcaattggaatttggttattcaccatgtacgaggatccccactaagcatccatggctgaatggttaaagcgcccaactcataattggcgaattcgtaggttcaattcctactggatgcacgccaatgggaccctccaataagtctattggaattggctctgtatcaatggaatcttctcatcatctatacataacgaattggtgtggtatattcatatcataacataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatgaatagtcatcgactccccggaaaggttaaaagaatgggacctattctgggacatacaatgcattacagacgtatgatcattacgcttcaaccgggttattctattccacctcttagaaagaaaagaacttaaatcaaaatacttaatagcatggcgatacatttatacaaaacttctaccccgagcacacgcaatggagccgtagacagtcaagtgaaatccaatccacgaaataatttgatctatgggcagcatcattgtggtaaaggtcgtaatgccagaggaatcattaccgtaaggcatagagggggaggtcataagcgtctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagataccattgtttctggtacagaagttcctataaaaatgggaaatgccctacctttgagtgcggtttgaactatttgatttacgtaattggaagtaaccaattaggtttacgacaaaacctagaaatcgatcactgatccaatttgagtacctctgcaggatagacctcaacagaaaactgaagagtaacggcagcaagtgattgagttcagtagttcctcatataaaattattgactctagagatatagtaatatggagaagacaaaattgtttcaagcaccgacagaaccataagcgccccttgtttcaaagagaggaggacgggttattcacatttcatttgatggtcagaggcgaattgaaagctaagcagtggtaattctaaagattcccccggggaaaaatagagatgtctcctacgttacccataatatgtggaagtatcgacgtaatttcatagagtcattcggtctgaatgctacatgaagaacataagccagatgacggaacgggaagacctaggatgtagaagatcataacataagttattcggcagattttgattcctatatatccactcgtgtggtacttctaccatatatagaagaattctacgatatatataagataagatccatccgtatagatatcatcatctacattcagaaagccgtatgctttggaagaagcttgtacagtttgggaaggggttttgattgatcaaaaagaagaatctacttcaaccgatatgcccttaggcacggccatacataatatagaaatcacacttggaaagggtggacaattagctagagcagcgggtgctgtagcgaaactgattgcaaaagaggggaaatcggccacattaaaattaccttctggagaggtccgtttgatatccaaaaactgctcagcaacagtcggacaagtgggaaatgttggggtaaaccagaaaagtttgggtagagccggatcgaaatgttggctaggtaaacgtcctgtagtaagaggagtagttatgaaccctgtcgaccacccccatggaggtggtgaagggagggctccaattggtagaaaaaaacccgtaaccccctggggttatcctgcgcttggaagaagaactagaaaaaggaaaaaatatagtgagactttgattcttcgtcgccgtagtaaataggagagaaaatcgaatttctttcttcgtcttaaaaaaaataggagttaattaactgtgacacgttcactaaaaaaaaatccttttgtagcaaagcatttattaagaaaaatagagaagcttaatacaaaggcggaaaaagaaatcataataacttggtcccgggcatctactattatacccacaatgattggccatactatcgctatacataatggaagggaacacttacccgtttatataatcgaccttatggtaggacataaattgggagaattttcacctactataaattttagaggacacgcgaaaaatgataatagatctcgtcgttaattaaatgaattcaaaaaaatgaataatgaatataatttttttttttagtgagaggtaaaccttatgataaagaagaaaaagaagaaatcatatacttccgtatatgctttagggcaatatatatctatgtctgcccacaaagcacggagagttattgatcagatccgtggacgttcctacgaagaagcacttatgatattagaacttatgccgtatcgaggatgttatcccatttttaaattagtttattctgcagcagcaaatgctagtcacaataagggtttcaaagaaaccaatttagtcattagtaaagctgaagtgaatcaaggaaatacggtgaaaaaattaaaacctcgggcacgaggacggagttacccaataaaaagatccacttgtcatataactatcgtattggaagatatatccttatatcaacaatatgaagaatatttaatgtatttaaaaaaacctggatgcagcaatgaaaacataaatctaacatgttacgatacatatagtagtggaggcccatgggacaaaaaataaatccacttggtttcagacttggtacaacccaaagtcatcattctatttggtttgcacaaccaaaaaagtattctgaaggtttagaagaagataaaaaaatacgagactgtattaaaaattatgtccaaaaaaatataagaatatcctctggtatggagggaattgcacgtatcgaaattcaaaaaagaatcgatctcattcagatcataatctatatgggatttcctaaattattaattgaagataaaccccgaagaatcgaagaattacagatgaatgttcaaaaagaacttaattgtgtcaatagaaaactcaacattgctattacccgaatttccaatccgtatgggcatcctaatattcttgcagaatttatagctggccaattaaaaaatcgcgtttcttttcgaaaagcaatgaaaaaagctattgaattaactgaacaggcgaatacaaaaggaattcaagtacaaattgcaggacgtatcgacggaaaagaaattgcacgtgttgaatggatcagagaaggcagagttcctttacaaacaattgaagctaaaattgattattgttcctatacagttcgaactatttatggggttttaggaataaaaatttggatattcgtagacgaagaataaaaaaactttatttgtctttacattttatccaatgataaaaaacgaaaactatgtagtataacactataaagaaataaaaataaaaacttgtagtctttttttttatgtttaagaaaaaaaaatgagcaattctataaggttgaataaacatttccatcaaaactcctttgatataattgctatgcttagtgtgtgactcgttggtttagggttagattacgataaaaaaaaaaagaacttaccaactaataactacagcattaataaataacctaagcaactcattgcttcgcattatctggatccaaaaaattagtcaagatatgataggctgatcatatcattggagcaactgactaaaaaaaaagaataaagaaagatgattattaagttatgaaaggtaatcaaaaagtatgcggataaatggaaggatgaaagaaagagcgaaaaaattgaatattaatgatatatgattccaatttggaaaatctatgaggtcactgtaagaaaagcaatgtaataaagcatcaatacagattcattcataataattagataaatctgttccgaaaacaaaaaattaagagccttgagccaataaaaactgagaaaattgcctcaaaaaaaaaaaaagaaattcaaaatttcatgtaaaagctccattgtagaattcaggcctaatgattaatcaagaagcgatgggaacgacggaacccatgaatatataggattctagtgaacaagaaatcttagtaattcattggacaggatggcggaataaaccagaaactttattatctattctgatttctgattttgattctgagacctcgggggataaacagcaaacttaaatagatattgaaagagtaaatattcgccggcgaaaaattggtttttttttcaaataaaaacagtaataaaagatgaaaaaaacaatgaaaaaaataaaataaggatttgttataatattctaactctaataaaaattacatttgtaatgatgatattacgttatttttaaataaatcgaaataaaattgatctttgattctatttcaaaaaagacatacacaaatttagaagagataagatgaaataaaaaaaaaataccatgattaataggattaatcattaactacatctatatcttaattaatccttttattcgcgaggagctggatgagaagaaactctcacgtccagttctgcagtagagatggaatttctcatttagaaaaaacccatcaactataacccaaaaagaaccaaatttcgtaaacaacatcgaggaagactaaaaggaatatcctctcgtgggaatcgtatttgttttggcagatatgctcttcaaacacttgaacccgcttggattacatctagacaaatagaagcagggcgacgagcaatgacacgaaatatacgacgtggtggaaaaatttgggtacgtatatttccagacaagccagttacagtaagacccgcggaaacgcgtatgggttctgggaaaggatccccagagtactgggtagctgtggttaaaccaggtaaaatcctttatgaaatgggtggtgtaccagaaaatatagccagaaaagctatttcaatcgcggcatcaaaaatgcctataaaaacccaattcattatttctgaataggaatatagaatgaaaaagctaaataacatttaaggataaaaagattataagtttttttttgacaaacaatattttttttacttcgtcctttgcactaaaagaagagatacaaaaatatgattcaaccacaaacctatttgaatgtagcagacaacagcggggctagaaaattgatgtgtattcgaataataggagctagtaatcgccgctatgctcatattggtgacgttattgttgctgtaatcaaggaagcaatcccaaatactactctagaaagatcagaagtggtcagagctgtaattgtacgtacttgtaaagaactcaaacgtaagaatgggacgataatacgatatgacgacaatgccgcagttgtcattgatcaagaaggaaatccaaaaggaactcgcgtttttggggcgatcccacgggaattgagacaattaaactttactaaaatagtttcattagctcctgaagtattataagacctaaatatcgatagttaatataggataggattaaaaaaatggtattgaaatcaaattaattataattaatagattgtgtatcacgcatatacccttaataattttatatattaataattgaattcatatattaatatataattcgtctctatttttatataaataaaagaaaaataacatgttgattatatcaaaattatagaacaattaaggaattttaacttatcatggggaaagacactattgctgatataataacctctatacgaaatgctgacatgaatagaaaaggaacagttcggataggatcgactaacatcaccgaaagcattgttaaaatacttttacaagagggttttatcgaaaacgtaaggaaacatcgcgaaaacaatcaatattttttgattttaaccctaagacatagacgaaataagaaagaatcctataaaacgattttaaatttaaagagaataagccgaccgggtctacgaatctattctaactctcaacgaattccacgaattttaggcggaataggaattgtaatcctttcaacttctcaaggtataatgacagatcgagaagctcgactaaaaagaatcggcggagaaattttgtgttatatatggtaatccttctaatatcaaaattggatatccggaacttagcatttgtgaaaaaaaagggggggggttgtgtaataccacccctgctaaaaaagtttagaattttttaccccgaatgaaattaaagaaaaaaatgaattaatgaaagttttctttatgaatcacttccgaacggtatggttcgattttgtttagatactaaagattttttttattttaggtcatgcttctgaaaggattcgacatatttttgtataggtatacctataggagaaaaaggggtaaaaattttagtaagttcttaggtattaagttaatcggggaacagccactttctagactccataacaaggattcaaataagtcagtggttttttgaaattcaacattcctttcacgaagatacaattcaagattcaaaaatatcaagaaacctttttttcgtccaacaataagtatattaagagaattaaggaataacaactatgaaaataagggcttccgttcgtaaaatttgtgaaaagtgtcggctaatccgtaggaggggacgaattatagtaatttgttccaacccgaggcataaacaaagacaaggataatcttactaaaggaaaaggcacttccaaggagctagtaaaaaaaaggtccgttttgacatgaaatggatatatccatatatttcttgtgaaatgaaaaaatatggcaaaacctatattaagaattggttcacgtaaaaatacccgtagtggttcacgtaaaaatgtacgtagaataccaaagggagttattcatgttcaagcaagtttcaacaataccattgtgaccgttacagatgtacggggtcgggtgatttcttggtcctccgcgggtacttgtggattcaggggtacaagaagaggaacaccttttgctgctcaaaccgcagcaggaaatgctattcgagcagtagtggatcaaggtatgcaacgagctgaagtaaggataaaaggccctggactaggaagagatgcagcattacgagctattcgtagaagcggtatacttttaagtttcgtacgagatgtaacccctatgccacataatggttgtagaccccctaaaaaacgacgtgtatagaactaaataaaggctgaaagggtttcaagagaaataaatgattcaatgatctgatcaaataaaattactatggttcgagagaaagtcaaagtatctactcggacactacagtggaagtgtgttgaatcaagaagagacagtaagcgtctttattatggacgctttattctgtctccacttatgaaaggtcaagccgacacaataggcattgcgatgcgaagagctttacttggcgaaatagaaggaacatgtattacacgtgcaaaatctgagaacataccacatgactattctaacatagtcggtattcaagaatcagtacatgaaattttaatgaatttgaacgagattgtattaaaaagtaatctatatggaacgcgcaacgcgcttatttgtgtccaaggtcccggatatataactgctcgagacatagttttaccgccctctgtggaaatcgttgataatacacagcatatagctaccttaacggaaccaataaatttgtgtattggattaaaaatcgagaggaatcgcggatatagtttaaaaatgtcaaataactttgaagaccgaagttatcctatagatgctgtattcatgcctgttcaaaatgcgaatcatagtattcattcttatgggaatgggaatgaaaaacaagagattctttttctagaaatatggacaaatggaagtttaactcctaaagaagcacttcatgaagcctcccggaatttgattaatttatttattccttttctacatgtagaagaagaaacgttctatttagagaacaatcaacatcaagttactttacccctttttccttttcataatagattagttaacctaagaaaaaaaaaaaaagaactagcgtttcaatatatttttattgaccaattagaattgcctcccagaatctataattgtctcaaaaagtccaatatacatacattattggatcttttgaataacagtcaagaagaccttatcaaaatggaacattttcacatagaagatgtaaaaaagatattagacattttagaaaaaaaataaaaaaagcattaaaaaaaatttgactaaaaagtcaatttaaaattgaaatggattttaaaccttcaacgtaatttcgattttccagtcaaacctattttacttaataaaattaatttagatatgtatctagggagaattcattttgaaatgactactccctagatacccacgccttttattttacaattgaataaatttaattaaaaaagacctaaagttagagatttatcaattggtaatgttgctccaatacctaaccacagggccaccacggtgccaatcaaaaagacggttgtcgcgactggacgacgaaatggattttggaacttattaacattttccaaaaagggtacggttaataatcccgccggtactgaagccattaaaagaacacccaataatttgttaggcactgtacgaagtatttgaaatacaggaaagaaataccattcaggtaatatttccaaaggagttgcaaaaggatccgcaggttcaccaatcattgatggttctaaaaccgctaagcctacgttacaggcaatggtaccaagaatgactactggaaaaatatataaaagatcattgggccatgcgggctctccgtaataattatgacccatacctttagctaatttagctcgtaatacaggatcattcaaatctggtttttttgttattgggataggtgaattcttatggatccatcccccgagggaaccggacatgataatttttcatcatccggctcgagcaagaattaaccaaactaaattaatacatacaaaaaatatatatgttatcaacaagtatttaatatgtaaaaaaagaattatccgattccaaagttattgcaactaaagattaccataaattccattcttacaggtaaatgctcaacacccacgtaagcttaaaagttgatcatgattaagtgctttctggatcgtctcataccttatcaattaatccttaatctcaaaaattatatcgagatttttcaaatacaaaggatttacttgttactaatgaagtctaccctctactcttcattagatcctgtattcactccgatagtatcagaaatcgagtcgatgcagaggaaatgaatgcatttacatactattaattttttatgtttttagctattttttactaaaaaatagctaaaaacataatcctgattatgttccatcccttaatctcctggatttttggattttacggagcccactcatccacgacatcgtcgggtattatgatcatagaaaagattctcttcaagtgaaccagcctatcccctgtatggggcttacacagtggttggaacaaagacacatttggttgtgaattccaatgtagcagataaagtcatatttctgcacggcccgatcaatagttcaagtcacacactcccataatccattttctcttcatagaattcccttcaactttttatgtcaaaaaaataatacaatattgtggagttgaagggaaatatccaaatacatgtcttatttttttaataatccatatttatagcaataaaatacgattgttccttcaccaagtaataagataaattagtaattaaaaatatctagaatctatattatttataagggaccagaaataccttgcttacgtatcattaagaaatgcattaacataaatacagccgtaagaagaggtaatacaaaagtgtgtaaactataaaaacgagtcaaagtggattgtccaacactagcacttccgcgtaataattctacaagaggcgatcctattaccggaatagcgtcaggtacacctgttacaattttgactgcccaatagccaatttgatcccaaggtaaagaataacctgttacaccaaaagatgcggtcaatacacccagaaccacaccagtaacccaagttaattcgcgaggttttttaaaaccaccggtgaggtatacacgaaatacgtgcaggatcatcattaggaccatcatacttgccgaccatcgatgaactgatcggattaaccaaccaaagttagcttcagtcattatatattgaacagaagcaaaagcctcagtaacagttggacggtaataaaaagtcatagcaaatcccgtagctacttgtactaaaaaacaagtaagggtaattcctcctagacaataaaatatgttgacatgcggaggaacatatttactagttatatcgtctgcaatcgcttgaatctcaagacgttcttcgaaccaatcataaactttattgagataggtaaaccaaggttcctccccctccaagaactgtatatgagaatttcatctcgtacagctcaaacaaaaaaaagacccaaatactgattgaaacggatatggaatataaagttttaaacttctctctcattcaatattatttaagagtcaaaatgcgaaagctcttctttgtggttaaatgccaaaaactcaagtcagctcatacgtctttatgttgtgttgatcgttacaggcctcttgaatcttctagattacctatcgttattgtcttttttagttggtatttgtatggaatgggaatacggatttcttcttgttttctttattattgataggaattttcttgttaagaccctacttattaattgaaacctcagattcatacgaaaaccacgataattcaatgaaaccttcaaagtccaaagttcactgagtgagaaccattggatcatcacttattcaataaaaaaaaaaaagagctataatgattaaaaacataaaatacaaagaagcgtttgtcctttgatctaaataagagtttaaaagcagaaaaaaattgatttatgaaaatttataagatagaacggaaagaagtccggctacgaggtctaagtattaagtatgaatcatagttcgaaaactttgtgatctatttgatctatttcgtgctccagatactcgaatgaatatccgacgaaataaaaccatcttgataaagatgacagacccccttctctgtactatccatagggtcaattctaacaagtcacacactcatattccggaaatatacaatgcagaaaaaaatttcgcggtcgaactaccaaaggagaataggtgcaaaattttagacctacatactttacttttttgtatcgaacaaaaagctaggacttcaagattcttctcagtctaattcattgaaattccatccagtagaacagaggaattataaatctccaaaataatagataggaataccgcaaatagtgccattgcaacacccatcaaaggggtcgttccccatccaggagctactttaccatattcagaattcaacggtttcaataacttccctacagtagtgcttcttggaccagatctagaactatcttcaacagtttgtgtagccataaatcttattttgtattcattacgatctgttgactttgtataccattccgttgtaaataaacgatcttagcatagatccattgtggtctttcaattatataataatggaaacagcaactctagtcgccatctttatatctgggttacttgtaagttttactgggtatgctctatatactgcctttgggcaaccctctcaacaactaagagatccattcgaggaacacggggactagttgacgtaatcagcctccaaatagttggaggctgattacgtcaatgaagagaatgaaaaattatttcattttttagttgaaattgtaggcggttcccgaaaaaaaatagcgaaaaaaatgatccctaaagtcgatactaagagaaatgtataaaccaatgcttccataaatttgatcgtggtttacaattatagctttcatacctgttttgtttatgtttactgaaggagtatacctccggataaagaacaaaaaagagtcaaagaaacggcagcgatttaaatcaagattcctacagtaccctacctattaaataaaatgaaatcaaaaaaatcgcaaacagaaactaaaagaaaaaagcaatgttgcatcagactgcttgtctttttgtagttggatctccaagtttttggaatgccccaaattccacctgagcatccaaatctggatcaataccagcaaaaacatctctgaagagggttctagaaccatgccaaatgtgtccaaagaagaaaagtagagcaaacgaagcatgcccaaaagtaaaccaacctcttggactgctacgaaaaacaccatcggatttcaaagtagcacgatctaattcaaaaatctcacccaattgagcccgtctagcatattttttcacagttgcgggatcactataacttactccattgagttcaccaccataaaactcaacagttacacctacttgttcgacactatatttagattctgcccttctaaacgggacgtcggctctaacaattccgtctccgtctaccaaaacaaccggaaatgtttcaaaaaaagtaggcatacggcgtacaaaaagttcacgcccttctttatttctaaagacggggtgtcctaaccatccaacagctattccatccccattgtccattgaacccgctcggaataatcccccttttgctggattattaccaatataatcataaaaagctaatttttcaggaattttagaccaagcttctgatacactttgattttcagctagtccggcactaactcttcgatatatttcttgttgaaagtatccctgatcccattgataacgagtaggaccaaataattcgatgggagtagttgcagaaccataccacatagttccagcaacaataaaagctgcaaaaaagacagcagcaatactactggaaaggacggtttcaatatttcccatacgtaatcctttgtatagacgttgaggcggacgaacactaagatggaataagcccgctaatatacccaacgtccctgctgcaatatgatgagaggctattcctcccggaacaaaagggtcaaaaccctccacgccccacgccggatttacgggttggacctttccggttagtccataagggtcggatacccatattccaggaccatataatcctgttacatgaaatgcgccaaaaccaaagcaagccactcctgaaagaaataaatgaattccaaaaatcttgggcaaatccaaagaaggttttcctgtacgttcatcacaaaaaatttctagatcccaatatacccaatgccaaatagctgccaagaagcacaagccagaaaacacgatatgtgctgcggctaccccttcgtaactccaaagacccggattcgttatagtccctcctgtaatattccaaccgccccatgaattggttattcctaaacgagtcatgaaaggtataacgaacataccttgtctccacattggatcaagaacagggtcggagggatcaaaaacagctaattcatatagagccatggaaccggcccaaccagcaaccagagcagtatgcattatatgaaccgaaagcaaacgaccgggatcattcaatacaacagtatgaacacgataccaaggcaaacccatggaaatacccctttatcaatgaaaaatagacactatgtaactttattgcattggaaaaaactatgttacggaccccccctttttaggtaattatttcggagaaaggattaatatttgttctattctgttagtaataatggaacaattcgattcataggaaaaaagggaagcggatctattctatatccgataagtaccaatacgcaatgggggtgaatcctatgttatatgaaccaagatagctattgttgttcatcgttcagaagcccgttcgtaaaaagtttcctttcatttttattcattctctcttactttacttttattttatattttattttagcttattcaacttctgtattaaatattattaatttaaatatgattaatattaataaagtaggaaaaaaggataatatgataaaaaaaatgaaaccccagtcttacgtttccacatcaaagtgaaatagagaacttcattctctttttttttcatttcatgcctattggcgttccaaaagtaccttttcgaagtcctggagaaggagatacatcttgggttgacatatagtgcgacttgtcagatatattgggctatatgggatttccccattttctccctcgatcgagatatcctctgtttcgctcaaaaagattgattgaattatcaaaaatttgtaacgcgaagcgcaaaaaataaattagaattaaatgcagggagtatttagattgatattagattatcaaaaattttttatggtttacgtgatcggactaataaaattaagtatccaggctccgtttagcaaaaatccaattgataattaatatataatatttttataattactacttaatatgatatgaatatgatatcaaaattatgataaaaattctattaaaaaataaaaaaaatacaaaaaattgaaacagggtgatctaaaactgttgatcaaataaaataatataattaaaaatttattgactatttgacagaagacatgtgaaagaaatgaattgaaaaaaaaagaaggagtagtaaaaaaaaaaaagacgcggtatttggttcatttgtcctatatgtgcaaatcaaaatcgggcaaatttttccttttactcggagtagagcataaacctaaaaaaacagaataaaaaaaggaagaagcccattcaggaacaagaaaaaaccatccccatttcaactgaatctcgatgaaaaaaaaatatcaatgaatcaagttagtctgacaggcctaatcaatcgttttattattttattattaggattataatatctaataaataaaaggggccaaaacttatttattttttcttttacttttaaaagggaagcaagcccttcccttattaagttagaaagaaaagccttctctgaaaaaaagggggttggaatcgacacattgattttttaacaatttttgttgaaccgtatgcatcaaaaggtgcctgtacggctcctaaggaataaaattttatcctaatcaaccgactttatcgagaaagattgttttttttaggccaagaggttgataccgaaatttcgaatcaacttattagtcttatgatatatctcagtatagaaaaggataccaaagatctttatttgtttataaactctcctggtggatgggtaatatctggaatggctatttatgatactatgcaatttgtgcgacccgatgtacagacaatatgcatgggattggccgcttcaatagcatcctttatcctagtcggaggagaaattaccaaacgtatagcattccctcacgcttggcgccaatgagtttttttattttagagaaaaaatactatgccttcgccctcggaaatatgaattagttaagtaataatagcatggcacttcgaattcgatatgaaattttttagattaaaaaaattagattatatattgaaagagtagtatgggataagaaaggggtatttaaaatgatatcttccctattcgggcacatcccagcgtcacaaactttgttttcacaccggaagcttatttacaaaaacaaaaaaaaagacactttgggattgctgaatcatagacggatcaaaaaaaatgatatataaagcaacggaaccatcatagtatttttttaactcctacaaaacaaaaaagaaggatggtaattggatcatttatggatccgcgtataatagaacctatattttgttttctttcgccgaaaggaaaggtcaaaaacgtaaattccattctagagccgtatgcaacgcacaaaaaaagcctgtacggttattcaaatttctctgtttttttggttatctcgcctcattctgcgaaatagaaaaagcttttctattatatcatcagggtaatgatccatcaacccgctagttcgttttatgaggcacaaacgggagaagttatcttggaagcggaagaactactaaaacttcgcgaaaccatcacaagggtttatgtacaaagaacgggcaaacctatatgggttgtatccgaagacatggaaagggatgtttttatgtcagcaacagaagcccaagctcatggcattgttgatcttgtagcggttcaataaaaataggagcgatttcatgcaaatctaccactgctaattttatatctttttagattaaaggtttagtttcatattctcttcaatataaaaaaaatatattgaagagaatcttgaagagaagtaattcagaattagccggttagaacccatctaaaccagcccattatttatatgattccgtatgccaaccattaaacaacttattagaaatacaagacagccaatccgaaatgtcacaaaatccccagcgcttcggggatgccctcagcgacgaggaacatgtactcgggtgtatgtgcgactcgtttagatcatagactgaaacacaaaaaggaaattctttttgaaatatcaaggatcagtacctgttaataaaataaaatagaatggaggaactcgattcattatttcaaaaagatagatcattcatatcttctattgtgtctgaaacttatggtttacattggtgcaaatccaatcaactccattttttagaaaacccccaatgataacaaatggttatcaattaagcgggggaaatcccattttttattaaaaagattccactcttgaaagaaaaaacggactaacagggtaaatgaccaaatcaattttaaaataaaataccgttactgtataaagtggatctcattgtgaaagatctattactggaatattaatggggtagagccaaagaatgtgaattgtacaagttaccaatagtattgattaattaaaagaaggagctccggtgtatagagaggacctcaccgttttagaagtaaccatagaaacgaaggaacccactatttatccatttctatttactactttttgtagttattctattttttttatatcaagtaccaaggcaatttatcctttcaaagcaaaggaaaatacctagccaaaaatagtggtggggaaggttagagtagcaaaagccattggaatttttttttatacattggaataattcgtttggttattaatgactagtaaaggggaaaagaataactaaaactaaaaaaagaattagttattcatcaaagtttgatttattcaatgactagaattaaacgcggatatatagctcggaggcgtagaacaaaacttcgtttatttgcatcaagctttcaaggggctcattcacgacttacacgaactatgactcaacagagaataagagctttagtttcggctcgtcgggataggggtaaaagaaaaagggattttcgtcgtttatggatcactcgaataaatgccgtaattcacgaaacggaggtattctatagttataaccgattcatacacaatctgtacaagaagcaattacttcttaatcgaaaaatacttgcacaaatagctctattaaataggagttgtctttatacgatttcaaatgagatcaaaaaatgaggggattggaagaaatccactaaaatatttgaaatagagttcttaagtagaataagctcggggagggtagagtagaaattagtattataaaaaaagtcgtcaaaacaaaacgagggtatatagtcgctaaaaaaagacttattctttttcttttcgacgattcttttcttttttttttttttatgacagaaacagacgtaacaatcaaattttgattcttaattggatttgtcgaacaaaatattaacctcttttttaattccttcagattagttattcaattgaagaataagtctatttttttctggttctaaggctagtagttctaggggtcgactcacttctttcaaattgtttctgattattaagaaaaggtaacaaagataaaatacgagcttgttttatagcaatagtaattaatcgttgttgttttaaagttactctattcacccgtctagataatatttttccttgttcactaataaatcgactaattaaactcatgtttctataatcaattcgatcccccgattggatcgggggcaaacgccgacgaaaagatcgcttggatttagtaaaaggtcgcttagatttattcataattttttattccttacctataaaatcctattttgattggatcaaaataaaaacgatttctatttctatataggatagagtttctatatagaattaagaatataggatttgatttatttctattattttatttgtttatatttatatatatgtaataatacgtagatactctcattattcctgttcttaaaataaaatttgacatacaagcactcaattttatctatttcttaatttccccatgaattgtatgtttataacaatagggacagaattttctcaattccaatcgactaggagtgttatgccgattcttttgagtaatatatctggaaattccagccgattctttcttaatatcatttcgaacacaactggtacattccaaaataattgttactcgaacatctttacctttggccatgaaacctcctttggatttatgattcacccccaatcttctattttaattttagggtccataaagaacaagaacaaaaaaaaatagaagctgttaattaactcaaaaaaatgtcttaaatatttcgttgcaatgaatattaattagtaattaaataaaaagaaaataataagtaatataatgattttttgaaaactatatttcaaatctttgtacagtattttttttaagtatctcgtaggatactctttccctagcaacacttttttttttattggattctgaaccctcgtttttatgaccctttcggccccctttttttttttctaattcttttttattcttaaaaaagaattagaaaaaaaagggggggttattccccgatcgttgatcgtatctctaaatttttttatcctttctgatgttaataactagaattaaaaaaagggaaatgttaatgcatctggaaataaacgattaatctctattaataaacctgctaacgaaacgaaccatagagtacttagtaccggtgctacggaaagatatgtttttagatctcgcatttgaaatcctccttctttcttctttattgtattacaatatatatagtaatatatataactatagatgtacatgtagttaagaagttcttgtatttgtatatgtaaccccccattttcaaaattagaattgaaatattgtctactagaacgatcttatagattccatttgaaaatggaaacgcctttttatgtaaatttgaaattgataggatttgcctaaaaaaagtaatttttttaattatacttatatatatgtttgttatctgatatgaaacaaaaaaaaagaaggatgtggaaaacaagataggaattgtttacaatgacactgtaaaccaatcgaaagggatgtagcgcagcttggtagcgcgtttgttttgggtacaaaatgtcacgggttcaaatcctgtcatccctacctaattactgctcagaagagcagtaacgaggaatccattttagatttatctttttttaataaaattggacatacatataattctgaattttatgatatactatgatatagtatatacgtacaaaatcgattcgagttaaagaatgtcctctttctagccttttcgtttttttagaaaaaacaagaaaagcgctcttagttcagttcggtagaacgtgggtctccaaaacccaatgtcgtaggttcaaatcctacagagcgtgatgtcactcttgtttattagattgtgtcaaaattccactgttcgcaaataattgagcagcaatctgaattcgacctcccgcatatgaaagcaagaaggaggtcagtaaaaaaaaagagatgttaattaatcaaaagtccaactgatcaccacgtctgtattgtaaataagcagttacgaataatccagccaaagtaataggaattagacctaagacgattccaaataaagaaacttcaatcatttcaattttcttttgttttcatttttgaaagggagaaaagagaggtactatctattcctagctcttaatctgtattgccgacgaatctcaatgaccaaaattgggtaattaacacggtaaggaactatcgaacatatgaaataccatataaatcttttttgatcaaaaaagattcattcaattaatttcaaataagtcgtattttgcttagaccaataaatagaactgaggttatagttaaagctgctagtagaaaaccgaaataactagttatagtaggcatgaagggactcaataaaatatgtttttttatacatatgtttctaaagtacttcccgaagtttcaataaaaaaatttttaaaagtaaagatagatacaaatactagttccaagaatcaaaaaattaaattgaaaatttgtgagttatcaagcattatcggtggtatgaacaaaaatagagaaaaagaaaaaacgaaattcatcgtctttggcatctgcaccatctcaggattcagaattcacgtaactgattcattgaaaaactctttaagaaattaataagaaaaaataatacataaaaaaaataactctattatataacttcagttaaaacatagaactttttttgaataaacatgtaaaaattaaaaaaaaagttgtttgattcttttttttttaagtgaccttagaacctagaatacgcccccttctacatttattcaaattgaaataaattcaattttgaataaagtagattaatatagtagagcagttttcttcatttaatctatgaaattaaaccaaaaagcagtatcctacacggagaacgagatcagtcaaaaaaagagttatttattttaactagatttttaaaacttgtaattagcaatttctattatcgtttcctttctaggttttaggtttttttctttcgatattatatagaaaatagagtgaaaaacccatcatctttgtagttagttaaagaaagaaaaaacctttaaattgaatacaacaaaacaatgcacgcattccaaagatttagtattattatttttttattatttgttgttcttttgaattgatccaaaactattcttccttttcttgttactgtaaattaattccttaaaataaaatgaaataaaaagcaaaaacggggggggtcacattatcattacaaaaaaatctcttctacaattatgcatatgcaacaaaaatgaaattgatggtttttggattcaattgacttgggacaatatgagaatttccttaatgaattattagaattagaaaccaccctcttgaattttcattttatctaatctttagtttattttctagtccaaaacaaataaaggatcaaagcccctatagattacagatacaggaatttgaagaagtggaacatggttatacatcgacaagcaaaaaaaaaaaacgaaataaattatctaacacttcagttctatactaattcaaattgcgttgctgtgtcagaagaaggatagctatactgattcggtagactctaaaaatacccttggtactttattgacgatctcacaaagatgtaatctcagtgaatttgaatttactgattcatcttttacagaatcgattccctacaagaatatctggagttcagtatgtctggaagcacaggagaacgttcttttgctgatattattaccagtattcgatactgggtcattcatagcattactataccttccctattcattgcgggctggttattcgtcagcaccggtttagcttacgatgtgtttgggagccctcgtccaaacgagtattttacagagagccgacagggcattccattaataacaggccgttttgattctttggaacaactcgacgaatttagtagatctttttaggaggacccaatgactatagataggacctatccaatttttacagtgcgctggttggctgttcatggactagctgtacctaccgtttcttttttggggtcaatatcagcaatgcagttcatccaacgataaaccgaattcaattatttatagagctatgacacaatcaaatccgaacgaacaaaatgttgaattaaatcgtaccagtctctattgggggttattactcatttttgtacttgctgttttattttcaaattatttcttcaattaaaattaagtaaaattaagaaaagagcgtagaataataaaataaaaaacaaagagtagtaattttcttatcccattcggatggattatatatcataattatctctgactgtttatgtttctagcatgaccactcgatgaaatgtggagggaagcgggataaatggctgatactactggaaggattcctctttgggtaataggtactgtagctggtattcttgtgatcggtttaataggtattttcttttatggttcatattcaggattaggttcatccctgtagaaattggatgaactgagttatagacgtgaaaacataagaactcaacggggcccaactcttccttctttgtctgattcgagggggtcccgttgaactgctaataataagaacaatttttatcgtgtttttgaaaaatgaacttaattagattagtaggttacgagcatatagtatttattattaacctttcaaagatcgaaaaaaagggggggggatcacttaattttatttttctgctttcccgactgacacaatattttttatcattagatctatcattaaaattttgtctatactcta

SEQ ID NO: 4761 - DNA, 3441 bp, Sorghum bicolor
ccgcaataactccttcctcccttctccacattctcttccacctccgtccgttcccctccccttcctcttcctctcctcccccttccatggccgccgcttagcttcgttctcaaggcctcctccctctcgccacacacctcctgctagctacccttctgagcttgcaaagttttgccgcatcacatcgatcttgagagctgcagcaggcagagatcgatcagagttctatttttgcagaggcacacaaacatatatagttcctgtatctgctagatctcactgccagccagctcgcagtgaagcttctctgggctaccttgtcgctagatctgttgctggtcgtgctgttacttggcaggcaaggtatacatctccatataggaataggattggcgccgcctgttttcttgggttgtgagggagatatactacgcatgtgccagtgaataaatgggaagcagctagtgaggaggcaataagaatcagggtttgagaggtcgcgagaggagaaatgatgatcccggcgaggcacatgccgccgatgatcgtccggaacagcgccgccgcgtacggctcctcgtcggcactctcgctcagccagccgaacctgctggacagccagcagcagctccagctccagcaggcgctgcagcagcagcacctgctggaccagatcccggcgacgacggcagagagcggcgacaacatgggccgcagcggcggcggccgggggtccgatccgttgatggggggcgacgagtttgagagcaagtccggcagtgagaacgtggacggcgtctccgttgacgaccaggaccccaaccagcgacccagcaagaagaaacgctaccaccgccacacccagcaccagatccaggagatggaagctttcttcaaggaatgcccgcacccggacgacaagcagcgcaaggagctgagccgggagctggggctggagcccctccaggtcaagttctggttccagaacaagcgcacgcaaatgaagaaccagcacgagcggcatgagaactcgcagctgagggcggagaacgagaagctgcgcgccgagaacatgaggtacaaggaggccctcagcagcgcgtcctgccccaactgcggcgggccggcggcgctcggcgagatgtccttcgacgagcaccacctccgcgtcgagaacgcgcggctccgggaggagatcgacaggatctccgccatcgccgccaagtacgtgggcaagcccatggtgtccttccccgtgctgtccagcccgctcgccggggcacgcccgtcgccgctggacatcggtggcggcgtggggggtgccgctgcgtatggcgctgtcgacatgttcggcggcggtgtcgctgtggacctgctgaggggtgccgtgccgcagtcggatgccgacaagcctatgatcgtggagctggccgtcacggccatggaggagctggtccggatggcgcagctggacgagccgctgtggaacgcgccgggccttgatggatctgctgaaacgctgaacgaggaggagtacgcgcacatgttccccggcgggctcggcccaaagcagtacgggttcaagtcagaggcatcgcgcgacagctccgtcgtcatcatgacccatgccaacctcgtcgagatcctcatggacgtgaatcagtatgcgacggtgttctcgagcatcgtgtcgagagctgtgacgctggaggtgctgtccactggcgtggcggggaactacaatggtgcattgcaagtgatgtcagttgagtttcaggtaccttccccactggtgccgaccagggaaagctatttcgtgagatactgcaagcagaatgctgatggatcatgggccgtcgtcgacgtctcgctggacagcctgcgccccaactcagtcctcaagtgccggcgccggccttcaggatgtctgatccaggaaatgcctaatggctactcaaaggtgacctgggtggagcacgtcgaggtggacgacaggtcagtgcacaacatctacaaactgctggttaactcagggcttgcctttggaccaccccggtgggttggaacgttagatccccagtgcgagccccttcccagtgtcatgcccagcaccattccgactagtgatatgggtgtgatcacgagcacggaggggagaaagagcatgctgaagctggctgagaggatggtgatgagcttctgcggtggagtgacggcctcagctgcacaccagtggactacgctctcaggcagtggtgctgaggacgtccgtgtcatgaccaggaagagcgtcgacgaccctggcaggccaccgggcatagtcctcaacgctgccacctctttctggctccccgtcccgcccaagcgtgtcttcgacttccttcgtgatgaaagctctcgcagcgagtgggacatcctctccaatggcggtgttgttcaagaaatggctcacatcgccaatggccgcgatcatggcaactgcgtctcgcttcttcgtgtcaatagcaccaactcgaaccaaagcaacatgctgatcctgcaagagagctgcactgacgcatcaggctcgtacgtcatctatgcgccagtggatgtggtcgcgatgaacgtggtcctcaatggcggcgaccctgactatgtggcactcctaccctctggctttgccatccttcctgacggtccggcaggcagcaacatgcaaggcgatggtggtgttggctcaggtggatcgctcctgacggtggcgttccagatactggtcgactccgtccccacagccaagctctccctggggtcggtggcgacagtgaacagcctcatcgcctgcaccgtggagcgcatcaaggcggcggtctctggcgagagcaatccccagcagtaactttgttgaatcaaacagtgttcttatcctttgcattgaaggagcagcaaattttagagctttcatcagtgggaagtcaagaacgcacctcagactctccttgccatgtggtgctcatagtttgggttatttttcgcctagttttcccagaatttctgggtattattccatttcagtcaccgaagaaaatgagtcaccactacgcaagggtagttggttcgggtattgacttcctcttcatgttggcctctcggatgctgctacctctgaatttaggcttctttttcttctcttgtggagtacaaaaccgttatttagcatgtaatttgtgctgttgctgcagttgttcagactttcagtatcctggattccccaaatagagatttgtttcccttaggttttatacttctgcagtgcttcttaatgtctagccatcatttcagtaccaaacgtgtctgtaacgtggttgcatgcatacttgcgttattgttgaatgtcttcgatgctattttgcagctttaggttctgaattaatttagtgatatggccatggaatgcca

SEQ ID NO: 4762 - DNA, 1916 bp, Secale cereale
gactcatggtcgtgcttcttcttcgtcttccccgcaaatcaaccagcgcctcttttcccgatctcctagcttgctacctaccgctgcatggataaatcataaatggattgctggattcgatgctgtggatgagcttcccctccctctatccgatccgtcaccccaccgctcccctcgcttcctcctatccaccgtctcctcctacctcacctcacctagctagcaccactagaaactagtagtatcaattgctatttcagctgggcgactctcccaatcttggtccattccatccgactctcggccgatcggcgggacgaagaacacagacggatcattgtgcgcgttgatgcgtgcaagcgatctagtcgctcaagatgaagagcagcagcaatctcgaggccttcctccaggccgccacgccgctgctcccatggcgctccgccaccatggaacggttccagggcgcgcccagcagcgtgtggcagcagccggacggcaagaacaaggacgcggtggagtacttcgcgctgtccgacctgtgggagcactacgccgagagcagcgcctacggcctcgccgtgcccgtccgggacgccggtgaccgcggcgccctggtcaccacccagcacttcgtcccctacctctccgccgtccagctctacaccgccacaaagcccacctcccacacactcggcgccacctccaggagcacggggagcgagacggattcgtggagcgacgacagcgtgggcggcgacaggttcgccagctccgggtcctcctcctgggacgcggcgtcggacgaagacgattcttcctccacctacgacggcaacggctccaccggcgtctcagcgaagcagagcgggtacctgaactttcagtacagggagtgggactcgccctacgagagggtgccgctggctcacaaggtggcggagctagctcaggattacccgtgcctgacgtcgctcagcagcgcggagctctcgccgtcgagctggatgtccgtggcatggtacccaatctatcacatccctgctcatgtcaacctcaagggtacctctgcctgcttcctcacctaccattccctctcatccgtcttccaagacaacatacacagcggaccggaacacgacgatggtgagatcgccgcgctctcgccgttcgggctggccacgtaccggatgcaaggggatttgtggaggaggccagggtcatcagaccccaggaggttgtctgagctccattgggcggcgtcctcctggctgaagcaagtcggcgcgcaccatcctgacttcaccttcttcacgtcgtctcaccgtcgatgacacggcaccttgttgattcccatgtgtttcggtgcattgcacaggagacgggacaatgtgaagatatgacacaaagaattgcatgtaggatttgatagaacaacacgcaatgggtttttgttcttcctcttctctctgaacttgcaggaagatacagtaatttgttgaaccggtctgtgtggaattgagtggccaggcgaatggcctttgttttcttcattgacgggcatgcatcatggaggtgcagacataacgttctcaagaatttgcagttcatgaaatgtggcctcggtggatatgtttagagtgtaatccacctagttttacatgttggattcactgtacttcactgccttacgacattctccgtcatgtaccatgtctcctatttggagtacaaagatggaggagaaatacatgatctttggcgatgttgttaggagaattattgttttgaattcacttcattttttcaagtttaaaagtaaaaaaaaaaaaaaaaaaaaaagaaaaaaaaaaaaactaaagagaactagaccaaaggacgaacaacgaagggaagtaggaggggggggggggggg

SEQ ID NO: 4763 - DNA, 1644 bp, Triticum aestivum
gcatggataaatcataaatggattgctggattcgatgctgtggatgagcttcccctccctctatccgatccgtcaggccaccgctcccctagcttcctcctatccaccgtctcctcctacctcacctcagctagctagcaccactagaaactagtagtatcaattgctatttcagctgggcgactctcccaatctcgatccattccttccgattcttgcccggtcgatcgatcgcgggacgaagaacagcacgcagatcattttgcacgttgatgcgtgcaaactgtctgattgctgaagataaagatgaagagcagcagtaatctcgaggccttcctccaggccgccacgcccctgctcccatggcgctccaccaccatggaacggttccagggcgcgcccagcagcgtgtggcagcagccggacggcaagagcaaggacgcggtggagtacttcgccctgtccgacctgtgggagcactacgccgagagcagcgcctacggcctcgccgtgcccgtccgggacgccggtgaccgcgccgtggtcaccacccagcacttcgtcccctacctctccgccgtccagctctacaccgccacaaagcccaccactcacaccctcggcgccacctccaggagcacggggagcgagacagattcgtggagcgacgacagcgtgggcgacaggttcgccggctcagggtcctcctcctgggacgcggcgtcggacgaagacgattcttcctccacctacgacggcaacggctccaccggcgtctcagtgaagcagagtggatacctgaattttcagtacagggagtgggactcgccctatgagagggtgccgctggctcacaaggtggcggagctggctcaggattacccatgcctcttgtcgcttagcagcgcggagctctccccgtccagctggatgtccgtggcatggtacccaatctatcacatccctgctcatgtcaacctgaagggtacctctgcctgctttctcacctatcattccatctcatcagtcttccaagacaacatacatagcgggccggaacacggtgagggtgagatcgcggcgctctcgccgtttgggttggcaacctacaggatgcaaggggacctgtggaagagaccagggtcatcagactataggaggttgtctgagctccactgggcggcggcctcctggttgaagcaagttggtgctcaccaccccgacttcaccttcttcacatcttctcaccgtcgataacacggcacccggtcgattcctcatgtgtttcgatggcattgcatcgggcaatgtgaagatatgacaccaaaaacttcatgtaggatttgatagaacaacacgcattggatttttcttctttctgaacttgcaagaagattcagtaacttgttgcatcgaccttctggattggattaagtgtcagacagcatgctctgttttttcctcatcgacgggcatgttatagctgcaaaacaacattttcatataattgcagctcgtgaaatgtgacctcaatggctatagtttaacaatccaccaggtattacctgctgggctttgactgtattcattgtcttaacaacactcagcaacctgtacatatatagcatgtaagtatagttttta

SEQ ID NO: 4764 - DNA, 1438 bp, Secale cereale
ctaaaccccctggaaggagggaggaaatccctaataacccccggtcgcctttccacggcgaaaggtatcccggcggcgatggcggcggctgcggcaaggtccggatcccggcgcttgttctccatatccgccctgctgccaccgaagccaccgacccctcccccgaaggcagatcccttcgccagcctcttcgttcccgggttaagcaagcgaacaacaactgatggacttagggaagcttttgcaaagtctggtgaagttgcgcatgcatcatctgtaaaaaattcaaggtggtatatgatcaatgcaaaccggtcaggtcctttgacagtgcgtaaagaataccgcaaagtgcttccttctttcataaggccatctgcatcttactccacagaagcctcaggaaaaagaccaaaacaggagagaacagacttgacgactgttgaagatccctttagtgcccctacctacaatatacctgagaagccagtgacatttgtcgagggggcctcttacagtgttgtaatacttgctgggcttggagttgctgcattggctggatatgctgttttgaaagagcttatatttgagccaaaagagtacaagatttttgggaaagctctagcaagagttcagagtgatagtcaggttacagccaaaattggttaccctataaccggttatggtacggaatccagaaaccgtgcagctcggcagcgcatccaaaacagggtttggacagatgaggatggtgttgaacatgtggaggttggctttcacatccgggggccgcatggagctggaaaggtgtttgcggagatgttcaaagatagttcggacaggacatggaagttcacatttcttctcgtcgagattacgtcaccgcgacccgcacaaatcatgttagaatcttacctaccagcataaggatgcatgagaaacatcagctagcagtggcgcatccatccgacaccttctttttacgtgatatatctccagtggcctgcatcatgttaaatacccgtcctcggattaaagaggttgtgaattttgaacttcccccaaagcataagtaggaggaagatgaaccatcagagctgctgaccatctctagtatcttagtatggtgtaccgtgcaaggacctccatgttgttcctttgtttagctgaaaggcgtgcaggcacatgtatacaacccatctttcctgacgctcctcaaacatgggacggagcaagtgatccttcatctatcgagttttggtcccatttcaggcagttttataattatgcctatggatttcgtgcaaacctccgatggtatccaaataacaataatatgtaccgtctttggttacatatacttacattacgactctcaggcgtagggtttcattcaggaatgtatttagtgatcttcaatacaagtattgctcaaatt

SEQ ID NO: 4765 - DNA, 1252 bp, Picea glauca
ccctttataaagtcgatatattagggtttttatctcttccttcgaatcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacggagacgattgagttacagattggccttaagaattatgatccgcaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaggatttttccttggtttttgttttgcgttggtcagaacattacatttttgtttgtgtggaggggtatgttagccaagtggctttaatctcatgcatttgggagtaaaagggaaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattgtccatgcaggagagatattagaaaatgattgatatattcctggtttgatttctgaaattggcattacaaggcgtactgtgaacaccgaaaacaaactagaaaatggtatacctgtttctgttaattatgttttattcactaacattattaacaaactggc

SEQ ID NO: 4766 - DNA, 1127 bp, Picea glauca
attcacatgtgaacataagtgggatttgtgcaaaaccctagcttggcctcaggattttatttgtgactattcgagggtcgtttggagaagagcagcagtaggacgacgaagaagaggcagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaggatttttccttggtttttgttttgcgttggtcagaacattacatttttgtttgtgtggaggggtatgttagccaagtggctttaatctcatgcatttggagtaaaagggaaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattg

SEQ ID NO: 4767 - DNA, 1238 bp, Picea glauca
agagatattgaccaaaatataggatctcactcggggtcacaaaaaaggccatagaaggtgtatacgaggaaaccgaaccctaatcaatgattttcacatgtgaacataagtgggatttgtgcaaaaccctagcttggcctcaggattttatttgtgactattcgagtgtcgtttggagaagagcagcagtaggacgacgaagaagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaatgaaacaaaagcaacggttaagtttcagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaagatttttccttggtttttgttttgcgttggtcagaacattacatttttgtttgtgtggaggggtatgttagccaagtggctttaatctcatgcatattggagtaaaagggaaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattgtccatgcaggagagatattagaaaa

SEQ ID NO: 4768 - DNA, 1196 bp, Pinus taeda
gcaaaaccctagcctggccttcatagtatcatatttgttatctttgcagtgtcaattggacgagggcagcacgagaacgaccaagaggcacaggcagaggaagcaaggcgctccttacctgtaaacaatgagtaaacttcagagcgacgtgttgagggagggaataagtcaggtaatgggtgaaagcaaggacaaaaagcgaaaatttacagagacgatagagttacagatcgggctgaagaattatgacccccaaaaggacaagcgtttcagtgggtccgtaaaattgccccacattccccgccccaagatgaaggtctgcatgctcggagatgcccaacacgttgaagaggctgagaagatcagtctggactacatggatgttgagggtctgaagaaaatgaacaagaataagaaacttgttaagaagcttgctaagaagtaccatgcatttcttgcttcagaagcaattattaaacaaattccaagactccttggacctggtctgaacaaggcaggtaaatttcccactcttgtttcacaccaagagtccttggaggccaaagtgaatgagacaaaggcaatggttaagtttcaattgaaaaaagttctatgtatgggggttgctgtggggaactgtggaatggaggagaagcaggtgtttcagaatgttcaattgagtgtgaacttcctggtatccttgctgaagaaaaactggcaaaatgttcgatgcttgtatctgaagagtaccatgggcaagccagcacgtgtattctgagtagtgcaattttggtgccagcttgtgttggttgcatatggagaggacttttccttgtttttttgttacgttggtcaggacattacatttttgtttgtgtttaggggtatgttagccaagtggctttaatttcgggcattttggagtaaaagggaaatttaattattattttactattctgttattgtaacttcggcatgcttctctttctttattcaagtaatcagaattgagtagatactaaacccagtttttttctacttttgaaataggcatattcattagtgtatgccggagagaactgtgattgtttgatatattcctggtttgatttctgaaatggacgttacaggcatactgtgaatactgaaaacaaactagaagagggtatacccgtttctgttaattaagttttatt

SEQ ID NO: 4769 - DNA, 1054 bp, Pseudotsuga menziesii
tgagtaagcttcagagtgatgtgttgagggagggaataagtcagattatgggagaaagcaacgacaagaagcgaaaatttactgagacgatagagttacagatcgggttgaagaactatgatccccaaaaggataagcgtttcagtggttccgtaaaattgccccacattccccgccccaagatgaaggtctgcatgctcggagatgcccaacacgttgaagaggctgaaaagatcagtctggactacatggatgtcgagggtctgaagaaaatgaacaagaataagaaacttgttaagaagcttgcaaagaagtaccatgcatttcttgcttcagaggcaatcataaagcaaattccaagactccttgggcctggtcttaacaaggctggtaaatttcccactcttgtttcacaccaagagtccttggagtccaaggtaaacgaaacaaaggcaacggtcaagtttcaattgaaaaaagttctatgtatgggcgttgctgtggggaactgtggaatggaggagaaacaagtgtttcagaacgttcaattgagtgtgaacttcctggtatccttgctgaagaaaaactggcaaaatgtccgatgcttgtatctgaagagtaccatgggcaagccagcacgcgtattttgaatgtgcaatattggcaccaccttgtgttggctgcatatggagaggacttttccttggtttttgttttacgttggttagaacaatacagttttgtttgtgtggagggctatattagcgaagtggctctaatctcgtgcatattattggagtaaaagggaaatttaattattatttcactattctgttattgtaacttggcatgttttatcagtcatgccgcgggaagttatgtttatctcttcctggattcaagtaatcagaattgagtagatactgaacccagcttatcattgttcttaatttgacagtcatatttattattgtgcattcagtaaagtacttaaaaaatggtagatgtattccccagtgtgatttatgaaattgacataacaggcatactgcga

SEQ ID NO: 4770 - DNA, 1816 bp, Picea glauca
  misc_feature (1147)..(1147): n is a, c, g, or t
attccatgtgaacataagtgggatttgtgcaaaccctagcttggcctcaggattttatttgtgactattcgagtgtcgtttggagaagagcagcagtaggacgacgaagaagaggcagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaggatttttccttggtttttgttttgcgttggtcagaacattacatttttgtttgtgtggaggggtatgttagccaagtggctttaatctcatgcatattggagtaaaagggaaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattgttcatgcaggagagatattanaaaacctcagctcaaccatttctatttattttttgaaagaattgtgaggttacgctgcccttgtctttgaaatttttgtttggagaagatgtctcaggaaaaacagcatcaccatctattccaccgcaaggaagatggtgatgagcaggtaccccagagcgcagatatgtatggtgcggggaatgatgagactgttgatcacgagaaggcattgaaggaggaaaaatatcacaagcatatggaggaattgggtggactgggaatagtgggtaccggaggctttgcattgcacgagaagcacgaagaaaagaaggatccagagaacgcgcgcaggcacaagattgaggaggaggttgcagcagcagctgcagtgggagaagggggttacggttttcatgagcatcacgataaggaggagtccaaagaggaagctaaagaaacagacggaaaaaagcatcaccagcttttctagctgaccagtgtcacttgtgcatttaaaatactgttctcttcctctgttatttggatttggtgtgatattgttatgagattcagatcaagctgaagtcagtcttgctcatatctcttagatcgataagcttggattacctcgttctgtactgattctaatatatatagatattgtgaaaatttagttgtaaaaaaaaa

SEQ ID NO: 4771 - DNA, 1102 bp, Picea glauca
ggagaagagcagcagtaggacgacgaagaagaggcagaggcagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcaagttgaaaaaagttctatgtatgggggttgctgtggggaactgtggaatggaggagaaacaggtgtttcagaatgttcaattgagtgtgaactttctggtatccttgctgaagaaaaactggcaaaatgtccgatgcttgtatctgaagagtaccatgggcaagccagcacgcgtattctgagttttgcaatattggtgtcagcctgtgttggctgcatatggagaagatttttccttggtttttgttttgcgttggtcagaacattacatttttgtttgtgtggaggggtatgttagccaagtggctttaatctcatgcatattggagtaaaagggaattaattattattttactattttgttattgtaatttggcatggtttatcagtcatgctgctggaagatatgtttatctcttcctttattcaagtaatcagaattgagtagatactgaaccaagtttattattgttcttaatttgacataggcatatttattattgtccatgcaggagagatattagaaaatgattgatatattcctggtttgattt

SEQ ID NO: 4772 - DNA, 1008 bp, Cedrus atlantica
acagaggaagcaaggcgccccactctgtaaacaatgagtaagctccagagtgacgtgttgagggagggaataactcagattatgggagaaagcaaggacaagaagcgaaaatttacagagacgatagagttgcagatcgggctgaagaattatgatccccaaaaggataaacgtttcagtggctccgtaaaattgccccacataaccccgcccaaagatgaaggtctgcatgctcggagatgcccaacatattgaagaggccgaaaagatcagtctggactacatggatgttgagggtctgaagaaaatgaacaagaacaagaaacttgtaaagaagcttgcaaagaagtaccatgcatttcttgcttctgaagcaattattaaacaaattccaagactccttggacctggtcttaacaaggctggtaaatttcccactcttgtttcacaccaagagtccttggagtctaaggtgaatgaaacaaaagcaacggttaagtttcaattgaaaaaagttctatgtatgggggttgctgttgggaactgtgggatggaggagaagcaggtgtttcagaatgttcaattgagtgtgaacttcctggtatccttgctgaaaaaaaactggcaaaatgttcggtgcttgtatcttaagagtaccatgggcaagccagcacgcgtattctgaatgtgcaatattggtgctgtttgtgttggctgcatatggagaggacttttcctaggtttttgttttccgctggttagaacaatacatttttgtttgcgtggaggggtatgttagccaagaggctttaatctcatgcatattggagtaaaaggaaatttaattattattttactattctcttgttgtaacttggcatgttttatcagtcatgctgctggaagtttttgtttctcttccttaattcaagtgatcacaatgcagtagatactgaacccagtttattattgttcttaatttgactataataggcataattattattg

SEQ ID NO: 4773 - DNA, 1038 bp, Abies balsamea
acgacgaagaagaggcggagacaggaggaaggcgcccccttctgtaaacaatgagtaagctccagagtgacgtgttgagggagggaataactcagattatgggagaaagtaaggacaagaagcgaaaattcacagagacgatagagttgcagatcgggctgaagaactatgatccccaaaaggataagcgtttcagtggatccgtaaaattgccccacattccccgccccaagatgaaggtctgcatgctcggagatgcccaacatgttgaagaggctgagaagatcagtctggactacatggatgttgagggtctgaagaaaatgaacaagaacaagaaacttgtaaagaaacttgcaaagaaataccatgcatttcttgcttcagaagcaatcattaaacaaattccaagacttcttggacctggtcttaacaaggctggtaaatttcccactcttgtttcacaccaagagtccttggagttcaaggtgaatgaaacaaaagcaacagttaagtttcaattgaaaaaagttctatgtatgggggttgctgtgggtaattgtggaatggaggagaagcaggtgtttcagaatgttcaattgagtgtgaacttcctggtatccttgctgaagaaaaactggcaaaatgtccgatgcttgtatctgaagagtaccatgggaaagccagcacgtgtattctgaatgcgcaatattggtaacatttgtgttggctgcacacggagaggactttctcttggttttgtttttatgttggttagaacaatacatttttgtttgtgtggaggggtatttcagccacacgtggctttaatctcatgcatattggagtagaagggaaatttaattattattttactattctgttattgtaacttggcatgtttgatcagtcatgctgctggaagttatttttatctcttcctttattcaagtaatcagaattgagtagatactgagtccagtttattattgttcttaattcgacattaaaggcatatttattattgtgcatgcagga

SEQ ID NO: 4774 - DNA, 1255 bp, Pinus pinaster
agacacatagaccaaactacaggatctgactcggactccaatcaatggtattaacatgtgaacatgagtgggttttgtgcaaaaccctagcctggccttcatagtatcatatttgttacctttgcagtgtcaattggacgagggcagcacgagaacgaccaagaggcacaggtagaggaagcaaggcgccccttacctgtaaacaatgagtaagcttcagagcgacgtgttgagggagggaataactcaggtaatgggagaaagcaaggacaaaaaacgaaaatttacagagacgatagagttacagatcgggctgaagaactatgacccccaaaaggacaagcgtttcagtgggtccgtaaaattgccccacattccccgccccaagatgaaggtctgcatgctcggagatgcccaacacgttgaagaggctgagaagatcagtctggactacatggatgttgagggtctgaagaaaatgaacaagaataagaaacttgttaagaagcttgctaagaagtaccatgcatttcttgcttcagaagcaattattaaacaaattccaagactccttggacctggtctgaacaaggcaggtaaatttcccactcttgtttcacaccaagagtccttggaggccaaggtgaatgagacaaaggcaatggttaagtttcaattgaaaaaagttctatgtatgggggttgctgtggggaactgtggaatggaggagaagcaggtgtttcagaatgttcaattgagtgtgaacttcctggtatccttgctgaagaaaaactggcaaaatgttcgatgcttgtatctgaagagtaccatgggcaagccagcacgtgtattctgagtagtgcaattttggtgctagcttgtgttggttgcatatggagaggacttttccttgtttttttgttacgtttggtcaggacattacatttttgttttaggggtatgttacccaagtggctttaatctcgggcattttggagtaaaagggaatttaattattattttactattctgttattgtaacttcggcatgcttctctttctttattcaagtaatcagaattgagtaaatactaaacccagttttttttgtacttttgaaataggcatattcattattgtgtatgcgggagagaactgttattgtttgatatattcctggtttgatttccgaaatggacgttacaggcatactgtgaatactgaaaacaaactagaagagggtacacctgtttac

SEQ ID NO: 4775 - DNA, 1163 bp, Picea glauca
aaacgatagtagaagaggatctatttcatcactttgagaataccaaatttcttgggatataaagatgcatataaatatttgtgaccctcccactaaccatagagatattgaccaaaatataggatctcactgggggtcacaaaaaaggccatagaaggtgtatacgaggaaaccgaaccctaatcaatgatattcacatgtgaacataagtgggatttgtgcaaaaccctagcttggcctcaggattttatttgtgactattcgagggtcgtttggagaagagcagcagtaggacgacgaagaagaggcagaggcagaggcagaggaagcaaggcgcccccccctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaaacgtttcagtggatccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcagaagcaattattaaacaaattccaagacttcttggacctggtcttaacaaggctggtaaatttcccactcttgtttcacaccaagagtccttggagtccaaggtgaatgaaacaaaagcaacggttaagtttcagttgaaaaaagttctatgtatgggggttgctgtgggaaactgtggaatggaagaaaagcaagtttttcagaatgtgcaattgagtgttaacttccttgtatcactactgaagaagaactggcagaatgtaaaggtgcttatatttgaagactaccatggaaagcctaaccgcatttctgagtgcggaacagagtggagatatttcaatggcacttccttttgtataactattaaacataggttatgttatttagtttcgaccaaacaaatcaatttaatgcaactacttacgaattgaggaagagatgtgctggtaaattgctgttttgaacaataagagt

SEQ ID NO: 4776 - DNA, 796 bp, Picea glauca
cggtttggagaagagcagcagtaggacgacgaagaagaggcagaggcagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccggtaaaattgccccacattccccgccccaagatgaaggtctgcatgctcggagatgcccaacacattgaagaggctgagaagatcagtcttgactacatgggtgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcatttctgagttttgcaatattggtgtcagcctgtgttggctgcatatggagaggatttttccttggttt

SEQ ID NO: 4777 - DNA, 865 bp, Zostera marina
gggggaaaggcgccattgtttgtttattcgagggatttcattagaggggatctctaaagatgagtaagttgcagagtgatgttttaagagaggctattggacaaatcactgctgcttgcagtgataagaagcgcaattttacagaaaccattgaacttcagattggattgaagaattatgatccccaaaaggataaacgtttcagtggttcagtcaagctcccacatattcctcgtcccaaaatgaaagtttgcatgcttggggatgcccaacatgttgaggaggcttctaagatttcattgtcctcaatgagtgttgaagatctgaagaagtttaacaagaacaagaagttggttaagaagatgtcaaagaagtatcatgcctttcttgcctcagaagctgtgatcaagcagattccacgtcttttgggtcctggactaaacaaggcaggaaaattcccaacccttgtatcccaccaggagagtctagaggcaaaagtaaacgagatcaaagccacagtgaaattccaactgaagaaagtgctttgcatgggtgttgctgtaggtaatgttggaatggacgaaaagcaaatattccagaacgtccagctttctgtcaactttttggtttccttactgaagaaaaactggcagaatgtgaagtgtttgcacttaaagagcaccatgggaaagccgtttcgcttgttctgatctatttatgttcttaattccttaaaatgtcagacaattttcttatttatttattgttgagaattgagatcaacatttttctgtttttgcacaacctttactattttgtttgttaaacaattcaagaacaattccttatgagttatgatagtgtc

SEQ ID NO: 4778 - DNA, 652 bp, Picea glauca
aaattcacagagacaatagagttacagatcgggctgaagaactatgacccccaaaaggacaagcgtttcagtgggtccgtaaaattgccccacattcccgcccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcagttgaaaaaagttctatgtatgggggttgctgtggggaactgtggaatggaggagaaacaggtgtttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttccttttgtatactattaaacataggttatgttatttagtttcg

SEQ ID NO: 4779 - DNA, 489 bp, Setaria italica
atgtatccggcgaagcccagcgacgcggcggcggcggcgccggtgaccggcgtccccgtgggcggcccgcctgtcgccgccggcaacgccaccagccagtggtcctcggggctcttcgactgcttcgacgactgcgggctgtgctgcctgacgtgctggtgcccgtgcatcacgttcgggcgcgtcgccgagatcgtggaccggggcgcgacgtcgtgcgggacgagcggggcgctgtacgcgctgctggcctacctcacggggtgccagtggatctactcctgcacctaccgctccaagatgcgcgctcagttcggcctcccggagaacccctgctgcgactgctgcgcctgcgcgctctgccagcagtacaaggagctcaaggcccgcggcttcgaccccgaactcggatgggacctcaacgcccagcgcggcgccggcgccggacaagccatgtacgcgccggcggcacaggggatgggccgctga

SEQ ID NO: 4780 - DNA, 1339 bp, Pennisetum glaucum
tcctcacaaacatctcatctcccggggggcacagcagagaattggagttgcttctctcctcctcctcctcctcctccaccgttcttgttcttcgccggcgtgcagcggccatggctaggaagtgctctagctgtggcaacaatggccacaactcgaggacatgcggtgggcacggcagggtcttgatggagaacggcggcggcggcggcggagtgaggctgttcggggtgcagctgcacgtggggtctccctcctctcccatgaagaagtgcttcagcatggactgcctgtcgtccgcggccccggcggcgtactacgcggccgccctcgccgccagcagctcctcgccgtccgtgtcgtcgtcgtcgtcgctcgtctcggtggaggagaacgccgagaaggtcgccaccaacgggtacctctcggacgggctcatgggcagggcgcaggagaggaagaagggggttccatggactgaggatgagcaccgaagattcctggcaggcctggagaagctcgggaagggcgactggcgaggcatctcccggcacttcgtgacgacgcggactccgacgcaggtcgccagccacgcccagaagtacttcctccggcagggcagcctcacgcacaagaagcggcgttccagcctcttcgacgtcgtggagaacgccgacagggcggcgacgagcgcgagcgagcgtccgagactgagaggcgcggcggcgggctcgtcggcgccgccggacacggagctcccggctctgtccctcggcatcaccagccggccggcgaagcagcccgagcgcgtgctgccgccgagcctgtcgtctcccctgcagctgccacggtgctcgtcggcgatgagcagcgggagcgggagcacgtcgccgtgcctggccgcgccgagacagcagaagcaccctgcttcgtccctgacgctgccaaagcctcatcaggtgagcctccaccagcttgcgccgccggacctggagctgaagatctcgacgcccaccgaccaccaggccggctcgtcgccgaggacaccgttctttggtaccatcagggtcacgtaaccggaaaggtgatctacgacggtcggttggaacatccgttgccggaagagctgcttgttgctcatctggatggagacgatgaacaaacacggtggggagggaaaaggatcaaaggaggagccttccgccggtatggtggtgtatgtgtgagatgctggcgacagccgccgccgccgtccgtgccgtcttgtactcctgttgatgtatgtatcatcagaagatgaaactttactggcctaattttagacgtgcaaataaagaacggc

SEQ ID NO: 4781 - DNA, 1724 bp, Setaria italica
caccagccaccatggctgcggccatggcgtcgctcccgctgcacctgctcctcctcctcccactccttgccgtcgtctcattcctgtggctccaccgtgcggtgtcgcgccggcgagggcgaggcggcggcgcgcggctgcccccgtcgccgtgggcgctcccggtgatcggccacctgcaccacctcgcgggcgcgcttccgcaccgcgccatgcgcaacctcgcggcgcgccacggcgagctcatgctgctccgcctcggcggtctccccgtcgtcgtcgcctcctccgcggacgccgcccgggaggtgatgcgggcgcgcgacctcgacttcgcgacgcgccccgtgacgcggatggtgcggctggtcatccccgacggcgccgagggcatcatcttcgcgccctacggcggcgggtggaggcagacccgcaggatctgcaccgtcgagctgctcagcgcccgccgcgtccagtccttcaggcccgtccgcgaggaggaggccggccggctcctccgcgccgtggcgtcggcggcgccgccggcgtgggcggtgaacctgagcgagctgctgtccgtgtacgcggccgactcctcggtgcgcgccatcatcgggagccggttcaaggaccgggacacgttcctggccatgctggagcgcgggctcaagctgttcgccaagttgagcttgccggacctcttcccgtcgtcacgcctcgccatgctcgtcagccgaatgcccggccggatgaagcagcaccggcaggagacggttgtgttcatggacgccttggtccgggaccacgaggagagcagagcagctgacgacggcgacggcaaggaggacctgctcgacgtgctcctgaggatccagacggaaggcgatctgccggtgccactcaccactgacaacatcaagtcagtggtcggagacatgttcgccggaggcagcgagacggcggcgacggcgctgcaatggatcatggccgagctcatgaggaacccgagagtgatgcagaaggcgcaagacgaggtccgacgagcacttgccggacggcaaacagtaacagaggatgaccttggcgatctccattacatgcgcctagtgatcaaggaggctcttcggctgcatccacccctgccacttctacttccacgagagtgccggaactcatgccaggtgctaggattcgacgtgccagcaggcaccatagtgttcgtgaacgcgtgggccatcgccagggaccccaaatactgggacaagccggaggaatttgtgcccgaaagatttgaggatggcaagattgatttcaaggggacggacttcgagttcataccgttcggggcgggacggaggatgtgcccgggaatggcgtttgggctcgtgcatctggagcttgcactcgctggcctcctttaccattttgattgggagctcccgcttgggatggaggctgcagatctggacatgacggaggaaatgggagtcacggcccggcggcttcaagacctccggcttgttccagtagttcgagtgcctgtgccggtggaatagatgtaggagtgttttatttgtgttctttggtgcagccgtagtgttgggaacatgagcttctaatatactacctcgttcataaatatataatgcttagataaagctagttaattaaaaaatgaggcacatgagggctaaactttttttctttgaaatggagggctaaac

SEQ ID NO: 4782 - DNA, 1884 bp, Sorghum bicolor
aaaaaattttcattgccaatctaaacaggcccttaagccttgagcgatgagaggtgctccttccttcctccttccttccagttccattcgacaagcaccaagccgccatggaattagtggcgcttccagtccacctactcctccccctccccatcctggccgtcgtctccttcctctggctcaggcgtgcagttttgggccgtcgaggcggcggtccgcggctgctaccgtcgccatgggcgctcccagtgatcgggcacctgcaccacctcgcgggcgcgctcccgcaccgcgccatgcgtgacctggcggcgcgccacggccccgtgatgctgctccgcctcggcgggctccccgtcgtggtggcctcctccgcggacgccgcgcgcgaggtgatgaaggcgagggacatcgaattcgcgacgcgccccgtgacgcggatggcccggctggtcatccccgagggcgcggaggggatcgtcttcgcgccctacggcgacgggtggaggcagacccgcaagatctgcaccgtcgagctcctcagcgcccggcgcgtccagtccttccgccccgtccgcgaggacgaggccaggcggctcctccataccgtggcgtcggcgccgcgcccgcgggcggtgaacctgagcgagctgctggccgtgtacgccgccgactcctcggtgcgcgccataatcgggagccggatcaaggaccgggacacgttcctggccttgctggagcgcgggctcaagctgttcggcagcatgagcttgccggatctctacccgtcgtcacgcctcgccatgctcgtcagccggatgccgcgccggatgaagcagcaccggcaggaagcggacgcgttcatggacgccatggtccgggagcacggcgagagcagagcagccaacgacgacgacgacgacaaggaagatctgctcgacgtgctgctgcggattcagagggaaggtggcctgcagtttccactcaccactgacaacatcaaaacagtgatcggagacatgttcgccggaggcagcgagacgggtgcgacgacgctgcagtggatcatggcggagctcatgaggaacccaagagtgatgaagaaggcacaagacgaggtccggcgagcgctcgccgtcgccggccggcagagagtaacagaggacgacctgagcaatctgcactacatgcgcctggtcatcaaggagggcctccggctacacccacccttgccgcttctgcttccacgagagtgccggagctcatgccaggtgctgggattcgacgtgccggcgggcacagtcgtgttcgtgaacgcatgggcgatcgggagggaccccagctcgtgggacaagcctgaggagtttgtgcctgagagatttgaaggcagcggcgtcgacttcaaggggacggacttcgagtacgtgccgttcggggcaggacgaaggatgtgcccgggcatggcgtttgggcttgtgaccatggagcttgcactggctagcctcctgtaccattttgactgggagctgccgcctgggatgacggccacggatgtagacatgacggaggaaatgggggtcacggctcgacggctccacgacctcttgcttgttcccttcgtccgaatgcccgtgcccatgacctagctaggtccagcagcaggagaatccgaaaaacttgtattcgtccattttaaataaggccttgtttagttccgaaaagtgaaaagttttcggtattgtagcactttcgtttgtttgtgataaatattatctaatcatggactaactagaatcaaaagattcgtctcgtgatttacagctaaactgtgtaattaatttttgttttcgtctacatttaatgttttatgcatgtgtcacaaga

SEQ ID NO: 4783 - DNA, 4424 bp, Sorghum bicolor
atggcccccggcgggcgccggcgcgggattgccaccttcgccgctgcggcgatcgctctgatgcagatcagttctctactgttcccgatcagcgcacagcaattcagtggctcaagagttgtaccagcagaaggttactgttccatgtatggcatctgtgcgcaacgaagtgatgggaaggtcttaaactgtgcgaatgcaaccaaagctgttaagccagacactttgttttcttcaaggatccaaagtttgtgcccaacaatcactggcgatgtctgttgtactgtagatcagtttgacacattacaccaacaagtccaacaggctgttccatttcttgttggatgcccagcatgcttgaggaatttcttgaatctcttctgtgagatgtcttgttctccaaaccaaagcctcttcattaatgtgacttcagtaaagcagattaatagcactatgactgtcgatggcttagattactatgtaactactaactatggtgaagagctatatgactcatgcaaggatgttaagtttggcactctgaacacccgtgcaatggattttattggtgctggtgctaaaacttacaaagattggctggcatttattgggcgacaagcaaactctaatgagccagggtcaccttatttgataacatttcgatcggattttagtgattcttctggtgtgaagcctctaaattctacaatttattcttgtggcgacccttctctgggttgttcatgtggtgattgcccttcttcttctgaatgcacgggatccttgctacctcagctgaatacagaaacctcctgttcagttaaaatgggatctttaaaggccaaatgcttggacttctcactagtggttatttaccttgcgttactatgcgcttttctgctatggggtttgttacacagaacacgaggaagaactgctttcgggcaaacaagaccgttgaggaattcagataataagtcagactcgaacaaaaatggcaagagccctcataactcggttcaggtgcccgaagctgcatcctctactgtcaaaccatccaatccttctattgttcaagcttacatgtcaattttctttaggaagcatggaatttttgttgctagacaccctctccttgtgttatgtgtgtcattgcttgtccctgtcctcttatgcattggtctctttcgcttcaaggtggaaacccgaccagaaaagctttgggttagccctggaagtcaagctgctgatgagaagaattattttgacagccatctcgcaccattttataggatcgagcagcttgtgttggccacttctgcatctggtgggtccgaagctccttcaatagtaaatgacaacaatatgaaattactttttgacgttcagaaaaaggttgatgatctacgtgtaaattattctgggtctacagtagcccttgctgacatttgcttaaagccactcagtacagactgtgctactcaaagtgtcttgcagtatttccagctggatcctaaaaagtttgatgattctggaatagaccatgctaagttctgttttcagcattacacttctgaagagacatgtttgagcacttttcagtcacccattgatccaagtacaattttaggtggttttctaggaagcaattttaccgaggcttcggcatttgtaataacttatcctgtgaacaacaaggttgaaacaacaggaaaagagaacgggaaggccgtggcttgggaaagagcatttattaatcttgttaagcttgccaacccagctctcatattccagctgggctatttgaggatatgccatccctcaagaattagggaggaaatacgtccgatggtattagcgcagaacctgacattgtccttttcgtccgagagctctatccaagatgaattaaacagagaaagtacagctgatgcaattacaatagtgattagctatattgtgatgtttgcatatatatcattcacacttggagaccgtccttctcgttggctgttactatttgtttcatcgaaggtactgcttggtttgtctggtgttgttctggtgatgctttcagttttaggatcaatgggattctttagtgctattggagtgaagtccacccttattattatggaagtgattccttttcttgtgctggctaggttttcccttactttgtccatgtcaacaaacaattcggaatacctcgacttttcagaacagattaataaagccaattccacagccatatcaccatcatattttatccacattgctgttgtgactacattatgcctattttactggaaagcactggcggtctttatggatttccttctccaagtgacagcctttgtagcccttattgtatttgactttaggagggcacaggatggcagaattgattgtgtcccttgtgcgagaatcatgccaagtacaggtgctggtgatggtggcgatgagcagaggctccacttgcttgctagatatatgagggacattcatggaccaattctcagctaccgggcggtgaagttcgttgtagtcactgtatttttaggattgacatttgcaagcatagcattgtctactagactgcaaccaggactggagcagcaaattgttctgccacgaaattcctatttacaggattattttgacgaccttgcaaagtacatgaaagtcggtccaccattatactttgttgtgaaggacttcaattacagctctgcatcggtgcatacgaatcaaatatgttcaatcaaccagtgtaattcgaattctcttttaaatgagatatcaagacaatcattatcccctgagaccagttacattgctaaacctgctgcttcatggcttgatgacttcctagtttggatgtcccctgaagcatttggatgctgtaggaaatttgtgaatggaaattactgccctccagatgatcagcctccatgctgccaacacaatcaggtttcaggctcttgcgtcacaagcagcacctgcagtaactgtaccacgtgcttcctacactcagacttggataatgggcgtccatccacaacccaattcagagataaacttccatggtttcttgatgcacttccatcgagtgattgttctaaaggggggaaaggagcttattcaacaagtttagacctcagtggttatgaaagtggcattatacaagcgtcggcattccgaacataccatactccccttaacaagcagagtgactatgttaactcaatgagagctgcccgggacttcagttctaaaatgtccaaagatttacagatgaatattttcccatattcggtgttctatatattctttgagcaatacctaagcgtgtggaagacagctatcatgaacatatgtgtttgccttggtaccatatttgttgtttgcttcatagttaccggcagtttatgggcttcagcaatcattttaattgtgctagcgatgatagtcttggatctgatgggggtgatggccatccttggtattcagcttaatgcaattgctgttgtaaaccttgttatgtcgataggaatcgctgtcgagttctgtgttcatatcacacatgcctttatgattggcgctggggacagagaaactcgtgcaaggcaggctctatccacgatgggtgcgtctgtattcagtggaatcaccttgaccaaacttgtgggagttattgtcctccgttttgcgaaatctgaagtttttgtggtctattacttccaaatgtatttggctcttgtcatcattggattcctgcatgggcttatcttcctaccggtcgttttgagtttatgcggccctcctccaaaatcggcgaagccaatagaacaaagccaaccaccttcagcttcaaccgagcggacttgacaggattttatttgagttcgacagttacattacatactcaaaaattgaaataggctggttggggagtgcttcctctgtgcgtccatgtacatgtatatccatctcaccatctgtgtcgcattggaggagcaacagtgaggtgtacagcatttgctgaaggtgaaagcagtcttacagatccgtagaaaaatattgtacatatccatgttagcataactaggttagttggtgctagtgctacacatggtggggaaggaaactaagaggcgaattggggttcgatgtaactctagttggttgcagtccgctcgttgttctgtgtcacccaagagtcgagactcgagagtagtgctgctgtcttcgtttgatctggattcattccgtatgcttgtaaagcttgtttttataggcatccgtgccccgttctagcctagcatgcacaacggatcacatggaaagtatgatgtttcttgctttgcgtcatgctgtagctggagaccgcacagtcaaatccatggtaaccattcctctct

SEQ ID NO: 4784 - DNA, 4079 bp, Brachypodium distachyon
atgcagatagtctttcttgtgcctcccacaactgcacaacaatctggtggtacttcaagggtagtacctgccgaaggatactgttccatgtatggcatttgtgcacaccgaagtgacgggaaggtcttaaactgtgtgaatgcaacaaaagctgttaagccagacgctttattttccacgaggatccaaagtttgtgccccactatcaccggtgatgtctgttgtacagttgatcagtttgacactttacaccaacaagtccaacaggctgttccatttcttgttggatgcccagcttgcctgagaaatttcttgaatctcttttgtgaaatgtcttgttctccgaaccaaagcctcttcattaacgtgacttcagcaaaacaggttaataaaactatgactgttgatggcatagattactatgtaacaagcaattatggtgaagagttatatagctcttgtaaggatgtgaagtttggcactctgaacacacgtgcaatggattttctcggtgggggtgctaaaacttacaaagagtggtttacattccttgggcgtcaggcaaatcctaatgagcccggctcaccttatctgataacataccgatctgattttgatcagtcatcgagggtgaagcctctaaatgcaacaatctattcttgtggagatccatctttaggctgttcatgtggcgattgtccttcttcttcagtttgcacaggatctttgttgcctcagtcgaagacagtaacctcctgttcagttaacatggtttccctaaaggccgaatgcttggacttttcattagtgattgtgtaccttgcgttgctatgtgcaattttattatggggcttgttatacagaagacgaggaagaactggcttctcctcacaaacaaaaacaccaaagaattctgaagataagttgcattcaaacaacaatgacaatgttcctgataaccatgttcaggtgcccgaagctacatcatcttctgttgtccaaacttacatgtcgactttctttaggaggcatggaatttttgttactagacatcctcttcttgtgttattcgcatccatacttgtccctgtcatattatgcattggtcttattcgtttcaaggttgagacacggccagaaaagctctgggttagtcctggaagtcgggctgccgatgaaaagcaatattttgacagtcatcttgcaccattttataggattgagcagcttgtattagccacttctgcatctgaccagtctgaagctcctacgatagtaaatgagaacaatatgaaattgctatttcaaattcagaacaaggttgatgatctacgtgcaaattattctggatcgacagtatcccttgctgacatctgcctaaaaccactcagtacagactgcgctactcaaagtgttttgcagcattacagttctgaagagacatgcttgagcacttttcaatcacctatcgatcctagtacgatattaggtggttttccaggaagcaatttttctgaggcttctgcattcataataacgtatcctgtgaacaacaaggtcgagacaacaggacaagagaatggaaaagctgtggcttgggaaagggcatatattaatcttgtaaaggacgaaatactgccaatggtattagcacagaatctaacgttgtccttctcatctgagagctctatccaagatgaattaaacagagaaagtacagctgatgcaattacaatagtgataagctatattgtgatgtttgcatacatatcattcacacttggtgatcgtccttctcgcttgtggtcattacttgtttcatcaaaggtacttcttggcttatctggagttgtcctggtgatgctttcagttttaggatcaattggattctttagtgctattggaatgaagtcaactctaatcataatggaagtaattccttttcttgtgcttgcagttggtgtggacaacatgtgtatccttgtgcatgctgtcaagcgccaaccatatgggttggtattggaagaacgtgtaagtaacgcattggtggaagttggaccatccattacattagccagtttggctgaagttttagcttttgctgtcagtgcaatcaatccaatgcctgccaccagagtattttccatatttgctgcaatggcagttcttctggatttccttctccaagtgacagccttcgtagcccttattgtacttgattttaggagggctgaagatggcaggattgattgtgtcccttgtgcaagacttacttctagtacggatactgtcgctggcgatggttccccccatcaggggcctcacttggttgcacgatatatgaaggacattcatggaccaattcttggctatcgggcagtgaagtttattgtgattgctgcatttgtaggattagcatttgcaagcattgcaatgactactagactgcaaccagggttggaacagcaaatcgttcttccgcgaaattcttatttacagggttattttaatgacctagagaagtacatgaaagttggaccaccactatattttgttgtgaaggacttcaattacagctctgcgtcggaaaacactaatcagatatgttcgatcaaccagtgtaattcaaactctctttcgaatgagatagcaagacaatctttatctcccgagacaagttacatagcaaaacctgctgcttcatggcttgatgacttcctagtatggatgtctcctgaagcatttggatgctgtcgaaaatttgttaatggaaactattgccctccagatgatcagcctccttgctgtcaacttgatcaagattcaggttcatgcagtccaaatggatcctgcaataattgcacaacgtgcttcttacattctgacctgcaaaacgggcgtccatcgacaacacaatttagagagaaacttccatggtttctggatgcacttccatcaagtgattgttctaaagggggcaaaggagcttattctacaagtttgaacctcagtggttatgaaagtggcatcatacaagcgtcagcattccgtacatatcatactccccttaataagcagactgactatgttaactcactaagagctgctcgggacttcagttctcaagtgtccaaagatttacagatgcaaattttcccatattccgtgttctatatattttttgagcaatatctcggcatatggaagacagctatcatgcatatatgtgtttgccttggtacagtatttgttgtttgcttcctactcactagcagtttgtgggcttcggcgatcattttagttgttttggccatgatagtcctggatctgatgggtgtgatggctgtccttggcattcagctcaatgcaatttctatcgtaaaccttgttatgtcaataggaattgctgttgaattctgtgttcatatcacacatgcctttatgataggcattggggatagagaaaaccgtgcaaggcatgctctatcaacgataggtgcttctgtattcagtggaatcaccttgaccaaacttgtgggggttattgtcctacgttttgcaaagtctgaagtttttgtggtgtattacttccaaatgtacctggcgcttgtactcattggctttctgcacgggcttatattcctaccggttgtgttgagtctgtgtggccctcctcaaaaaaccatgaaaccaattgaacaaagtcagactccgccttcaaatgggcaaacctgatagctaaacatttaggatgtttgcaaagcatttccatgtacatatccatctcaccgcgtgcaggaggaacagcgaggagtacaccatttctagaggcggaagcaatctttatagattcatagaataggttgtgcattagttaagctcagttacagaactagattcgttggtgtcggcatgtggagaaggaagtgtgagttgagtatgtagatcagtgtagcttgtgtttattacagttcagctggtggtttgtatctgttcaatgcgtgaatccaagtgccaacgtttggtagtactatatcgtttgaattggtttgcgctgtgcatttgcaagaggcattttt

SEQ ID NO: 4785 - DNA, 4119 bp, Oryza sativa
atggcgctcgtccggcgccggcgaggcgtcgccggcggcggcggcccggccctcgccgccgtggcggtggctctgatgcagcttgtttttctcgtgcctcctacaagagcccagcaatctaatggtacttcaagggttgtacctgcagaaggatactgttccatgtacggtatttgtgcacagcgaagtgatgggaaggtcttgaactgcgtgaatgcaaccaaagctgttaagccagacactttgttttctgcgaggattcagagtttgtgcccaactatcactggcgatgtctgttgtacggtagatcagtttgacacattacatcaacaggtgcaacaggctattccatttcttgttggatgcccagcatgcctgaggaatttcttgaatctcttttgtgaaatgtcttgttccccaaaccaaagcctcttcattaacgtgacttcagtaaaacaggttaataatactatgactgttaatggcatagattactatgtaacaagtacctatggtgaagagctatacaactcctgcaaggatgttaaatttggcacactgaacacacgtgcaatggatttcctaggtggaggcgctaaaaattacaaagagtggatggcatttattgggcgacaggccgaccttaatcagattggttcaccttatttgataacatttccatccgatattagtggttcgactgcggtgaagccgctgaatgctacaatttattcttgtggagatccatctttgggctgttcatgtggtgattgtccttcttcttctgtttgcacgggatccttgttgcctcagttgaacacagaaacctcctgttcagttaaaatgggttctctgaaggccaaatgcttggacttctcactggtggttgtataccttgtgttattgtgtatatttttatttggggcattcttacacagaacacgaagatctggcatcttctcacacacaaaaccattgaaaaatgcagaagataagatccactcaagcaacaatggcaaggttcctgatagctctgctcaggtgtctgaagctgcatccgctcctgtccaatcagcccatccttctgttattcaaacttacatgtcaactttctttaggaagcatgggacatttgttgctaaacatcctcttcttgtgttatttgtatccttgcttgtccctaccctattatgcattggtctaattcgtttcaaggttgaaatacgaccagagaagctttgggttagttctggaagtcgggctgctgatgagaagcaatattttgatagtcatcttgcaccattctataggattgagcagcttgtattagccacttctgcatttggtggttctgaagctcctacaatagtcaatgacaacaatatgaaattactatttcagattcagaaaaagattgatgatctgcgtgcaaattattctgggtcaacagtatctcttgctgacatctgcttaaagccgcttggtacagaatgtgctacacaaagtgttctacagcattacactactgaagagacatgtttgagtacttttcagtcacctattgatcctagtaccatattaggtggttttccaggaaacaattttactgaggcttctgcatttgtaataacatatcctgtgaacaacaaggttgagacaacaggacaggagaatggaaaagctgtggcttgggaaagggcatatgttaatcttgtcaaggaagaaatattgccaatggtattagcacacaatcttacaatgtccttctcatccgagagttctatccaagatgaattaaacagagagagtacagctgatgcaattacaatagtgattagctatattgtgatgtttgcctacatatcattcactctcggagaccgtccttctcatttgctgtcactatttgtttcatcaaaggtccttcttggcttgtctggggttgtcctggtgatgctttcagttctaggatcaatgggattcttcagtgcaatcggagtgaaatcaactctaatcataatggaagtaatcccgtttctagtattggctgtcggtgtggacaacatgtgtatccttgtgcacgctgtcaaacgccaaccagatggcttggatttggaagaacggataagtactgcattggtggaagttggaccatccattacattggccagtttggctgaagttttagcttttgctgtgagtgcaatcaatccaatgcctgcgaccagagtattttccatgttcgctgcattggcggtgcttctggatttccttctccaagtttcagcttttgtggcccttattgtacttgatttcaggagggctcaagatggaaggattgattgtatgccttgtgcgagagtaaaatcgagtgttgttgcttctgatggtggtaaccaccaggggcttcctttgcttgcacgatacatgaagaatgtccatgcaccaattctcggttatcgggcagtgaagtttgttgtgattgctgtgtttgtaggattttcatttgcaagcatagcattgtccactagactgcaaccaggattggagcagaaaattgttctaccacgagattcctacttacaggattattttgatgatcttgcaacatacatgaaagttggcccaccactatattttgtcataaagaacttcaattatagctcagcatcagaacatacaaataagatatgttcaatcaaccagtgtgattcaaattctcttttaaacgagatagcaaaacaatcattatctcccgagacaagttacattgctaaacctgctgcctcatggcttgatgatttcctaatatggatgtctcctgaagcgtttggatgctgtcggaaatttgttaatggaagttattgcccaccagatgaccagcctccatgctgtcaacatgatcaagactcaagctcatgtagtgcaagtggagcatgcaataattgtacaacgtgcttcttacgatcagacttgcataatggacgcccatccacaactcaattcaaagagaaacttccatggtttcttgacgcacttccgtcaagtgattgttctaagggtggcaaaggagcttattctacaagtttggaccttaacggttatgaaaatggcattatacaagcgtcagcatttcgaacataccatactcctctcaataaacagagtgattatgttaattctatgaaagctgcacgggacttcagctctaaaatgtccaaagaattacagatgcaaatgttcccatattcagtattttacatattctttgagcaatacctgggagtatggaagacggctatcatgaacatatgtgtttgccttggtacagtgtttgtcgtttgcttcgtagtcacaagcagtttgtgggcttcaataatcattttaatagtgctggccatgatagtactggatttgatgggaatgatggctatccttggcattcagctcaatgcaatttctattgtaaaccttgttatgtcaataggaattgctgttgaattctgtgttcatatcacacatgccttcatgctgttcttttccattgtcattctgaaacccttgatgacattctttgagatgcagataggcattggaaatagagaaagccgtgcaaggcaagctctatcgacgatgggggcttctgtattcagcggaatcaccttgaccaaacttgttggagttattgtcctacgttttgcaaaatctgaagtttttgtggtatactatttccaaatgtacttagcacttgtcatcataggctttctgcatggccttatcttcttaccgtgttacattgccacctcatctcatccttcatcgcccattcaaaatgggggtagcaatttaggactggactcaagtcactcaacagggtttcccaaaccgctagggacggggtcatcgtgccccggcggagtttaccgtggtatttatattaccgtaccccgtggtaaggccggtaaccgcgcggttgcggttaccgacgtctatcttgcttcaaaaaaaattatgttcctttcaccttgcttccccagaggcccagactgtaaatttggaagcttttcctataagtccttttttttaaatgttgtctttcgctcaaactacgctgtgtga

SEQ ID NO: 4786 - DNA, 1496 bp, Sorghum bicolor
atccgccgccagacaaggggcaagcgagcgaaaatcgaatggctcccatcttcgccgcggcgtcccacgcgtccctcctccccctctcccacgtcgaccgccccgccgccggccgcctagtccgtggcactctcaggccccacacctcgggcctccgcttgcgccgccccccgggggcaaccgggcgcggccgcgggcgtggccgaggaggcatccccgacgagtggggcgagcgttcgccgccaggcgcccccgaggcccccgcgcagcccgatccgctcatcgacgacgaggacgactccgccgacggcaactcacgccctatcgtcgtcgacgagtggggcgagcccggggcgcccgagcccgagccgccctccgccgcggacccgcctagccccgccgcagacgacgagtgggaggaggagccagaggcgtcggtgccggacccgaccccggctccggcggcggcggaggaggacgagcaggcggtgaagagggaggagctcaagcgctgcttggtggacacggtgtacggctccgacctcggcttccgggcgtccacggaggtcagaggggaggtcgtcgagctagtcacccagctcgaggcggctaaccctactacggcgcccgtcgagacatcggatctcctcgacggcaactggatcctcatatatacagcatattccgagcttctgcctattctagctgctggggcaacacctttggtcaaagtaaagcagatatcccaagaaattgactccaaaagcatgacgatagtcaatgcttcaacccttacgactccattcgcatcattttcattcagcgcaactgcctcttttgaggttcaaagtccgtcaagaatagaggtccaatttaaggaggggagctttcagcctccggtaatatcatcatctgtggatctacctcaacaaattgatatatttgggcagaagatcagcctggggccagtccagcaggcactgaatccattgcagcaagcatttgctagcattgcagggtccatttctgggcagccacccctcaaggtaccgattcccggcaacaacagagctcgatcctggctcttgactacctacctggacaaagacttaaggatctcgagaggtgatggaggcttgtttattcttgcgaaagaggggagccctttgctagatctattgtaaatctggtgctattattttttaatctttgtagtatttggcaatttgtctaccaatgaattgcagactggggccaatccagcaggtactgttgtacttcagcaagctgctgggtacttttcgaaacggaaccttctcttttgtctgggggttttggaattcgtcaacgctaggagaggggcatgattactgtatagcaaggggagatggtatactactgtgtttgggaaaatctaacaccaatctgcatgatcaaaactatgatccaagcgctcaaacgcagggatagcagtaaagcgtttgtgttagtctaaa

SEQ ID NO: 4787 - DNA, 1737 bp, Sorghum bicolor
gtcgggcctcccttgagcgaaatcggccgctcttcctccccatttttttctcgagcccatccgccgccagacaaggggcaagcgagcgaaaatcgaatggctcccatcttcgccgcggcgtcccacgcgtccctcctccccctctcccacgtcgaccgccccgccgccggccgcctagtccgtggcactctcaggccccacacctcgggcctccgcttgcgccgccccccgggggcaaccgggcgcggccgcgggcgtggccgaggaggcatccccgacgagtggggcgagcgttcgccgccaggcgcccccgaggcccccgcgcagcccgatccgctcatcgacgacgaggacgactccgccgacggcaactcacgccctatcgtcgtcgacgagtggggcgagcccggggcgcccgagcccgagccgccctccgccgcggacccgcctagccccgccgcagacgacgagtgggaggaggagccagaggcgtcggtgccggacccgaccccggctccggcggcggcggaggaggacgagcaggcggtgaagagggaggagctcaagcgctgcttggtggacacggtgtacggctccgacctcggcttccgggcgtccacggaggtcagaggggaggtcgtcgagctagtcacccagctcgaggcggctaaccctactacggcgcccgtcgagacatcggatctcctcgacggcaactggatcctcatatatacagcatattccgagcttctgcctattctagctgctggggcaacacctttggtcaaagtaaagcagatatcccaagaaattgactccaaaagcatgacgatagtcaatgcttcaacccttacgactccattcgcatcattttcattcagcgcaactgcctcttttgaggttcaaagtccgtcaagaatagaggtccaatttaaggaggggagctttcagcctccggtaatatcatcatctgtggatctacctcaacaaattgatatatttgggcagaagatcagcctggggccagtccagcaggcactgaatccattgcagcaagcatttgctagcattgcagggtccatttctgggcagccacccctcaaggtaccgattcccggcaacaacagagctcgatcctggctcttgactacctacctggacaaagacttaaggatctcgagaggtgatggaggcttgtttattcttgcgaaagaggggagccctttgctagatctattgtaaatctggtgctattattttttaatctttgtagtatttggcaatttgtctaccaatgaattgcagactggggccaatccagcaggtactgttgtacttcagcaagctgctgggtacttttcgaaacggaaccttctcttttgtctgggggttttggaattcgtcaacgctaggagaggggcatgattactgtatagcaaggggagatggtatactactgtgtttgggaaaatctaacaccaatctgcatgatcaaaactatgatccaagcgctcaaacgcagggatagcagtaaagcgtttgtgttagtctaaatataagcaagcctgctttacccaagatcaataaagccacattgtccgactggagagcagaaaccggtagtttcctgccagataaccggtgatgcgtccccgatgcatatcagattgtgaatataacatgtgctgctaacaatgcatcgttttcagtttatgttgctaattatttatagaccga

SEQ ID NO: 4788 - DNA, 2789 bp, Hordeum vulgare
gccgccgccgccgccgccgcctgagtgcgatccatggacgccgaggccggcgccgtcgccgccgcccaggagcttccgtggaggcagcactacaggaatctactgctgctagcataccagagcttcggtgttgtttatggggacctaagcacatcgcctctgtatgtgtacaaaagtacattctcaggaaggctcgggcagtaccaagatgaacagacagtatatggtgtactttccctgatattttggaccttcacacttgttcctttgctcaagtatgtcattattgtgttgagcgctgatgacaatggcgaaggtggaccatttgctctgtattcgctcctctgcaggcatgcaaagcttagcttgcttccgaatcaacaagcagcggatgaggagttatctacatactacagagatggcttcgcagctcagcatggatcttcaccctggctaagaaggttcctagagaagcacaaaactgtcaaaactggacttcttgttgtagttctctgtgctgctagcatggtgatcggtgatggtgtccttactccagcaatctcagtcctgtcatctatgtctgggctgcaagttcgagctactggtttacaggaacgttctgtggtgctactttcatgcattgtattggttggtttattttccttgcaacaccgaggtactcacaaggtagcattcatgttcgcaccaattgtcatcatctggctcctttgcattggtggaattggattgtacaacatagttcattggaacccaaagatataccaagcaatctctccatattacattgttaagttctttaggacaaccggtacagatggctggattgctctaggaggaatactactttctatgacaggcagtgaagctatgtttgctgacctcggtcattttacaagtgcatctgtcaggctagcttttattaccatcatatatccatgtcttatattgcaatatatgggccaagcagcatttttatcaaagaacatgttacacatgcgcacaagtttttatgactccatcccaggacctgtattttggcctgtatttgtggtagccactcttgctgcagttgttggaagccaggctgtcatctcagcaacattctctattgtaaagcaatgccatgctttgggatgtttcccacgagtgaagattgtccacacatcgaggtggatctatgggcagatatacattcctgaaataaattggatccttatggtgctatgtgtagctgtcacagttgcattcggtgatacaacccttatcggaaatgcctatggtattgcttgcatgactgttatgcttattacaacattctttatggcattcatcatcatctttgtttggcaaaagaacataatatttgccttgttgtttctattattcttcggatccattgaaaccgtgtatctttcctcatccctcatgaaggttcatcagggaggatgggtgcctcttgtgcttgctttcatattcatgtctgtcatgttcatttggcactatggaacaaagaggaagtaccagtttgatcttcagaacaaagtgtcaatgagatcaatcctttctcttggtccaaacctcggcatagttcgggttccgggaattggactgatttacacagaactggtgactggtgtgcctgccatcttcacacattttgtcactaatctccctgcctttcatgaagtcctagtgtttctttgtgttaagtcagtaccagtgccatatgttcaaccagatgagcgataccttgttggtaggattggacctagagcgtatcggatgtaccggtgcattgtcaggtacggttacaaggatgtgcagagagatgatgaaaattttgagaacatgttagttatgagcattgcaaggttcattatgatggaagctgaggatgtctcgtcttcagcaagttatgatattgctaacgagggaagaatggctgtgataagaaccaccgatgatgctggcaccccactgggcatgagagatctgggtggtctagctgagtccatttctaccacgaggagtagcaaatccgagagccttcgaagcttgcagtcctcttatgagcaggaatcaccgagtgcaaaccggaggcgtcgtgttcgcttcgagctgccaaatgaggacgccatggatcagcaggtgaaagatgagttattggcactcgtggaggcgaaacacgcaggggttgcgtatatcatgggccattcttacatcaaagctaggaggagctccaatttcctgaagaagtttgcggtcgatgttggctactctttcctccggaagaactgcagaggcccatcagtctcactgcatatccctcatattagtctgatagaagttggtatgatctactatgtgtagcctggtgctctttttttcacaatgtgggcatttggtggcaacaaagcatgtgctacctgtgaagccctattgctttatgtctggagttcaagctgcaatctctaggatggaatgttgcactgcatctagctgtccaaatgatctcagttttagtctggtggagatgaaggcgctgtgcatgttaatatcacttctcagccctaataaaacgccatgctctatcagtgatcgtagcttcttctttttggttatatttactgtgttttacatggttgtacttatttctgttttacatggttgtacttatttccggaatgacgtgaagtaaatcaattttgtcgcataaattctgccgctttccttgtaacctgtataaattttgcccgcgatgagaatcc

SEQ ID NO: 4789 - DNA, 2902 bp, Triticum aestivum
gagcctctccctccccgcccccgtgttctataactccacggaatcgcgctccaccgccggccggacacctcgcgccgccgccgccgcctgagtgcgatccatggacgccgaggccggcgccgccgccgcccagcagcttccgtggaggcagcactacaggaatctactactgctagcataccagagcttcggtgttgtttatggggacctaagcacatcacctctgtatgtgtataaaagtacattctcaggaaggctccggcagtaccaagatgaacagacagtatatggtgtactttccctgatattttggaccttcacacttgttcctttgctcaagtatgtcattatcgtattgagcgctgatgacaatggcgaaggtgggccatttgctctgtattcgctcctctgcaggcatgcaaagcttagcttgattccgaatcaacaagcagcggatgaggagttatctacatactacagagatgggttcgcagctcagcatgaatcttcaccctggctaagaaggttcctagagaagcacaaaactgtcaaaaccggacttcttgttgtagttctctgtgctgctagcatggtgatcggtgatggtgtccttactccagcaatctcagtcctgtcatctatgtctgggttgcaagttcgagctactggtttacaggaacgttctgtggtgcttctttcatgcattgtattggttggtttattttccttgcaacaccgaggtactcagaaggtagcattcatgttcgcaccaattgtcatcatctggctcctttgcattggtggaattggattgtacaacatagttcattggaacccaaacatataccaagcaatctctccatattacattgttaagttctttaggacaaccggtacagatggctggattgctctaggaggaatactgctttctatgacaggcagtgaagctatgtttgctgacctcggtcattttacaagtgcatctgtcaggctagcttttattaccatcatatatccatgtcttatattgcaatatatgggccaagcagcatttttatcaaagaacatgtttcacacacgcacaagtttttatgactccatcccaggacctgtattttggcctgtatttgtggtggccactcttgctgcagttgttggaagccaggctgtgatttcagcaacattctctattgtaaagcagtgccatgctttgggatgtttcccacgggtgaagattgttcacacatcgaggtggatccatgggcagatatacattcctgaaataaattggatccttatggtgctatgtgtagctgtcacagttgcattcggtgatacaacccttataggaaatgcctatggtattgcttgcatgactgttatgcttgttacaacattcttgatgtcatttatcgtcatctttgtttggcaaaagaacataatatttgccttgttgtttctgttattctttggatccattgaaaccgtgtatctttcctcatccctcatgaaggttcgtcagggaggatgggtgcctcttgtgcttgctttcatattcatgtctgtcatgttcgtttggcactatggaacaaagaagaagtaccagtttgatcttcagaacaaagtgtcaatgagatcaatcctgtctctaggtccaaacctcggcatagttcgggttccgggaattggactgatttacacagaactggtgactggtgtgcctgccatcttcacacattttgtcactaatctccctgcctttcatgaagtcctagtgtttctttgtgttaagtcagtaccagtgccgtatgttcaaccagatgagcgataccttgttggtaggattggacctaaagcgtatcggatgtaccgttgcattgtcaggtacggttacaaggatgtgcagagagatgatgaaaattttgagaacatgttagttatgagcattgcaaggttcattatgatggaagctgaggatgtctcgtcttcagcaagttatgatattgctaacgagggaagaatggctgtgataagaaccaccgacgacgctggcaccccactgggcatgagagatctgggtggcctagctgagtccatttctaccacgaggagcagcaaatccgagagccttcgaagcttgcagtcctcttatgagcaggaatcaccgagtgcaggccggaggcgccgtgttcgcttcgagctgccaaatgaggacgccatggatcagcaggtgaaagatgagttattggcactcgtggaggcgaaacacgcaggggttgcgtatatcatgggccattcttacatcaaagctaggaggagctccaatttcgtgaagaagtttgcgatcgatgttgcctactctttcctccggaagaactgcagaggcccatcagtctcactgcatatccctcatattagtctgatagaagttggtatgatttactatgtgtagcctggtggtcttttgttcacaatgtgggcattcggtggcaacaaagcatgtgccacctgtgaagccctattgctttatgtctctggagttcaagctgcaatctctaggatggaatgctgcactgcatctagctgtccaaatggtctcagtttcagtctggtggagatgaaggcgctgtgcatgttaatatcgcttgtcagccctaataaaacgccatactcgtatcagtgatcgtagcttcttctttttggttatatttactgttttacatacttgtacttcttcttttgggaacgacgtgaagtaaatcgattttgtcgcataaattttgctgctttcccccttaatctgtataaattttgccactttccctgtaacctatctgcgatgagaagcctagaatggtgtcatccaaattcctgtgaaaccaaaaaaaaaaaaaaaacg

SEQ ID NO: 4790 - DNA, 2554 bp, Secale cereale
gcacatcacctctgtatgtgtataaaagtacattctcaggaaggctccgacactaccaagatgaacagacagtatatggtgtgctttccctgatattttggaccttcacacttgttcctttgctcaagtatgtcattatcgtattgagcgctgatgacaatggcgaaggtgggccgtttgctctgtattcgctcctctgcaggcatgcaaagcttagcttgcttccgaatcaacaagcagcggatgaggagttatctacatactacagagatgggttcgcagctcagcatggatcttcaccctggctaagaaggttcctagagaagcacaaaactgtcaaaactggacttcttgttgtagttctttgtgctgctagtatggtgatcggtgatggtgtccttactccagcaatctcagtcctgtcatctatgtctgggctgcaagttcgagctactggtttacaggaacgttctgtggtgctactttcatgcattgtattggttggtttattttccttgcaacaccgaggtactcagaaggtagcattcatgttcgcaccaattgtcatcatctggctcttttgcattggtgcaattggattgtacaacatagttcattggaacccaaacatataccaagcaatctctccatattacatttttaagttctttagcacaaccggtacagatggctggattgctctaggaggaatactactttctatgacaggcagtgaagctatgtttgctgacctcggtcattttacaagtgcatctgtcaggctagcttttattaccatcatatatccatgtcttatattgcaatatatgggccaagcagcatttttatcaaagaacatgtttcacacgcgcacaagtttttatgactccatcccaggacctgtattttggcctgtatttgtggtggccactcttgctgcagttgttggaagccaggctgtcatttcagcaacattctctattgtaaagcaatgccatgctttgggatgtttcccacgagtgaagattgttcacacatcgaggtggatccatgggcagatatacattcctgaaataaattggatcctcatggtgctatgtgtagctgtcacagttgcattcggtgatacaacccttatcggaaatgcctatggtattgcttgcatgactgttatgcttgttacaacattcttgatggcatttatcatcatctttgtttggcaaaagaacataatagttgccttgttgtttctattattcttcggatccattgaaaccgtgtatctttcctcatccctcatgaaggttcaccagggaggatgggtgcctcttgtgcttgctttcatattcatgtctgtcatgttcatttggcactatggaacaaggaagaagtaccagtttgatcttcagaacaaagtgtcaatgagatcaatcctgtctctaggtccaaatctcggcatagttcgggttccgggaattggactgatttacacagaactggtgactggtgtgcctgccatcttcacacattttgtcactaatctccccgcctttcatgaagtcctagtgtttctttgtgttaagtcagtaccagtgccgtatgttcaaccagatgagcgataccttgttggtaggattggacctagaccgtatcggatgtaccgttgcattgtcaggtacggttacaaggatgtgcagagagatgatgaaaattttgagaacatgttagttatgagcattgcaaggttcattatgatggaagctgaggatgtctcgtcctcagcaagttatgatattgctaacgaggggagaatggctgtgataagaaccaccgacgatgctggcaccccactgggcatgagagatctgggtggcctagctgagtccatttctagcacgaggagcagcaaatccgagagccttcgaagcttgcagtcctcttatgagcaggaatcgccgagtgcaggccggaggcgccgtgttcgcttcgagctgccaaatgaggacgccatggatcagcaggtgaaagatgagttattggcactcgtggaggcgaaacacgccggggttgcgtatatcatgggccattcttacatcaaagctaggaggagctccaatttcgtgaagaagtttgcgatcgatgttggctactctttcctccggaagaactgcagaggcccatcagtctcactgcatatccctcatattagcctgatagaagttggcatgatctactatgtgtagtagcctggtgctcttttgttcacaatgtgggcattcggtggcaacaaagcatgtgccacctgtgaagccccgttgctttatgtctggagttgaagctgcaatctctaggatggaatgctgcactgtccaaatggtctcagtttcagtctggtggagatgaaggcgctgtgcatgttaatatcacttctcagccccaataaaacgccatactcgtatcagtgatcctagcttcttcttctttttggtcatgtttactgttttacacacttgtacttctttttggaacaacgtgaagtaaatcgattttgtcg

SEQ ID NO: 4791 - DNA, 4183 bp, Sorghum bicolor
ccctcgctctcgcgggtgacgagcgaaaattcgcatccatacactcccgctgcagacgggccccacaccgtcaaaaattggaccggctcccgctccctcgacgttttgggtttcgttttcccaccgcccgcccgacccccgcgtccgccctgccctgttttcacatttgagcgatcccctttcgattcgatttctccagactccagagctctagagagcatcgcatcagcagcagtccccgtctccggaccctagagagcatcgcatcagcagcagctacagcatcccctgccatggcgccgagctccccgtcgtccgccgagcccacgcgcgtctccggccggaagcgcgccgccaaggccgtggagatccaccagagccaggaggaggaggaggagcagaaggttgtggcggcgtcgtccgccaagcgcagccgaaaggcggcgtcttccggcaagaagcccaagccgacgcccaagcaggccaaggcgggtaggaagaagaagggggaggccgagaggaaggagcccgtggaggacgatgtgtgcgccgaggagcccgacgaggaggagttggccatgggcgaggcggaggcggaggcagaggcggaggccgatgagcaggccatgcaggaggaggtggccgcggtcgctgccgggtcgcccgggaagaagagggtggggagaaggagcgccgccgctggcggcgaccacgagccggagttcgtcggcaacgcagtccctgcggtcgaggcgcgcagcaactggcctaagcgctacgagcgcagcactgccgcaacgaaaccggaggaggacgaagagctcaaggccaggtgccactaccggagcgctaaagtggacaacgtcgtctactgcctcggggatgacgtctatgtcaaggctggagaaaatgaggcagattacattggccgcattactgaattttttgaggggactgatcggtgtcactattttacttgccattggtttttccgagcagaggacacggttatcaattctttggtgtccattaatgttgatggccacatgcatgaccctagacgcgtttttctttctgaggaaaagaacgacaatgtgcttgattgcatcatctccaaggtcaagatagtccgtgttgatccaaatattgatccaaaagccaaggctcagctgatagagcattgtgacctatattatgacatgtcgtactctgttgcatattctacgtttgctaatatctcatcagaaaatgggcagtcaggcagtgaaactgcttcgggtatttctgatggtgatgtggatctggagacgtcatctagtatgccagagaggacagccacccttcttgatctgtattctggctgtgggggcatgtccactggtctttgcttgggtgcagctctttctgggttgaaacttgaaactcgatgggctgttgaccttaacagttttgcgtgccaaagtttaaagtacaatcatccacagactgaggtgcgaaatgagaaagccgatgagtttcttgctctccttaaggaatgggcagtcctatgtgagaaatatgtccaagacatagattcgaatttagcaggttcagaggatcaagaggatgaaggcagccctctcgacaaggacgaatttgttgtagagaagcttattgggatatgctatggtggcagtggaaggaaaaacggcatctattttaaggtccagtgggaaggatatggtcctgaagaggatacatgggaaccgattgataacctgagtgactgcccactgaaaattagagaatttgtacaagaagggcacagaagaaaaattctcccgctgcctggtgatgttgatgtcatttgtggaggcccaccatgtcaaggtatcagtgggtttaatcggttcagaaaccgtgacgagccacttaaagatgagaaaaacaagcaaatggtgactttcatggatattgtggcgtacttgaagcccaagtatgttctcatggaaaatgttgtggacatactgaaatttgctgatggttacctaggaaaatatgctttgagctgcctagttgctatgaagtaccaagcacgccttggaatgatggtagcaggctgctatggtctgccacagttcaggatgcgtgtgttcctctggggtgctctttcttcgatggtgctccctaagtatcctctgcccacatacgacgttgtagtacgtggaggagctcctaatgccttttcacaatgtatcgttgcatatgatgagacagaaaaaccatccctgaagaaagcattgctccttggggatgcaatttcagatttaccaaaggttgaaaaccatcaacctaacgatgtaatggagtatggtggttcccccaagacagaattccagcgctacattcgacttggtcgtaaagacatgttggattggtcctttggtgaggaggctggtccagatgaaggcaagctcttggatcaccagcccttacggcttaacaacgacgattatgagcgggttcagcaaattcctgtcaagaagggagccaacttccgtgacctaaagggtgtcaaggttggagcaaacaatattgtgagtgggatccagaaatcgagcgtgtgaaactttcatctggaaaaccactggttcctgactatgcgatgtcattcatcaagggcaaatcacccaagccatttgggcgcctgtggtgggacgagacagttcctacagttgtaaccagagcagagcctcacaaccaggctatattgcatccgactcaagcaagagtcctgactgtccgggagaacgcaaggttacagggcttccctgattactacagattgtttggcccgatcaaggagaagtatattcaagtcgggaacgcagtagctgtccctgttgcccgggcgctgggctactgtttggggcaagcctacctgggtgagtctgaggggagtcaccctctgtaccagctgcctccaagtttcaccgctttggggcaaactgcggtacaggcgagggcctcttctgttggcactcctgcaggcgaggtggttgagcagtaaaaggatacagagctgagctgagcagggcaacagccaacggcaggagcatctctggttgggtccgattcagacccattaaatagcatgtttaccaatgaataatctgcgtatcgtgctgattcttatgattggagatgaatgtagggagggtgcacttgagctcgagtgcttgtcgtactgtactgtactgtaggttgaggtttcaaaacattaactagccatgtatcgtgttggaatatgagttattgatggtggccttatctcccgttgatagattgtcatccgggagggagaggcctactgaaaggatggtttgctgatcgtgctgtaaagagatcaacagttcctgcttgatgtttgccaaagaatttttagtggacatgcaaacgcttgcacttaagatgtacttggctatttggttttgttcctttccggattatgtattgaactggaatcaataatcgctaataagtgatttgcccaggtcgtggtacaacctgaattggtattttctatttcaagttagatgctttgctgaaatgttcattctctggacttcaaaaaataaaattggctacaggaacacagatcactatgagaagaattttgtgaagctgccctaattaagtagtagcatcaaaataggattgatttgagaatcgagccgtagcttgagtggtaaggcctccaggtggtggaacggctggtcgtgagtttcaagctttgcttgactcatgattctcactgcggtttcgtcctccacgggctccttcctctcggcctcccctttcttcttcctacccgccttggcctgcttgggcgtcggcttgggcttcttgccggaagacgccgcctttcggctgcgcttggcggaggacgccgccacaacctcctcctcctcctcctggctctggtggatctcctcggccttggcggcgcgcttccggccggagacgcgcgtgggcgcggcgggcgacggggagctcggcgccatggcaggggatgcggtagctgctgctgatgcgatgctctctagagtcggcagacgagagggtttggcaggagagggagagctctggagtctggagaaatcgaatcgaaaggggattggtcaaatgtgaaaacagggcagag

SEQ ID NO: 4792 - DNA, 3139 bp, Sorghum bicolor
atggcaccgagctccccgtcccccgccgcgcccacgcgtgtctccggccggaagcgtgccgccaaggcagaggagatccaggaggaggaggttgtggtggcgtcctccgccaagcgcagccgcaaggcgccgtcttccggcaagaagcccaagccgacgcccaagcaggccaaaccggccaaggcggcgaggaagaagaagggggaggccgagaggaaggagcccgtggaggacgacgtgtgtgccgaggagcccgatgaggaggagctggccatgggcgaggaggaggcggaggcggcggccgatgagcaggccatgcaggaggaggtggccgcggtcgtggccgggtcgcccgggaagaagagggtggggagaaggagcgccgccgctggcggcgaccacgagccggagttcgtcggcaacgccgttcccgcggccgaggcgcgcagcaactggcctaagcgctacgagcgcagcactgccgcaaagaaaccggaggaggacgaagagctcaatgccaagtgccactaccggagcgccaaggtggacaacgtcgtctactgcctcggggatgacgtctatgtcaaggctggagaaaatgaggcagattacattggccgcattactgaattttttgaagggactgatcggtgtcactattttacttgccgttggttcttccgtgcagaggatacggttatcaattctttggtgtccattaatgttgatggccacaagcatgaccctagacgtgtttttctttctgaggaaaagaatgacaatgtgcttgattgcatcatctccaaggtcaagatagtccatgtggatccaaatatggatccaaaagccaaggctcagctgatagagcattgtgacctatactatgacatgtcgtactctgttgcatattctacatttgctaatatctcatcagaaaatgggcagtcaggtagtgaaaccgcttcgggtatttcttctgatgatgtggatctggaggcgccatctagtatgccagagaggacagcaacccttcttgatctgtattctggctgtgggggcatgtccactggtctttgcttgggtgcagctctttctggcttgaaacttgaaactcgatgggctgttgatcttaacagttttgcgtgccaaagtttgaagtacaatcatccccagactgaagtgcgaaatgagaaagccgatgagtttcttgctctcctcaaggaatgggcagtcctatgtgagaaatatgtccatcaagatgtggattcgaatttagcaggttcagaggatcaagaggatgaaggcagccctcttgacaaggacgaatttgttgtagagaagcttattggaatatgctatggtggtagtggaaggaaagatggcatctattttaaggtccagtgggaaggatatggtcctgaagaggatacatgggaaccgattgataacctgagtgactgcccgctgaaaattagagagtttgtacaagaagggcacagaagaagaattctcccgctgcctggtgatgttgatgtcatatgtggaggtccaccatgtcaaggtatcagtgggtttaatcggttcagaaaccgtgatgagccacttaaagatgagaaaaacaagcaaatggtgactttcatggatattgtggcttacttgaagcccaagtatgttctcatggaaaatgttgtagacatactcaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtgctccctaagtatcctctgcctacatatgatgttgtagtacgtggaaacaccccaaatgccttttcgcaatgtatggttgcatatgatgagaaacaaaaaccacacctgaagaaagctttgcttcttggtgatgcaatttcagatttaccaaaggttgaaaaccatcaacctaaagaggtaatggagtatggtggttcccccaagacggaattccagcgttacattcgacttagtcgtaaagacatgttggattggtcctttggtgaggaggctggtccagacaaaggcaagctcttggatcaccagcccttacggcttaataacgatgattatgagcgggttcaacaaattcctgtcaagaagggagccaacttccgtgacctaaagggtgtcaaggttggagcaaacaatattgttgagtgggatccagaaatcgagcgtgtgaaactttcatctgggaaaccactggttcctgactatgcgatgtcattcatcaagggtaaatcactcaagccatttggacgcctgtggtgggatgagacagttcctacagttgtaaccagagcagagcctcacaaccagattatattgcatccgactcaagcaagagtcctgactatccgggagaacgcaaggttgcagggcttccctgattactaccgattgtttggccccatcaaggagaagtatattcaagttggaaatgcagtagctgtccctgttgcccgggcactgggctactgtctggggcaagcctacctgggcgaatctgaggggagtcaccctctgtaccagctgcctccaagtttcaccgctttggggcgaactgcggtgcaggcgagggcctctcctgttggcactcctgtaggggaggttgttgagcagtaagaggatcagagctgagctgagcaggccaacagccaacggcaggagcatctttggttgggttcgagcccaaccgatagcatgtctaccaataaataatcagtgcatcgtgctgattcttatgattggtgatgaatgtaggcagggtgcactcgagctcgagtgcttgttgtactgtaggttgaggtttcaaaacatttattcatcggcccgcctatttgtggctgatgtttctcgtgtcatttcagtttatctgctgatttgaggcttcgtcatgtacgtgtaggttgaggcttcgtaatgtacgtgtaggttgaggtttgaaaacatttattcattcttgttaaatgcaagtaagataacatttgacccttgttcaacgtgagcaaattttcatcca

SEQ ID NO: 4793 - DNA, 3433 bp, Sorghum bicolor
cgaaaattcgaatccataccctcccgctcccgctccctcgaacttttgggtttcgttttccctccgccccccgcccgaccgccgcgtccgctctgccctgttttcacgttcgatccccttcgattcgatttctacacccccagagtccagactccagagctctcactctcctgccaaaccccctcgtctcgcccctgccatggcaccgagctccccgtcccccgccgcgcccacgcgtgtctccggccggaagcgtgccgccaaggcagaggagatccaggaggaggaggttgtggtggcgtcctccgccaagcgcagccgcaaggcgccgtcttccggcaagaagcccaagccgacgcccaagcaggccaaaccggccaaggcggcgaggaagaagaagggggaggccgagaggaaggagcccgtggaggacgacgtgtgtgccgaggagcccgatgaggaggagctggccatgggcgaggaggaggcggaggcggcggccgatgagcaggccatgcaggaggaggtggccgcggtcgtggccgggtcgcccgggaagaagagggtggggagaaggagcgccgccgctggcggcgaccacgagccggagttcgtcggcaacgccgttcccgcggccgaggcgcgcagcaactggcctaagcgctacgagcgcagcactgccgcaaagaaaccggaggaggacgaagagctcaatgccaagtgccactaccggagcgccaaggtggacaacgtcgtctactgcctcggggatgacgtctatgtcaaggctggagaaaatgaggcagattacattggccgcattactgaattttttgaagggactgatcggtgtcactattttacttgccgttggttcttccgtgcagaggatacggttatcaattctttggtgtccattaatgttgatggccacaagcatgaccctagacgtgtttttctttctgaggaaaagaatgacaatgtgcttgattgcatcatctccaaggtcaagatagtccatgtggatccaaatatggatccaaaagccaaggctcagctgatagagcattgtgacctatactatgacatgtcgtactctgttgcatattctacatttgctaatatctcatcagaaaatgggcagtcaggtagtgaaaccgcttcgggtatttcttctgatgatgtggatctggaggcgccatctagtatgccagagaggacagcaacccttcttgatctgtattctggctgtgggggcatgtccactggtctttgcttgggtgcagctctttctggcttgaaacttgaaactcgatgggctgttgatcttaacagttttgcgtgccaaagtttgaagtacaatcatccccagactgaagtgcgaaatgagaaagccgatgagtttcttgctctcctcaaggaatgggcagtcctatgtgagaaatatgtccatcaagatgtggattcgaatttagcaggttcagaggatcaagaggatgaaggcagccctcttgacaaggacgaatttgttgtagagaagcttattggaatatgctatggtggtagtggaaggaaagatggcatctattttaaggtccagtgggaaggatatggtcctgaagaggatacatgggaaccgattgataacctgagtgactgcccgctgaaaattagagagtttgtacaagaagggcacagaagaagaattctcccgctgcctggtgatgttgatgtcatatgtggaggtccaccatgtcaaggtatcagtgggtttaatcggttcagaaaccgtgatgagccacttaaagatgagaaaaacaagcaaatggtgactttcatggatattgtggcttacttgaagcccaagtatgttctcatggaaaatgttgtagacatactcaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtgctccctaagtatcctctgcctacatatgatgttgtagtacgtggaaacaccccaaatgccttttcgcaatgtatggttgcatatgatgagaaacaaaaaccacacctgaagaaagctttgcttcttggtgatgcaatttcagatttaccaaaggttgaaaaccatcaacctaaagaggtaatggagtatggtggttcccccaagacggaattccagcgttacattcgacttagtcgtaaagacatgttggattggtcctttggtgaggaggctggtccagacaaaggcaagctcttggatcaccagcccttacggcttaataacgatgattatgagcgggttcaacaaattcctgtcaagaagggagccaacttccgtgacctaaagggtgtcaaggttggagcaaacaatattgttgagtgggatccagaaatcgagcgtgtgaaactttcatctgggaaaccactggttcctgactatgcgatgtcattcatcaagggtaaatcactcaagccatttggacgcctgtggtgggatgagacagttcctacagttgtaaccagagcagagcctcacaaccagattatattgcatccgactcaagcaagagtcctgactatccgggagaacgcaaggttgcagggcttccctgattactaccgattgtttggccccatcaaggagaagtatattcaagttggaaatgcagtagctgtccctgttgcccgggcactgggctactgtctggggcaagcctacctgggcgaatctgaggggagtcaccctctgtaccagctgcctccaagtttcaccgctttggggcgaactgcggtgcaggcgagggcctctcctgttggcactcctgtaggggaggttgttgagcagtaagaggatcagagctgagctgagcaggccaacagccaacggcaggagcatctttggttgggttcgagcccaaccgatagcatgtctaccaataaataatcagtgcatcgtgctgattcttatgattggtgatgaatgtaggcagggtgcactcgagctcgagtgcttgttgtactgtaggttgaggtttcaaaacatttattcatcggcccgcctatttgtggctgatgtttctcgtgtcatttcagtttatctgctgatttgaggcttcgtcatgtacgtgtaggttgaggcttcgtaatgtacgtgtaggttgaggtttgaaaacatttattcattcttgttaaatgcaagtaagataacatttgacccttgttcaacgtgagcaaattttcatccactgtagttgagtactgaatggtttgagtgattgagtcatcatgtagtatttgcatttattttcacaagagtgtaggaataaaacttacaataagc

SEQ ID NO: 4794 - DNA, 3310 bp, Sorghum bicolor
ggaccctagagagcatcgcatcagcagcagctacagcatcccctgccatggcgccgagctccccgtcgtccgccgagcccacgcgcgtctccggccggaagcgcgccgccaaggccgtggagatccaccagagccaggaggaggaggaggagcagaaggttgtggcggcgtcgtccgccaagcgcagccgaaaggcggcgtcttccggcaagaagcccaagccgacgcccaagcaggccaaggcgggtaggaagaagaagggggaggccgagaggaaggagcccgtggaggacgatgtgtgcgccgaggagcccgacgaggaggagttggccatgggcgaggcggaggcggaggcagaggcggaggccgatgagcaggccatgcaggaggaggtggccgcggtcgctgccgggtcgcccgggaagaagagggtggggagaaggagcgccgccgctggcggcgaccacgagccggagttcgtcggcaacgcagtccctgcggtcgaggcgcgcagcaactggcctaagcgctacgagcgcagcactgccgcaacgaaaccggaggaggacgaagagctcaaggccaggtgccactaccggagcgctaaagtggacaacgtcgtctactgcctcggggatgacgtctatgtcaaggctggagaaaatgaggcagattacattggccgcattactgaattttttgaggggactgatcggtgtcactattttacttgccattggtttttccgagcagaggacacggttatcaattctttggtgtccattaatgttgatggccacatgcatgaccctagacgcgtttttctttctgaggaaaagaacgacaatgtgcttgattgcatcatctccaaggtcaagatagtccgtgttgatccaaatattgatccaaaagccaaggctcagctgatagagcattgtgacctatattatgacatgtcgtactctgttgcatattctacgtttgctaatatctcatcagaaaatgggcagtcaggcagtgaaactgcttcgggtatttctgatggtgatgtggatctggagacgtcatctagtatgccagagaggacagccacccttcttgatctgtattctggctgtgggggcatgtccactggtctttgcttgggtgcagctctttctgggttgaaacttgaaactcgatgggctgttgaccttaacagttttgcgtgccaaagtttaaagtacaatcatccacagactgaggcatgagtagtgcgaaatgagaaagccgatgagtttcttgctctccttaaggaatgggcagtcctatgtgagaaatatgtccaagacatagattcgaatttagcaggttcagaggatcaagaggatgaaggcagccctctcgacaaggacgaatttgttgtagagaagcttattgggatatgctatggtggcagtggaaggaaaaacggcatctattttaaggtccagtgggaaggatatggtcctgaagaggatacatgggaaccgattgataacctgagtgactgcccactgaaaattagagaatttgtacaagaagggcacagaagaaaaattctcccgctgcctggtgatgttgatgtcatttgtggaggcccaccatgtcaaggtatcagtgggtttaatcggttcagaaaccgtgacgagccacttaaagatgagaaaaacaagcaaatggtgactttcatggatattgtggcgtacttgaagcccaagtatgttctcatggaaaatgttgtggacatactgaaatttgctgatggttacctaggaaaatatgctttgagctgcctagttgctatgaagtaccaagcacgccttggaatgatggtagcaggctgctatggtctgccacagttcaggatgcgtgtgttcctctggggtgctctttcttcgatggtgctccctaagtatcctctgcccacatacgacgttgtagtacgtggaggagctcctaatgccttttcacaatgtatcgttgcatatgatgagacagaaaaaccatccctgaagaaagcattgctccttggggatgcaatttcagatttaccaaaggttgaaaaccatcaacctaacgatgtaatggagtatggtggttcccccaagacagaattccagcgctacattcgacttggtcgtaaagacatgttggattggtcctttggtgaggaggctggtccagatgaaggcaagctcttggatcaccagcccttacggcttaacaacgacgattatgagcgggttcagcaaattcctgtcaagaagggagccaacttccgtgacctaaagggtgtcaaggttggagcaaacaatattgtgagtgggatccagaaatcgagcgtgtgaaactttcatctggaaaaccactggttcctgactatgcgatgtcattcatcaagggcaaatcacccaagccatttgggcgcctgtggtgggacgagacagttcctacagttgtaaccagagcagagcctcacaaccaggctatattgcatccgactcaagcaagagtcctgactgtccgggagaacgcaaggttacagggcttccctgattactacagattgtttggcccgatcaaggagaagtatattcaagtcgggaacgcagtagctgtccctgttgcccgggcgctgggctactgtttggggcaagcctacctgggtgagtctgaggggagtcaccctctgtaccagctgcctccaagtttcaccgctttggggcaaactgcggtacaggcgagggcctcttctgttggcactcctgcaggcgaggtggttgagcagtaaaaggatacagagctgagctgagcagggcaacagccaacggcaggagcatctctggttgggtccgattcagacccattaaatagcatgtttaccaatgaataatctgcgtatcgtgctgattcttatgattggagatgaatgtagggagggtgcacttgagctcgagtgcttgtcgtactgtactgtactgtaggttgaggtttcaaaacattaactagccatgtatcgtgttggaatatgagttattgatggtggccttatctcccgttgatagattgtcatccgggagggagaggcctactgaaaggatggtttgctgatcgtgctgtaaagagatcaacagttcctgcttgatgtttgccaaagaatttttagtggacatgcaaacgcttgcacttaagatgtacttggctatttggttttgttcctttccggattatgtattgaactggaatcaataatcgctaataagtgatttgcccaggtcgtggtacaacc

SEQ ID NO: 4795 - DNA, 3265 bp, Zea mays
ccgctcccgcctcctctctgccctgtttccacatttgaccgatcctcttcgattcgatttctacacccccagagcttgccaaacccctcgtctcccaaccctagagagcagcagcagcagcagcagctaccgcatcccttgccatggcgccaagctccccgtcatccgctaggcccacgcgcgcctccggccggaagcgctccgccatggccgaggagatccaccagaaccaggaggaggaggaggaggttgtggctgcgtccaccgccaagcgcagacgcaaggcggcgtcttccgggaagaagcccaagccgacgcccaagcaggccaaaccggccgtggcggggatgaagaagaagggggagaccgagaagacggagcccgttgtggacgacgtgtgcgccgaggagcccgacgaggaggagttggccatgggcgaggaggaggcggaggccgaggagcaggccatgcaggaggtggtggccgcggtcgcggccgggtcgcccggtaagaagagggtggggagaaggagcgccgccgcctcgggcgaccacgtgcccgagttcatcggcagccccgttgctgcggccgaggcgcacagcaactggcccaagcgctacgagcgcagcactgccgcaaataaaccggaggaggacgatgagctcaaggccaggtgccactaccggagcgctaaggtggacaacattgtctactgcctcggggatgacgtttatgtcaaggctggagaaaatgaggctgattacattggtcgcattactgaattttttgagggcactgatcgatgccactattttacttgccgttggtttttccgtgcagaggacacggtcatcaattcgttggtgtcgattaatgttgatggccacaagcatgaccctagacgtgtttttctttccgaggaaaagaatgacaatgtgcttgattgcatcatctccaaggtcaagatagtccatgttgatccaaatatggatccaaaagctaaggcccaactgatagaacattgtgacctatactatgacatgtcttactctgttgcatattctacatttgctaatatctcatcagaaaatgggcagtcaggcagtgaaaccgcttcgggtatttcttctgatgatgcgggtttggagacgtcatctaatatgccagagaggacagcaacccttcttgacttgtattcgggctgtgggggcatgtccactggtctttgcttgggtgctgctctttctggcctgaaacttgaaactcgatgggctgttgatcttaacagttttgcgtgccaaagtttaaaatacaatcatccacagactgaggtgcgaaatgagaaagctgatgagtttcttgctctccttaaggaatgggcagtcttatgtgaaaaatatgttcatcaagacgtggattcgaatttagcaggttcagaggatcaagaggatgctgacactcttgacaaggatgaatttgttgtacagaagcttattggaatacgctatgatggcactggaaggaaaaaaggcgtatattttaaggtccaatgggaaggatatggtcctgaagaggatacatgggaacctattgataacctgagtgactgtccgctgaaaattagagaatttgtacaagaagggcgcaaaagaaaaattctcccgcttcctggtgatgttgatgtcatttgtggaggcccaccatgtcaaggtataagtgggtttaatcggttcaggaaccgtgatgagccacttaaagatgagaaaaacaagcaaatggtgactttcatggatattgtggcatacttgaagcccaagtatgttctcatggaaaatgtcgtggacatactgaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtgctccctaagtatcctctgcctacatatgacgttgtagtacgtggaggagcacctaatgccttttcgcaatgtatggttgcatatgatgagacacaaaggccatccctgaagaaagctttgcttcttggtgatgcattttcagatttaccaaaggtcgaaaaccatcaacctaacgatgtaatggagtatggtggttcccccaagacagagttccagcgctacattcgacttggtcgtaaagacatgttggattggtcgtttggtgaggaggctggtccagatgaaggcaagctcttggatcaccagcccttacggcttaacaatgatgattatgagcgggttaagcaaattcctgtcaagaagggagccaacttccgtgacctaaagggtgtcaaggttggagcaaataatgttgttgagtgggatccagaagtcgaacgtgtgtacctttcgtctgggaaaccactggttcctgactatgcgatgtcattcatcaagggcaaatcactcaagccattcgggcgcctgtggtgggacgagacggttcctacagttgtgaccagagcagagcctcataaccaggttatattgcatccgactcaagcaagagtcttgactatccgggagaacgcaaggttacagggcttccccgattactaccgattgtttggaccgatcaaggagaagtatattcaagtcgggaacgcagtggcagtccctgttgcacgggcactgggctactgtctgggtcaagcctacctgggtgaatctgacgggagtcagcctctgtaccagctgcctgcaagttttacctctgtggggcgaaccgcggttcaggcgaatgccgtttctgttggcactcctgcgggggaggtagtcgagcagtaaaaggatagcggagcaaccctggttggtattttgattcgagcccatccagtagcatgtttaccaataaataatcattggtcgtgctgattcttatggttggagatgaatgtatgtagggtgtactcgagctcgagtgcttgttgtactgtaggttgaggtttctcatccattggcctgcctatttgtggatgacgtttcatttcagattagcaatgtgcttatttaaggtttcgtcatgtacctgtattctacaatccactattgtttccaaagacagcatttgatccttgttcaacgcgagcagattttcgtccaccaaagctgtgtagggatcgaaatgtcaacaatgaattgagtcattcaatcatttgtct

SEQ ID NO: 4796 - DNA, 4850 bp, Setaria italica
ctccccctcctccctcccctgttttcacatctcgccaatccgattcgattcgactcgatttcaaaaccccccggagctctcacgcttcccccaagcccctcatctcccaaaccctagtgactagcgagagcagcagcagctgccgcgcagccctcgccatggcgccgagctctccgtcctccgccgcgcccacgcgcgcctccgggcggaagcgcgccgccaaggccgaggagatccatcggaaccaggaggaagaggaggaggtcgcggcggcgtcctccgccaagcgccgccgcggagcgtcctccgggaagaagcccaagccgccgcccaagcaggccaagacggccaaggcggggaggaagaagaaggcggaggcggagagggcggagcccgtggaggacgacgtgtgcgccgaggagccggacgaggaggagatggccatgggcgaggaggaggcggcggccgaggccgaggagcaggaggcggccgcggccgccgcggggtcgccggggaagaagagggtggcgcagcccaggaaaaggggcaccgccgccgccggggaccacgagccggagttcgtcggcgagcccgtccccgcggccgaggcccgcgccaactggcccaagcgctacgaccgcagcgccgccgccaggaggccggaggaggacgaggaggtcaaggccaggtgtcactaccggagcgccaaggtggacaacatcgtctacacccttggcgacgatgtctatgtcaaggctgaagaaaacgaggctgattatattggtcgcattactgaatttttcgaggggactgaccgctgtcaatattttacttgccgttggttcttccgtcctgaggacacggttatcaattccttggtgtgcatagatgttgatgggaagaagcatgaccccagacgtgtttttctttctgaggaaaagaatgacaatgtgcttgattgcattatatcaaaggtcaagatagtccatgttgatccaaatatggatccgaaagccaaggctcagctaatagagcattgtgacttgtactatgacatgtcttactccgtagcatattctacatttgctaatatcccatcagaaaatggggcatcaggcagtgaaactgcttctggtatttcttccgatgatatggatttggagacatcatctggtgcgccagtgagaacagcaaccctacttgatctatattctggctgtgggggcatgtccactggactttgcttgggtgcagcacttgcaggcctgaaacttgaaacgcgatgggctgttgacctcaacagctatgcatgccagagtttaaagtacaatcatccacaaactgaggttcggaatgagaaagccgacgagtttcttgctcttcttaaggaatgggcagttctttgtgacaaatatgtccacaaagatgtgggttcggattcagcaggctcagaggatcaagaggatgatggcagccctcttgataaggatgaattcgttgtagagaagcttattgggatatgttatggtggcagtggcagagaaaatggcctctattttaaggtccaatgggcaggatatggtcctgaagaagatacatgggagcccattgataacctcagtgactgcccactgaaaattaaagaatttgtacaagaagggtacaggagaaaaattttgccattgcctggtgatgttgatgtcatttgtggaggtccaccatgccaagggataagtgggtttaaccgtttcaggaatcgtaatgagccccttaaagatgaaaaaaacaagcaaatggtgactttcatggatattgtggcatacttgaagcccaagtatgttcttatggaaaatgttgtggacatactaaaatttgctgatggctacctaggaagatatgctttgagctgcctggtcgcaatgaactaccaagcacggcttggaatgatggtggctggctgttatggtctgccacaattccggatgcgtgtgtttctttggggtgctctttcatccatggttctcccaaagtaccctcttcctacgcatgatgttgttgtgcgtggaggggctcctaatgctttttctcaaagcattgttgcatatgatgaaactcaaaggccttccttaaaaaaggccttgcttcttggcgatgctatttcagacttaccacaggttgagaattatcagcctcatgatgtaatggaatatacttcttcccccaagacagaattccagcgctatattcgacttggtcgtaaagacatgttggattggtcctttggggaggaggctggtccagatgaaggcaaactgttggatcaccagcccttacggctgaataatgatgattatgagcgtgttaaacagattcctgttaagaagggagccaatttccgagacctcaagggtgtaaaggttggagcaaacaacatagttgagtgggatccagaaattgaacgtgtgtacctgtcgtctgggaaaccactggttccggattatgcgatgtcattcatcaaggggaggtcacctaagccatttgggcgcctgtggtgggatgagacagttcctactgtcgtgaccagagcagaaccgcataaccagattatattgcatccgactcaggcaagagttcttacagtccgggagaacgcgagattgcagggcttccctgattactaccgattgtttggcccgatcaaggaaaagtacattcaagtcggcaacgcagtggctgtccctgttgcccgagcactgggctactgtctggggcaagcgttcctgggcgaatcagaggggagtcagccgctgtatgagctgcctgcaagcttcacctctgtggcacgtgtggcacaggtgggggcttcgtctgtcagcactcctgcaggggagatggcctccgctccacagtcgtcgccatcgtcgggcaactcaacgcagtcgccgccgccctccccatcgccaccgccgccctcgccaccaccctcacaagcatcaatctcaccgccaaaggtcgaatcatcctcatttccggcggccaagttatcacccccgccgccagcaccaagaaaaagcggtgggtctgggaatggtggggagactagctatagtagctccaaagatggaaagaagaagtcgtcatcgtcgccgtctgcgccggatcatgtgggcgctgtgatcaccggcgtggtgcttggagtggtgggtttcgctctgttgatggccatcgtggcgtgcctgtgctgctcgaggaagaagaagaaacgtccacccccaatgaacatgcccttctacaccgacgagaaaggcaatgtgtactacccgaacgctggtctgccgccgatgtggcagcagtatggcagcaacggcagcatccctcctccgccggggtggcaccagcacggcggtgggaacccactgtcccagtcgccgggctcgatggcggcgcccctgagcggtgagatctactcgtcgggtccccacggccctgccctcccgccgccctcgccgaacgtggcgctgggcttctccaagagctccttctcgtacgaggagctggcggcggcgacatcgggtttctcggcggggaacatgctgggccaaggcgggttcgggtacgtgcacaagggcgtgctcgccggcagcgggaaggaggtggcggtgaagcagctcaagtccggcagcgggcagggcgagcgcgagttccaggcggaggtggagatcatcagccgcgtccaccaccgccacctcgtctccctcgtcggctactgcatcgccggcaaccagcgcatgctcgtctacgagttcgtgcccaacaacacgctggagcaccacctgtacagcaagcagggccccgtcatggactggcccacccgcatgaagatcgcgctgggctccgccaagggcctcgcctacctccacgaggactgccacccccggatcatccaccgcgacatcaaggcctccaacatcctcctggacgccaacttcgaggccatggtcgccgacttcgggctcgccaagctcaccacggacaccaacacgcacgtgtccacgcgcgtgatgggcaccttcggctacctcgcgccggagtacgcgtccagcgggaagctcacggaccggtccgacgtcttctccttcggcgtcatgctgctggagctcctcacggggcggcggcccatcgacaccgccaactacatggaggacagcctcgtggactgggcgcggccgctgctcgccgccgcgctggcgggggaggccgggttcgaggagcttgtcgacgcgcggctcggcggcgagtactcggcggtggaggtggagcgcatggcggcgtgcgccgcggcgagcacgcggcactcggccaagcgccggcccaagatgagccagatcgtgcgcgcgctcgagggcgacgcgtcgctcgacgacctgcaccaggacggcgtgaagccagggcagagcatgctattctccgccggtggatccgagaacatctcccggctccggcagctcgccttcgacagcggcgagcacgacgactacaccacggactacagcaccgactcctccgccgccaccaccggccgaccacctcgcaggccatgatcgtctatccacttaccacaacactacttatatgtatacatatatacatatattttaatatatatgtactgtacttactagatcaattgggtaaaaccgtaaaagagagagggaggagatccatgcatggaagagggacgggagcaagcgatgatcttgggatgaggagattgctggaattgatgttgttgctgggcctgctatacatgcattctactggatcatatcgatggttttatgtatgcagga

SEQ ID NO: 4797 - DNA, 3110 bp, Pennisetum glaucum
ccgccgtggccacgcgctcctccgggcggaagcgcgccgccgccaaggccgaggagatccgccggaaccaggaggaggaggcggaggaggtccctgcggcgtccaacgccaagcgccgccgcggggcgtcctcctccgggaagaagcccaagccgccgaccaagcaggccaaggcagggaggaagaagaaggcggaggcggagagcgcggatcccgtggaggacgacgtgtgcgccgaggagccggatgaggaggagatggccatgggcgaggaggaggcggaggccgaggcccaggagcaggaggcggccacggcggcggccgcggggtcgccggggaagaagagggtgacgcagccgaggaaaaggggcgccgtcgccgccggggaccacgagccggagttcgtcggcgagcctgtccccgccgccgaggcgcgcgccaactggcccaagcgctacgaccgcagcaccgccgccaggggtccggaggacgacgaggaggtcaaggccaggtgtcactaccggagcgccaaggtggacaacatcgtctacacccttggcgacgatgtctatgtcaaggctgaagaaaacaaggctgattatattggtcgcattactgaattttttgaggggactgaccactgtcaatattttacttgccgttggttcttccgtcctgaggacacggttattgattccttggtgtgcatcaatgttgatgggaagaagcatgaccccaaacgtgtttttctttctgaggaaaagaatgataatgtgcttgattgcatcatatcaaaggtcaagatagtccatgttgatccaaatatggatctgaaagccaaggccaagttgatagagcattgtgatctgtattatgacatgtcttactccgtagcatattctacatttgctaatatcccatcagaaaatggggcatcaggcagtgaaacagcatctggtatttcttctgatgatatggatttggagacatcatctggtgctccagggagaacagcaaccctacttgatttatattctggctgtgggggcatgtccacaggactttgcttgggtgcagcacttgcaggcctgaaacttgaaacacgttgggctgttgaccttaacagctatgcatgcgagagtttgaagtacaatcatccaaaaactgaggttcggaatgagaaagccgatgagtttcttgctctccttaaggaatgggcagttctttgtgacaaatatgtccacaaagatgtgggttcggattcagcaggctcggtggatcaagaggatgatggcagccctcttgataaggatgagtttgttgttgagaagcttattgggatatgttatggtggcagtggcaggaaagatggcatctattttaaggtgcaatgggcaggatatggtcctgaagaggatacatgggagcccattgataacctcagtgactgcccactcaaaattaaagaatttgtacaagaagggtacaagagaaaagttttgccattgcctggtgatgttgatgtcatttgtggaggtccaccatgccaaggaataagtgggtttaaccgattcaggaatcgtaatgagccccttaaagatgagaaaaacaaacaactggtgactttcatggatattgtggcatacttgaagcccaagtatgttcttatggaaaatgtagtggacatactaaaatttgctgatggctacctaggaagatatgctttgagctgcctggttgccatgaactaccaagcacggcttggaatgatggtggctggctgttatggcctgccacaattccggatgcgcgtgttcctttggggtgctctttcttccatggttctcccaaagtaccctcttcctacgcatgatgttgttgtgcgtggaggggctcctaatgctttttctcaaagcattgttgcctatgatgaaactcaaaggcccgtcttaaaaaaggccttgcttcttggtgatgctatgtcagacttaccaccggttgagaatcatcagccaaatgatgtaatggaatatacttcttcccctaagacagatttccagcgctatattcgacttggtcgtaaagacatgttggattggtcctttggggaggagactggtccagatgaaggcaaactcttggatcaccagcccttacggctgaataatgatgattatgaacgtgttaagcagattccttttaagaagggagccaatttccgagacctcaagggtgtaaaggttggagcaaacaatatcgttgagtgggatccggatgttgaacgtgtgtacctggcgtctgggaaaccactggttccggattatgcaatgtcattcatcaagggaaggtcacttaagccatttgggcgcctgtggtgggatgagacagttcctactgtcgtcaccagagcagaacctcataaccagactatattgcatccgactcaggcaagagttcttacaatccgggagaatgcaagattgcagggcttccctgattactaccgattgttcggcccgatcaaggaaaagtacattcaagttggcaacgcagtggctgtccctgttgcccgggcactgggctactgtctggggcaagccttcctgggcgaatcacaggggagtgaaccgctgtatgagctgcctgcaagtttcacctatgtggcaggcgttgcacaggccggggcttcctctgtcagcactcctgcaggggaggtggttgagcagtaaaaagaaggcaaaactgagcaaggcaatgccaggggtgactctgattgggttcgacctgggtccatccaagagcatgttctaataatgttatgttattgttctggttcgtagattggattgaatgtagccatgggtggcactcgagcttgagtgtctgttgtactgtatggtgaggcaacacattcagtagcctagttgtagcttgtaggagacccttcttatgtcttctcaatttggcaatctgatggtttgacgcggcattgtgtatgtgtatttggagagaccattgtcagatgaaagagaaaccattgatgcgcgtaattgtactaaatgcaaataatttttcattacaaaaaaaaaaaaaaaaaaagtaaaactact

SEQ ID NO: 4798 - DNA, 1575 bp, Sorghum bicolor
cttcggcagcagcatctggtaacagtagtttcctttgctatataaaggggaggaacgcaggagtctgatggcaagcagcaagctaaccgagcgagggagctctgagctagctagcaacgcgtagcaactcggccggctagtagcttggatcgccatgaacatgggcggcaggaccccggcggcggcgacgacgacgatccggtgcaagtactgcagcgcgtgcctcaccgtgtgccccggcgagcgcgccgtccagtgcacgcaatgctgcggcgtcacgcgcatccggcggtccttgtcctcgcggatcccgctgccgccggcgatgacgaggccggcggcgcccatgggcgccttcccgtgctcccgcggcaagaagcgcgccgtcctgatcggcatctcgtacgccagcgtgcgccggggctgcggccagctgaggggacccatcaacgacgtcaagtgcatgaggcagctcctctgccagcgcttcgccttccccagcgactccatcatcatgctcactgatgagcagaaggacccgttgaggctgccgaccaaggacaacatccggatggcgatgcgatggctggtgcaggggtgcagcagcggcgactccctggtgttccatttctccgggcgaggctcgcaggtcgccgacgaggactgcgacgagctggacgggtacgacgaggccatctgcccgctggactcgttcgacaagggccccatcctggacgacgagatcaacgagaccatcgtccgcccgctggtgtacggcgccaagctccacgccgtcgtcgacgcctgccacagcgccaccgtcctcgacctccccttcctctgcaacatgtccaggaccgggaactggcagtgggaggatcaccgtcccccgtcgggcgtctgcaagggcaccagcggcggccaggcggtgctcatcagcggctacagcgacggcaaaaccaagttcagcgtgacgccggaggcctgcgcgacggtgggggccatgacgcacagcttcctcaaggcggtggagtgcgagcagcagggggtcacctacggccgcctgctcacctccatgaaagccttcatgaccaacgccggcggctgcaaccagctgcagggtcctatctgcgcgggcgtgcccgcccgcaaggtcgccaacttcagcggcgtgcaggaacctaacctgtcctgctcggagatgttcgacgtctatcgcaagccctttgcgctgtaaactgccgtctctcctctggctttgccattgcagactacatactgctgccgtctggactctataaaatgccttgtcgtcggaactcggaacaataaaccagacgggtttaagcatgacatatgcttgctaatgatgtgtgtctaattgtctatgtgtcaataatgtgtgtctgtctatgtgtcaccgccgtgaggcaagctcatagcttgtggaggacccaatgttgatcatatcgtccatggctcccgagcctagtactgtaccttatggcggcccattgtaataataaggctattgtttctcttttacatgactctaaaatgaactaagtgttatgg

SEQ ID NO: 4799 - DNA, 3034 bp, Sorghum bicolor
gttctgcgcgtcgtcctcgccttgcttcgtacgtcgtcgtccccggcgtccggcgtccgggaaagcggcgatggaggcggcgctgggggcgctgtgccgcgccggagggtggtcgtacgcggccgtctggcgcttccatccccaagaccctcggttgctcacattgggggactgctactctgaagatgaggcaaaaacaatggttcagaagatgcttaatctcgttgaaattgttggggaaggcatcctaggagaagctctagtaagcggagagtgtcaatggatttacgacgatacttgccatgtgttgaatcagacaagccatgctgataacagagacttatatctggattatacttggtggcagcatcagtttctgaatgggataaagactattgcagtattgcctcttcagttacagggactggtgcaatttggttccacacggaaggttcccaggagttcaattcttttgaatcaagtcagagatatatttgatcggatgaagaatgcttcaagcgatggtccaatggaatatacccacaactctcttgcatatggtcagcaacctatccttgcttcattgatatctgccaatgacatgctcgtacataataaggtcaacccattgcaaactgagaaacctgaggagaatattgagataacagaatctacaaggagttcgatgtgttctccaagcaattcacaaagatctttaaatgatttaacctcccatggtactggaaacaccagtacggatactcatatattggccatgcctgttaactccaagactatatatgagcttaaacgatttgataacgtcactaagttgtttcatcaaagtgctgatgacagagttggttttcaagtgaatcctagtaaagagcctggttctattattgctggtgtaatgtcaggatacaaaagttcgaacaatattcataggacagaaaatgattcatgtgatcaaaacacagaatataccccatacctttacactaccaccaactctgcaaattctggcttagatgaactttcttattctggcactggtttgtcgtcatcgtttacagcagtatctggaaaagttaaaaactgcctgcaaactgagagtgacaagtttctatgtaagtctgtatcattcagcagcaacccttgtgcttctaaaatccaagaaaatcgcctatcaccataccatgccctcatgcatgaacaatccctgatacctgacgatcctggagaatctgtgaggctcctctcacatgaagaatcatttaatgttcaaggtgactcaatgcaattcgaggatggtacccgctttacatgccaggataacagtacatttcctgaattaccaaacagatcacctgaagaagctactgctgaaactttagaaaaggaaagtagtggaaataacagtctgctggaaactatgatgcttgatcttagcactaatagctttgtgcaagattggtgggatgatagtgttctactggcagaaaaccttccaaattcaagtgaaaagcactcagagcctgctatagaattggccaataggcattcattgccaactggggagagaggcttgcctttcatacctgtcatcgaacaattactaggtgatgttgcacatccacctgctggacatagttcgcttgaggttgatgctactgctttagctggccgtgtttcagattatcagctgcctcagtttgcttttcgagattgcctaacagcacacaatgcacaagtcccatcactggcctgcagtaattatacatccagaaccggaagtgcccaaaatggttcttcagaagtgccatcagcaaacatatctgtggatgacacctgcagtttcaacacagcaaattccaagggaagtcagtcgagtaatcctgagggtaaggttgccaagagaagagctagagctggggagagtaccagacctagaccaaaagacagacaactgatacaagatcgcgttaaagaattacgagagattgtccctaatggtgcaaagtgtagcattgacgctttgttggagcgaacaattaagcatatgctgtttctacaaagtgtaaacaaatatgcagagaaaattaagcaagctgatgaaccaaagataatcgacaaagagagtggtgttgtcttgaaagacaacccagatgctggcagaaatggtggtgccacgtgggcctacgaggttgctgggcaaaccatggtttgcccaataatcattgaggatctttcaccacctggtcagatgcttgttgagatgctttgcgaggaacgtgggctctttctggagatagctgacaacatacgtggatttggtctcacgatattgaaaggacagatggagctccgtgatggcaagatatggtcgcggtttcttgttgaggcaaacagagaagtcacaaggatggatatatttttgtcgcttgttaagttactggaacagaacagccttgttcgatctaccgaccaaatggctaaggtcatgaataatggggttccatcatttgcaaaccatcagcgatctccaatgccagttccagtgggcattgctgagagactacagtgactgcaaaatgtttcaactagatagtgttaggtaccacgactgtaacatatctggtagccagaactccatgcattcgacagagcctagtgaagtgatagtctcactgctgctagaaatgccagtatcaagaacatgactgatgcaaacatgagcttctagtgcataaattacgaacttccctgattactggggtgtgatcagtgaagtggcattctttcctgcttagttagaaatcttaggttgacaccttgccccagagtagctaggctcttgatactggtgtttcttatgcagtgatggcagtgtagtaatgctagcttgcagtgccagagcctcagaggctataccggactattaccctctcccccctcattttgtgattatgatctgaatgattagcgagttacttatgcaagatatcagagcttaaaatgtactcgctgatct

SEQ ID NO: 4800 - DNA, 3761 bp, Sorghum bicolor
cttttccatccaaaaaaaaaagtttactagcttgaacacagcaactccgatccgttcctcggttaaaacagttggaagaagcagccgggcggggtgaaacagcctcagccagctttccccccaacgccaacgccaacgcgggccagtgccgtctccgtactggtactggacgtctctttctcgaaattctcttggctacagtctacaacttctgcagccgtccgtccgtccgtctccccaagtatatttatcagccccctctccccgtcgcctcgacgccctccgcttcgttctgcgcgtcgtcctcgccttgcttcgtacgtcgtcgtccccggcgtccggcgtccgggaaagcggcgatggaggcggcgctgggggcgctgtgccgcgccggagggtggtcgtacgcggccgtctggcgcttccatccccaagaccctcggttgctcacattgggggactgctactctgaagatgaggcaaaaacaatggttcagaagatgcttaatctcgttgaaattgttggggaaggcatcctaggagaagctctagtaagcggagagtgtcaatggatttacgacgatacttgccatgtgttgaatcagacaagccatgctgataacagagacttatatctggattatacttggtggcagcatcagtttctgaatgggataaagactattgcagtattgcctcttcagttacagggactggtgcaatttggttccacacggaaggttcccaggagttcaattcttttgaatcaagtcagagatatatttgatcggatgaagaatgcttcaagcgatggtccaatggaatatacccacaactctcttgcatatggtcagcaacctatccttgcttcattgatatctgccaatgacatgctcgtacataataaggtcaacccattgcaaactgagaaacctgaggagaatattgagataacagaatctacaaggagttcgatgtgttctccaagcaattcacaaagatctttaaatgatttaacctcccatggtactggaaacaccagtacggatactcatatattggccatgcctgttaactccaagactatatatgagcttaaacgatttgataacgtcactaagttgtttcatcaaagtgctgatgacagagttggttttcaagtgaatcctagtaaagagcctggttctattattgctggtgtaatgtcaggatacaaaagttcgaacaatattcataggacagaaaatgattcatgtgatcaaaacacagaatataccccatacctttacactaccaccaactctgcaaattctggcttagatgaactttcttattctggcactggtttgtcgtcatcgtttacagcagtatctggaaaagttaaaaactgcctgcaaactgagagtgacaagtttctatgtaagtctgtatcattcagcagcaacccttgtgcttctaaaatccaagaaaatcgcctatcaccataccatgccctcatgcatgaacaatccctgatacctgacgatcctggagaatctgtgaggctcctctcacatgaagaatcatttaatgttcaaggtgactcaatgcaattcgaggatggtacccgctttacatgccaggataacagtacatttcctgaattaccaaacagatcacctgaagaagctactgctgaaactttagaaaaggaaagtagtggaaataacagtctgctggaaactatgatgcttgatcttagcactaatagctttgtgcaagattggtgggatgatagtgttctactggcagaaaaccttccaaattcaagtgaaaagcactcagagcctgctatagaattggccaataggcattcattgccaactggggagagaggcttgcctttcatacctgtcatcgaacaattactaggtgatgttgcacatccacctgctggacatagttcgcttgaggttgatgctactgctttagctggccgtgtttcagattatcagctgcctcagtttgcttttcgagattgcctaacagcacacaatgcacaagtcccatcactggcctgcagtaattatacatccagaaccggaagtgcccaaaatggttcttcagaagtgccatcagcaaacatatctgtggatgacacctgcagtttcaacacagcaaattccaagggaagtcagtcgagtaatcctgagggtaaggttgccaagagaagagctagagctggggagagtaccagacctagaccaaaagacagacaactgatacaagatcgcgttaaagaattacgagagattgtccctaatggtgcaaagtgtagcattgacgctttgttggagcgaacaattaagcatatgctgtttctacaaagtgtaaacaaatatgcagagaaaattaagcaagctgatgaaccaaagataatcgacaaagagagtggtgttgtcttgaaagacaacccagatgctggcagaaatggtggtgccacgtgggcctacgaggttgctgggcaaaccatggtttgcccaataatcattgaggatctttcaccacctggtcagatgcttgttgagatgctttgcgaggaacgtgggctctttctggagatagctgacaacatacgtggatttggtctcacgatattgaaaggacagatggagctccgtgatggcaagatatggtcgcggtttcttgttgaggcaaacagagaagtcacaaggatggatatatttttgtcgcttgttaagttactggaacagaacagccttgttcgatctaccgaccaaatggctaaggtcatgaataatggggttccatcatttgcaaaccatcagcgatctccaatgccagttccagtgggcattgctgagagactacagtgactgcaaaatgtttcaactagatagtgttaggtaccacgactgtaacatatctggtagccagaactccatgcattcgacagagcctagtgaagtgatagtctcactgctgctagaaatgccagtatcaagaacatgactgatgcaaacatgagcttctagtgcataaattacgaacttccctgattactggggtgtgatcagtgaagtggcattctttcctgcttagttagaaatcttaggttgacaccttgccccagagtagctaggctcttgatactggtgtttcttatgcagtgatggcagtgtagtaatgctagcttgcagtgccagagcctcagaggctataccggactattaccctctcccccctcattttgtgattatgatctgaatgattagcgagttacttatgcaagatatcagagcttaaaatgtactcgctgatctctcaaaaaccaaaactttcattttagaggtacatttatattgaaccagttcccactagcacaactcatctatcacacgctcagagcaagaacaaatgtggagcactatgggaaactaccagctaacacaattccaatgctaagcactacatttcctcaggacctcagcaaagagaatggtagcacatgattcatgcatccccttcctcttgggtcaatctgactacctcgattaccaataaactaaactagccagcaatttaagttagtgctagtcgaacaacatctactgaaacaatcctaaaaaaactaaagagaaagacatcagtacctgtaatccagcaaatgcatataggggccctgggctttatttatagaaatacaaaggaaccatcacagaaatcaaagcggtggtcaaggaaaaccacatcatatctta

SEQ ID NO: 4801 - DNA, 3223 bp, Oryza sativa
cctggatccaaccatttttggtctaagatttggccgctgatcagtttgtaattagtttaatccgaacgtacggttgtctgattaattcctcttctccgaccggctcgctcacacgcacaaacacggcacactccactcactccactagcccccaacactgctactctcggtgctcccctcccctccccgcgctagctgtatgccgcctttataacgcggcgaggcagccagcttcccccaagcccagagcgacgcctcctcctcctcgcagctccgcgagatccacccggagcccggcaatcccaggcgaggtgtgagagttcttgatcgggtcggcataggggttttgttctgcagtacatgcgagagtgtgattgatggcatttggccgaggctcgaagatggacggcaggcggtcgtcgccgtcgtcgtcgctctgcacgacgaccaccgtcgtcgtgttcgtggcgctctgcctggtcggcgcctggatgatgacgtcatccaccatcttcccgctggagataacctcgaataagaaggcggcggtgaaggagcagccggcgagagttaactacggcgcgtccgaggaggcagcggcggcatccggcaacagtgctgaaggtgtggacaggtttggggacacggacaacaacgataatgcggttccggaggagccgaataacacggtcccttctgaagaagagaagttcagtgagaacacagtggagaagccagtggagagcagtgaagagaaggcgccaccgaaagaaaaggaggagagtaaggatacatttgatgatgcaaatgggaaaacagaacagtcgagcgccaaggaggatggggattctgaatcaggatctgggcagtcggatggttcaaagaatggcgacgacgaggagaagagtgaggagaagaaagatgatgagcaatctgatggtgagaggaaagatgatcaagaagagaaggctgaaggcagtggctcaaaggacacgactgaccagccacaaattgaggagacagtggatgaaagtggggagaagggtcagggtgcaaagtccaatgaggtattccctgatggggctcaatcagagcttctaaaggagtcaaacaccgagaacgggtcatttaaaacacaggatgcagagtcaaagaatgagaaggaatctcaagcagcatcaaattcttcagatgatgaaaccacatataactggaagttatgcaataacaatgctggaacagattacataccttgcctcgacaatgagaaggctatcaagaagcttcgaaccaccaaacattatgagcaccgtgagaggcattgccctgtggagcctcctacctgtgttgttccacttcctgaaggatataaacgcccagttgagtggcccacgagcagggacaaggtgtggtacagcaatgtcccccacactaagcttgctgagtacaaggggcaccaaaactgggttaaagtttctggggatcatctcctatttcccgggggtggcactcagttcaagaatggtgcacttcactacattgatactattcagcaggcattacctgatattgcatggggcaaacgaagccgtgtcattctagatgttggctgtggagttgctagctttggagggtacatgtttgagagagatgtactcacgatgtcatttgccccaaaagacgagcatgaagctcaagtacagtttgcacttgagagaggtattccagcaatatcagctgtcatgggcaccaaaaggctcccataccccagcagggtctttgatgtcattcattgcgctcgctgcagggtcccttggcacattgaaggtggcatgctattgctggaactgaaccgcctattacgccctggtggttacttcgtctggtctgccactcctgtttaccagaagctccctgaagatgtcgagatttggaatgccatgtcttctctaacaaaggccatgtgctggaaaatggttaacaagactaaggataagttaaatcaagttggtatggccatatatcagaagccaatggacaacagttgctatgagaaaagaccagaaaacagcccaccgttatgcaaggaaactgatgatgctgatgctgcatggaatgtacctttgcaagcatgtatgcacaaattgcctgctggccaatcagtccgagggtcaaaatggccagagacatggccacaaaggcttgagaagaccccctactggatagatgactctcatgttggaatctatggaaaaccaggaaacgaagattttgaggctgattatgctcattggaaacgagtcgtaagtaaatcttatgtgaatggcatgggaatcgactggtctaaagtaagaaacgtcatggacatgagagctgtatatggaggtttcgctgcagctttgagggaccaaaaagtctgggttatgaatattgtgccaacggattcagcagacacgctgcccattatttatgagcgtggcttgtttggtatgtaccatgactggtgtgaatctttcagcacttacccgagaacatacgaccttctgcatgcagaccatctcttctcaaagctaaaaaagagatgcaaattgttgccggtgtttgcggaggtcgacagaatattgaggccagaaggaaagctgattgtgagggataatgcagagacaataaacgaactgcaaggcatggtaaagtcgcttcagtgggaggttcgcatgacctacaccaagggtaacgagggtcttctatgtgtccaaaagtccatgtggcggcccaaggagatcgaggcaagcatgtgaaatatacagatgttcaagagaactgttactggttagtggtacattagactgaattttggctctagatatgcatactattcttgttgattctgaaaaggcataagccttgatgtaattgtagaatcattttttttctttcttgccaaacaaatgcactctatattctcttcttgctgtgctcttgctccattgctgtaaggttgtattggaacctggaagtgtcacaagtgtgacaagtgtcacaggcaaattatgttcaatccatacagccatgtagtgtacgagaaatttctttgtgttatttaggagaaccttacaaaagtttgtctgtcatatcagtcaaacattctggaactcatgggaactttggattctttcatgagttactgctcatcactcaacagtgacattataattttgtgcaa

SEQ ID NO: 4802 - DNA, 3112 bp, Oryza sativa
cacgcacaaacacggcacactccactcactccactagcccccaacactgctactctcggtgctcccctcccctccccgcgctagctgtatgccgcctttataacgcggcgaggcagccagcttcccccaagcccagagcgacgcctcctcctcctcgcagctccgcgagatccacccggagcccggcaatcccaggcgaggtgtgagagttcttgatcgggtcggcataggggttttgttctgcagtacatgcgagagtgtgattgatggcatttggccgaggctcgaagatggacggcaggcggtcgtcgccgtcgtcgtcgctctgcacgacgaccaccgtcgtcgtgttcgtggcgctctgcctggtcggcgcctggatgatgacgtcatccaccatcttcccgctggagataacctcgaataagaaggcggcggtgaaggagcagccggcgagagttaactacggcgcgtccgaggaggcagcggcggcatccggcaacagtgctgaaggtgtggacaggtttggggacacggacaacaacgataatgcggttccggaggagccgaataacacggtcccttctgaagaagagaagttcagtgagaacacagtggagaagccagtggagagcagtgaagagaaggcgccaccgaaagaaaaggaggagagtaaggatacatttgatgatgcaaatgggaaaacagaacagtcgagcgccaaggaggatggggattctgaatcaggatctgggcagtcggatggttcaaagaatggcgacgacgaggagaagagtgaggagaagaaagatgatgagcaatctgatggtgagaggaaagatgatcaagaagagaaggctgaaggcagtggctcaaaggacacgactgaccagccacaaattgaggagacagtggatgaaagtggggagaagggtcagggtgcaaagtccaatgaggtattccctgatggggctcaatcagagcttctaaaggagtcaaacaccgagaacgggtcatttaaaacacaggatgcagagtcaaagaatgagaaggaatctcaagcagcatcaaattcttcagatgatgaaaccacatataactggaagttatgcaataacaatgctggaacagattacataccttgcctcgacaatgagaaggctatcaagaagcttcgaaccaccaaacattatgagcaccgtgagaggcattgccctgtggagcctcctacctgtgttgttccacttcctgaaggatataaacgcccagttgagtggcccacgagcagggacaaggtgtggtacagcaatgtcccccacactaagcttgctgagtacaaggggcaccaaaactgggttaaagtttctggggatcatctcctatttcccgggggtggcactcagttcaagaatggtgcacttcactacattgatactattcagcaggcattacctgatattgcatggggcaaacgaagccgtgtcattctagatgttggctgtggagttgctagctttggagggtacatgtttgagagagatgtactcacgatgtcatttgccccaaaagacgagcatgaagctcaagtacagtttgcacttgagagaggtattccagcaatatcagctgtcatgggcaccaaaaggctcccataccccagcagggtctttgatgtcattcattgcgctcgctgcagggtcccttggcacattgaaggtggcatgctattgctggaactgaaccgcctattacgccctggtggttacttcgtctggtctgccactcctgtttaccagaagctccctgaagatgtcgagatttggaatgccatgtcttctctaacaaaggccatgtgctggaaaatggttaacaagactaaggataagttaaatcaagttggtatggccatatatcagaagccaatggacaacagttgctatgagaaaagaccagaaaacagcccaccgttatgcaaggaaactgatgatgctgatgctgcatggaatgtacctttgcaagcatgtatgcacaaattgcctgctggccaatcagtccgagggtcaaaatggccagagacatggccacaaaggcttgagaagaccccctactggatagatgactctcatgttggaatctatggaaaaccaggaaacgaagattttgaggctgattatgctcattggaaacgagtcgtaagtaaatcttatgtgaatggcatgggaatcgactggtctaaagtaagaaacgtcatggacatgagagctgtatatggaggtttcgctgcagctttgagggaccaaaaagtctgggttatgaatattgtgccaacggattcagcagacacgctgcccattatttatgagcgtggcttgtttggtatgtaccatgactggtgtgaatctttcagcacttacccgagaacatacgaccttctgcatgcagaccatctcttctcaaagctaaaaaagagatgcaaattgttgccggtgtttgcggaggtcgacagaatattgaggccagaaggaaagctgattgtgagggataatgcagagacaataaacgaactgcaaggcatggtaaagtcgcttcagtgggaggttcgcatgacctacaccaagggtaacgagggtcttctatgtgtccaaaagtccatgtggcggcccaaggagatcgaggcaagcatgtgaaatatacagatgttcaagagaactgttactggttagtggtacattagactgaattttggctctagatatgcatactattcttgttgattctgaaaaggcataagccttgatgtaattgtagaatcattttttttctttcttgccaaacaaatgcactctatattctcttcttgctgtgctcttgctccattgctgtaaggttgtattggaacctggaagtgtcacaagtgtgacaagtgtcacaggcaaattatgttcaatccatacagccatgtagtgtacgagaaatttctttgtgttatttaggagaaccttacaaaagtttgtctgtcatatcagtcaaacattctggaactcatgggaactttggattctttcatgagttactgctcatcactcaacagtgacattataattttgtgcaa

SEQ ID NO: 4803 - DNA, 2973 bp, Brachypodium distachyon
gaccccaaaggacgcctcactcccctcccctctcgagatcccctcggaatcggagctcagctcccccggccggcgaggtgcgcgcctgtgtgaccaagctgcaacctttgggttgtttggtcggtggactcgatataaacaagccgcgtggagtgggaggtgagctcgtcctgtacatgccagagtaggtttaatggcatttggccgaggtgcaaagatggacgggaggcggccttcgtcgccatcctcgtcgttgtgcacgacgaccaccgtcgtcgtttttgtggcgctctgcctggtcggtgcctggatgatgacatcgtccaccgtcttcccactagaggtatcctcttcaaataagaagtcggaaccattagatgcgtcgtcaaataagaaaccagaggtaagggatcagcgtgcagctgttgattttggcgcaaccgaggagtcaccatctggcaatgctggtggaagttcggcgaaattcgaggataccgacaataatgataatgttccagatgagtcgcacaataacagggatgctcctgaggaagagaagttcactgaggacacaatggagaagcctgtggagaggactgaggaaaaggaagcaccaaaagaaaaagatgaggttaaggattcatttgatgatgcaaatggaaaatcagaggtaaagaattcgaaggagggtggggaaactgggcgttctggtgacgaggaggggaaagacaatgagaccacaactgaaaatgatgttgatcaattcaatggagagaagaaggaagatcaagaaggaaagtctggtgatgatgccatgcaagatgcaactgaacagcctcaaatagaagagaaagttgaagaaagtggagagaaggaacaggctgcgaaggctaacgaggtgtttcctgatgcggctcaatctgaacttctgaaggagtcgaatactgagaatgggtcattctctacgcaggcagcagagtcaaagaaggagaaggaagcccaagcatcatcaaaatcttcaggtgatggaatcacatatagctggaaactatgtaatagcagtgccgtgacagattacataccttgccttgacaatgagaaggctattaagaagcttcattctacaaaacattatgaacatcgtgagaggcattgccctgacgagcctccgacttgccttgttccacttccagaaggatataagcggcccatcgagtggcccaagagcagggacaaggtatggtacagcaacgtccctcacaccaagcttgcagagtacaagggccatcaaaactgggttaaagtttctggggatcatctcttgtttcctgggggcgggacacagttcaagaatggcgcactccactacatcgatactattcagcaggcattacctgatattgcatggggtaaacgaagccgtgtcattctagatgttggttgtggggttgccagctttggaggctacatgtttgatagagatgtgctcacaatgtcatttgctccaaaagatgagcatgaagctcaagtacagtttgcgttggagagaggaattccagcaatatcagctgtaatgggcaccaagagacttccatatcccagcagggtttttgatgtcattcattgtgctcgctgcagagtcccttggcacattgaaggtggcaagcttttgctggaattgaaccgactactacgccctggtggttactttgtgtggtccgccactcctgtttaccaaaagctccctgaagatgttgagatatggaacgccatgtcttctctgacaaaatccatgtgctggaaaatggttaagaaaacaaaggatacactaaatcaagttggtatggccatatatcagaagccaatggacaacaattgctatgagaaaagatcagaagacagccctccattatgcaaggaaactgatgatgcagatgcttcatggaatattacattacaagcatgcatacataaattgcctgttggtccatcagtgagggggtcaaaatggccagagttttggcctcaaaggcttgagaagacccccttctggatcgatggctctcatgttggagtttatggaaaaccagcaaatgaagactttgaggcagattatgcacactggaagcgtgttgtaagtaaatcttacgtgaatggcatgggaatcgactggtctaaagtgagaaatgtcatggacatgagagctgtatatggcggttttgctgcagctctgaggggccagcgacaagtctgggttatgaatattgtgccaattgattctcctgacacactgcccataatttatgagcgtggcttgtttggaatgtatcatgattggtgtgaatctttcagcacttacccaagaacatatgacctactgcatgcagatcatctgttttcaaagctgaaaaagagatgcaaattgttgggagtctttgccgaggttgaccggatattgaggccagaaggcaaattgattgtgagggatagcgcagagacaataatcgaactcgaaggcatggcaaagtccctacactgggaggtaaccatgacctacgccaagggcaacgagggtttgctgtgcgtccagaaaaccatgtggcggcccaaggagatcgaagcaagcatgtgatatatatgttccaagataaattgttacttgtttaggggtacactagtctgaattttggctccagataagcatatgattctttccgatgctgaaggcaaaatgctttggtgcagctgtagaataatgtgtttgagtgtactcttcattctttctgagcttgaacaacattgttgtaaaatgtaacgttgtactggaagtcaatagttagagccagagaaggcacaattcttcaggaaaacctcactacagctacatgtatgcgatgacagtcccatattcttgaatacatggatgcccacacacaaaggaacttcaatgcatgtcatccttgaattctttca

SEQ ID NO: 4804 - DNA, 3715 bp, Brachypodium distachyon
tccttccgacttccgtccttcgctcacactttcacacactccactgctcgctcctagctgtagccctcctttataacgcggcgaggccagtgcgaatccgagaccccaaaggacgcctcactcccctcccctctcgagatcccctcggaatcggagctcagctcccccggccggcgaggtgcgcgcctgtgtgaccaagctgcaacctttgggttgtttggtcggtggactcgatataaacaagccgcgtggagtgggaggtgagctcgtcctgtacatgccagagtaggtttaatggcatttggccgaggtgcaaagatggacgggaggcggccttcgtcgccatcctcgtcgttgtgcacgacgaccaccgtcgtcgtttttgtggcgctctgcctggtcggtgcctggatgatgacatcgtccaccgtcttcccactagaggtatcctcttcaaataagaagtcggaaccattagatgcgtcgtcaaataagaaaccagaggtaagggatcagcgtgcagctgttgattttggcgcaaccgaggagtcaccatctggcaatgctggtggaagttcggcgaaattcgaggataccgacaataatgataatgttccagatgagtcgcacaataacagggatgctcctgaggaagagaagttcactgaggacacaatggagaagcctgtggagaggactgaggaaaaggaagcaccaaaagaaaaagatgaggttaaggattcatttgatgatgcaaatggaaaatcagaggtaaagaattcgaaggagggtggggaaactgggcgttctggtgacgaggaggggaaagacaatgagaccacaactgaaaatgatgttgatcaattcaatggagagaagaaggaagatcaagaaggaaagtctggtgatgatgccatgcaagatgcaactgaacagcctcaaatagaagagaaagttgaagaaagtggagagaaggaacaggctgcgaaggctaacgaggtgtttcctgatgcggctcaatctgaacttctgaaggagtcgaatactgagaatgggtcattctctacgcaggcagcagagtcaaagaaggagaaggaagcccaagcatcatcaaaatcttcaggtgatggaatcacatatagctggaaactatgtaatagcagtgccgtgacagattacataccttgccttgacaatgagaaggctattaagaagcttcattctacaaaacattatgaacatcgtgagaggcattgccctgacgagcctccgacttgccttgttccacttccagaaggatataagcggcccatcgagtggcccaagagcagggacaaggtatggtacagcaacgtccctcacaccaagcttgcagagtacaagggccatcaaaactgggttaaagtttctggggatcatctcttgtttcctgggggcgggacacagttcaagaatggcgcactccactacatcgatactattcagcaggcattacctgatattgcatggggtaaacgaagccgtgtcattctagatgttggttgtggggttgccagctttggaggctacatgtttgatagagatgtgctcacaatgtcatttgctccaaaagatgagcatgaagctcaagtacagtttgcgttggagagaggaattccagcaatatcagctgtaatgggcaccaagagacttccatatcccagcagggtttttgatgtcattcattgtgctcgctgcagagtcccttggcacattgaaggtggcaagcttttgctggaattgaaccgactactacgccctggtggttactttgtgtggtccgccactcctgtttaccaaaagctccctgaagatgttgagatatggaacgccatgtcttctctgacaaaatccatgtgctggaaaatggttaagaaaacaaaggatacactaaatcaagttggtatggccatatatcagaagccaatggacaacaattgctatgagaaaagatcagaagacagccctccattatgcaaggaaactgatgatgcagatgcttcatggaatattacattacaagcatgcatacataaattgcctgttggtccatcagtgagggggtcaaaatggccagagttttggcctcaaaggcttgagaagacccccttctggatcgatggctctcatgttggagtttatggaaaaccagcaaatgaagactttgaggcagattatgcacactggaagcgtgttgtaagtaaatcttacgtgaatggcatgggaatcgactggtctaaagtgagaaatgtcatggacatgagagctgtatatggcggttttgctgcagctctgaggggccagcgacaagtctgggttatgaatattgtgccaattgattctcctgacacactgcccataatttatgagcgtggcttgtttggaatgtatcatgattggtgtgaatctttcagcacttacccaagaacatatgacctactgcatgcagatcatctgttttcaaagctgaaaaagagatgcaaattgttgggagtctttgccgaggttgaccggatattgaggccagaaggcaaattgattgtgagggatagcgcagagacaataatcgaactcgaaggcatggcaaagtccctacactgggaggtaaccatgacctacgccaagggcaacgagggtttgctgtgcgtccagaaaaccatgtggcggcccaaggagatcgaagcaagcatgtgatatatatgttccaagataaattgttacttgtttaggggtacactagtctgaattttggctccagataagcatatgattctttccgatgctgaaggcaaaatgctttggtgcagctgtagaataatgtgtttgagtgtactcttcattctttctgagcttgaacaacattgttgtaaaatgtaacgttgtactggaagtcaatagttagagccagagaaggcacaattcttcaggaaaacctcactacagctacatgtatgcgatgacagtcccatattcttgaatacatggatgcccacacacaaaggaacttcaatgcatgtcatccttgaattctttcatgtgttgtttcccatcattcaaaactggcataagtatgatatgccaacattgtttggccgaagtccagttgaaaacagagagaacaacaacagcccagcaagggcaccccactgcggctgcggcaccgatcaacatggcaacatccgctaggacgactccaacaagattgaagctgctgccatcgctggcactggctttgccatgctacgctttcgcccgaagcacgaatgtgaaggagaatttgatgtcaatggacctttcgcatctgtcctgaagacctgaacatggagggaaagaacagagacatactctacgtccacggcccacgggtgatcggaagacgagtcagactagctagttcggaggccgaggtcgccgaaaagcaccagcagccaggcccagcgggtagcagccggagacctggagcctacgagtcatcagcagccggccggagcgagcctacgaggcaccggcagccacgaggtagcagccggaggccccaagcctatgaggaaacaacacatgccacgtacggaggccggaggggcagcgaatagtaacaggagttgcaactgacacggataacactcgagcccacacaagttgtggcagcccgggccgacggactccggacggtttc

SEQ ID NO: 4805 - DNA, 1013 bp, Saccharum officinarum
ttctcaccccctgcaacaatccttcgccgaatctacatggaaactgccgccgtcgccgcctccggtgccgggcgccgcatcatggtggccgtggacgagggcgaggagagcctgcacgcgctcaactggtgcctcgccaacgtggtgtccccggcaggaggcgacacgctgctgctcgtccacgcccgccgcccgcgcccggtctacgccgccatggacagcgcagggtacatgatgacctcggacgtgctggcgagcgtcgagaggcacgccaacgccgtctcggcggcggcggtcgacaaggccaagcgcgtctgcgccgaccacccgcacgtcaaggtggagacgatggtggagagcggggacccgagggacgtcatctgcgacgccgccgacaagatggccgcggacctgctcgtcatgggcagccatggttacggcttcatccagagggccttcttgggcagcgtcagcaaccactgcgcgcagaactgcaaatgcccggtcctcatcgtcaagaggcccaaggagtagaatggtcgtcgcatggacgagccaaatgtgccatggcgaaccacagcttagccaatgtgcaatggcgagtatgtggctttgttattggacatatttcgcatctcattgctgggcattgttttttgtagttcaaccaacatgatccaagcagctagtttctgctcatataaaatgttcggaacgaatatatcggcgatggatgtccggtgcataatttttcttgcaattggcattgttttttttaaggaaatcgtctcttgtttagtaattgagtttggatataataatcggtggtgtgtcactttattagataatagtttatcctacggtgtgcatccagattgttatatcttgttatgatgtctcctatatggaatttgacatagggctagttgtggagatgctaagattgtgataagccatagtggtaagcctaatttatagtgtgtgaataaaataatctcgttttacgttttcgt

SEQ ID NO: 4806 - DNA, 924 bp, Sorghum bicolor
agggcagagtcgcatggagacgggggcagccacagcctgagccaggcgccgaaccttttatagcggactctgctctcctcaattctcagtcaaaattgttctcacttctctcaccccctgcaacaatcgttcatcgcccgatctcgtgcttgctgcgtcctcggactcctgcgtggaaatggaaaccgccgccgtcgccgcctccgccgccgggcgccgcatcatggtggccgtggacgagggcgaggagagcctgcacgcgctcaactggtgcctcgccaacgtcgtctcaccggcgggaggcgacacgctggtgctcgtccatgcccgccgcccgcgcccggtctacgccgccatggacagcgcagggtacatgatgacctcggacgtgctggcgagcgtcgagaggcacgccaacgccatctcggcggcggcggtcgacaaggccaagcgcgtctgcgctggccacccgcacgtcaaggtggagacgatggtggagagcggggacccgcgggacgtcatctgcgacgccgccgacaagatggcggccgacctgctcgtcatgggcagccatggttacggcttcatccagagggcgttcttaggcagcgtcagcaaccactgcgcgcagaactgcaaatgcccggtcctcatcgtcaagaggcccaaggagtagaattttatgctgcagcttagccaatgtgcaatggcgagtgtcagattggcatcatatatgatatatgtacatatttcgcatctcattgcatggcagtgtcttttgtagttcaacaacattaatccaaagcactagttttctgctggaataagatgttcagacagatttttttgccaattactgtgttgtgtatatatccttgcatttgcaactcttgttcagagaaaagcatcattcatgttcagctg

SEQ ID NO: 4807 - DNA, 1092 bp, Sorghum bicolor
agaacatcgcatgggcatttcgggaaacgagaaaaccccggctgaggagtgaggagaaaacccagcggcggccgcggtcgcccaaacccagggcagagtcgcatggagacgggggcagccacagcctgagccaggcgccgaaccttttatagcggactctgctctcctcaattctcagtcaaaattgttctcacttctctcaccccctgcaacaatcgttcatcgcccgatctcgtgcttgctgcgtcctcggactcctgcgtggaaatggaaaccgccgccgtcgccgcctccgccgccgggcgccgcatcatggtggccgtggacgagggcgaggagagcctgcacgcgctcaactggtgcctcgccaacgtcgtctcaccggcgggaggcgacacgctggtgctcgtccatgcccgccgcccgcgcccggtctacgccgccatggacagcgcagggtacatgatgacctcggacgtgctggcgagcgtcgagaggcacgccaacgccatctcggcggcggcggtcgacaaggccaagcgcgtctgcgctggccacccgcacgtcaaggtggagacgatggtggagagcggggacccgcgggacgtcatctgcgacgccgccgacaagatggcggccgacctgctcgtcatgggcagccatggttacggcttcatccagagggcgttcttaggcagcgtcagcaaccactgcgcgcagaactgcaaatgcccggtcctcatcgtcaagaggcccaaggagtagaattttatgctgcagcttagccaatgtgcaatggcgagtgtcagattggcatcatatatgatatatgtacatatttcgcatctcattgcatggcagtgtcttttgtagttcaacaacattaatccaaagcactagttttctgctggaataagatgttcagacagatttttttgccaattactgtgttgtgtatatatccttgcatttgcaactcttgttcagagaaaagcatcattcatgttcagctgattgagagcttccttaacctttggttgcctcgccgagcgattaggcatctctgaaatctgaatgtgggtttagcctagc

SEQ ID NO: 4808 - DNA, 597 bp, Setaria italica
agccgggcgccgcatcgtggtggccgtggacgagggcgaggagagcgtgcacgcgctcacctggtgcctcgccaacgtcgtctccccggcgggcggcgacacgctcgtcctcgtgcacgcgcgccgctcgcgccccgtctacgccgccatggacagcgcagggtacatcatgacctcggacgtgctggcgagcgttgagaggcacgccaccgccgtctcggcggcggccgtcgacaaggcaaagcgcatctgcgccgagcacccgcacctggcggtcgagacgctggtggagagcggggacccgcgggacgtcatctgcgacgccaccgacaaggtgggcgccgacctgctcgtcatgggcagccatggatacggcttcatccagagggcgttcctgggcagcgtcagcaaccactgcgcgcagaactgcaagtgcccggtcctcatcgtcaagaggcctaaggagtagtagaatgacatccttgcaatgcaatgctgcagcttgcgagcctgtggcatcaactatatgtaaatatatattttttctcttcacatgccactggtttcttgttcaagaacatgatccgagcgcttcag

SEQ ID NO: 4809 - DNA, 1123 bp, Oryza sativa
catgggcattccaggaatccggagaaatgccacaaacccgaaaaccggcggctgcctcgccaaaacccaatgcaaggacgacgcccaccgcgccaccagatcggcaagcgtgacggctcatcgtcatcttccctccattaaatcggcagatcgactcggtgtccgcatctctccacttctccaaccaattgcccgattcatcgatctctcatcgttcgttcgctctagctaggttgaagactcgggagtctagctagctgctgtcgagagtgatggcgtcgtctgttcccgaggatggtgctagcgctgctgctgcggccgctactgctgaccctgctgctgctgcggctgaggctcccgggcgacgcatcgtggtggccgtggacgagagcgaggagagcacgcacgcgctcacctggtgcctcgccaacgtcgtctcctcctccggcggcgacacgctcgtgctgctccacgcccgccgcccccgccccgtctacgccgccatggacagctcagggtacatgatgacctcggacgtgatggcgagcatggacaagtacgccgccgccgtctccgccgcggcggtgggcaaggccaagcacatctgcgccgctttccctcacgtgacggtggagacgatggtggagagcggggacccgcgcgacgtcatctgcgacgccaccgagaagatggccgccgatctgctggtcatgggcacccatggatacggcctcatccagagggcgttcctgggaagcgtgagcaatcactgtgcgcagaactgcaaatgcccagtgctgattgtcaagaggccaaaataatagttgctaagtaatatacttagtactggtaataaagctcaactaatgcagagcttgctagtttgatgtttgtaaatattggcatgtcatgcttggtttgttgatcgagaacaaaagctatatgttgtttggtggcatggcagcgttcgatgttcagcgaccgatgcggatctgcggatctgttggcaccttgtaatggttgaaatttgcaggctatttgactttttctatgcatctgagtaattttaattcacaaatccgaatgtgttaagccggtgaatgttcacgcatttcaactagac

SEQ ID NO: 4810 - DNA, 1012 bp, Oryza sativa
aggaatccggagaaatgccacaaacccgaaaaccggcggctgcctcgccaaaacccaatgcaaggacgacgcccaccgcgccaccagatcggcaagcgtgacggctcatcgtcatcttccctccattaaatcggcagatcgactcggtctaggttgaagactcgggagtctagctagctgctgtcgagagtgatggcgtcgtctgttcccgaggatggtgctagcgctgctgctgcggccgctactgctgaccctgctgctgctgcggctgaggctcccgggcgacgcatcgtggtggccgtggacgagagcgaggagagcacgcacgcgctcacctggtgcctcgccaacgtcgtctcctcctccggcggcgacacgctcgtgctgctccacgcccgccgcccccgccccgtctacgccgccatggacagctcagggtacatgatgacctcggacgtgatggcgagcatggacaagtacgccgccgccgtctccgccgcggcggtgggcaaggccaagcacatctgcgccgctttccctcacgtgacggtggagacgatggtggagagcggggacccgcgcgacgtcatctgcgacgccaccgagaagatggccgccgatctgctggtcatgggcacccatggatacggcctcatccagagggcgttcctgggaagcgtgagcaatcactgtgcgcagaactgcaaatgcccagtgctgattgtcaagaggccaaaataatagttgctaagtaatatacttagtactggtaataaagctcaactaatgcagagcttgctagtttgatgtttgtaaatattggcatgtcatgcttggtttgttgatcgagaacaaaagctatatgttgtttggtggcatggcagcgttcgatgttcagcgaccgatgcggatctgcggatctgttggcaccttgtaatggttgaaatttgcaggctatttgactttttctatgcatctgagtaattttaattcacaaatccgaatgtgttaa

SEQ ID NO: 4811 - DNA, 1486 bp, Triticum aestivum
cgccgcacatctcgcctccccccgtttgctcacgagatctccctaatcacacctcttcccccgccgctctcggttttactgaccggcaccggaaaagatagagaagcgccgcgcgcgtcggctggttcctggtcccgccgccctcccctgcccgcttctcccgatccccttccgagtttagttggctgacatggctgccgaatcccagaccgagagtggcaactgcagtgcctgggcggcaaaagatccttctggagtactctccccacacagtttcaaccgtagggctgtacgacatgacgatgtttccttgaggatcacacattgcggtgtctgttatgctgatgttatctggacaaaaaataggcacaatgactcggtgtaccctttagtccctgggcatgagattgctggagttgtaaccgaggttggttcagacgtcaagggcttcaaactgggcgaccatgtggctgttgggacatatgtcaactcatgccgtgactgtgacaactgcaatagcttcctcgataaccactgctcaaagtttgttttcactttcaatggtgttgatactgacggtactgtcacaaagggaggatattccagtcacattgttgttcatgaacggtattgctataaaatacctgatggctacccactggaaaaggccgcacctttagtttgtgctgggatcactgtgtacagtccgatgatgcgacataacatgaaccagccaggaaagtcactcggtgtcattggtctcggtgggttgggtcacatggcagtgaaatttgggaaagcctttggactgaaggtgactgttcttagtacaagtgaatcgaaaagagatgaagcaatcagcctccttggtgcagataactttgtggtatcatcagataaaacacagatggagtccctgaaaaattctctggatttcattgtcgatactgcctctggtgaccacccattcgacccttatctcacgcttctgaaagttcgtggcctaatggcactagttggctttcctggagaaatcagagtgcatcctgcaacacttaatctcggtgcacggactttatccggtagtgtaaccggaggcacaaaggatacccaggagatgataaacttctgcgcggcaaacaaaatctacccagatattgaggttataaagatagactacatcaacgaggctctcgagaggcttgtcaaccgggatgtgaggtaccggtttgtaatcgacatagagagctctttaaagtaatatcttcgcagttggcacatctcgaatcattatagaagtgtgtagaataagttgaatcgtccacacaatcacgactcattgttaatggagagggctttcctctgtaatgttctgatatactttcatgtccatgtgttaaacttgcgtttcaaatttcatgattactttgaactaggcagttcataaaacatcaaaaggttgttatatcttaaaagattatattga

SEQ ID NO: 4812 - DNA, 1441 bp, Avena sativa
ggaggcaccgcgtcggcttgctggttcccttcccgcttcctgctcctcccaacgatcacagtttaggttgtctttgcagttcagtcgggatggctgctgaatccgagagttgcaactgcgatgcatgggcagcgaaggatccttcaggagtactctccccatacagattcagccgtaggactgtgcaacgtgacgatgtttcattgagaatcacgcattgtggagtctgttatgctgatgttgtctggacaagaaataagcacaatgactcggtgtaccctttagtccctgggcacgagattgctggagttgtaactgaggttggttcagacgtcaagggcttcaaagcgggggaccatgtggctgttgggacatatgtgaattcatgccgtgactgcgacaactgcaatagcttcctcgagaaccactgctcaaaatttgttttcactttcaatggtgttgatacagatggtactgtcacaaagggaggatattccacgcacaccgtagtccatgaacggtactgctacaaaatacctgatggttacccactggaaaaggcagcacctttagtttgtgctggaatcactgtgtacactccaatgatgcgacataacatgaaccaaccgggaaagtcacttggtgtcattggtcttggtgggttgggtcacatggcagtaaaatttgcaaaagcctttggactgaaggtgacagtttttagtaccagtgaatccaagagagatgaagctatcagccttcttggtgcagataattttgttttatcatcaaatgaaaaacagatggggtccctgaaaaattccctgcacttcattgtggatactgcctctggtaaccacccattcgacccttatctcgcacttctaaagttggtggcgtaatggcgctggtcggctttcctggagaaatcagagtgcatcctgcaacacttaacctgggcgcacggagtttatctggcagcgtaaccggaggcacgaaggacacccaggagatgataaacttttgtgcggcaaacaaaatctaccctgagattgagttgataaagatagactacatcaatgaggctcttgagaggcttgttaaccgggatgtcaggtaccggtttgtaatcgacatcgagagctctttcaagtgatatcttcgcagttggcattattttgagatccttattaaagtactaagaaacttagcgcggcgacatgctgtgcccgttagcatattccaactttattagtttcgttagtagttagcgacaattattatggattggagggagtatcaatatgtataaaactatgtacaaaggacattgttgttgcatatgtaaatctcagtgatacattttagcaggcaaactccccatagatacatttttggtaccatttccatccttgaaccaggagctaataaaaatgtcattctt

SEQ ID NO: 4813 - DNA, 1351 bp, Triticum aestivum
ccacgcgtccgagaaaccggaacccccgtttgctcgcgcgtcggctggtttcaggttccgccgccctgcctgattctcccgatccccttccgagttttgctgcccggcatggctgctgaatccgagagctgcaactgcagtgcctgggcagcaaatgatccttctggagtactctcccctcacagtttcaaccgtagggctgtacgacatgatgatgtttctttgaggatcacacactgcggtgtctgttatgctgatgttcagtggacaagaaatttgcaccatgactcggtgtaccctttagtccctgggcatgagattgctggagttgtaaccgaggttggttcggacgtcaagggcttcaaaccgggcgaccatgtggctgttgggacatacattaactcatgccgtgactgtgacaactgcaataacctcctcgagaaccactgctcaaactttgttttcactttcaacggtgttgatacggacggtactgtcacaaagggaggatattccactcacattgtagttcatgaacggtactgctataaaatacctgatggctacccactggacaaggccgcacctttagcttgtgctgggatcactgtgtatacaccgatgatccggcataacatgaaccagccggggaagtcacttggggttattggtcttggtgggttgggtcacatggcagtgaaatttgggaaagcctttggactgaatgtgacagttttgagtacaagtgaatcgaaaagagatgaagctatcaaccttcttggtgcagataattttgtggtatcatcagataaaaaccagatggagttcctgaaaaattctctggatttcattgtcgatactgcctctggtgaccacccatttgacccttatctcgcgcttctgaaagttcgtggcacaatggcactagttggctttcctggcgaaatcagagtgcatcctgcaacacttaatctgggtgcacggactctatctggcagtgtagttggaggcacaaaggatacccaggagatgataaatttctgcgcggcaaacagaatatacccaaatgttgaggtgataaaaatagactacatcaacgaggctctcgagaggcttgtcaaccgggatgtgaagtatcggtttgtaatcgacatagagagctctttcaagtaatatctttcgcggttggcacattttcgaatccttataaaagtgtgtagaataaagttgaatcttccaaacaatcgcggctgactggtaatagagggctttcctctgtaatgttctggtatgctttccggtccgtgatagaagattgttgtgaagatacgcatattactttcagaaaata

SEQ ID NO: 4814 - DNA, 1319 bp, Triticum aestivum
tcacacctcttcccccgccgctctccgttctaccgaccggcaccggaaaagatagagacgccccgcgcgcgtcggctggctcctggttccgtccgccgtccccccactgcccgcttctcccgatccccttccgagtttagttggctggctggctggctggcatggctgctgaatcccagaccgagactggcaactgcagtgcctgggcggcaaaagatccttctggaatactctccccacacagtttcaaccgtaggactgtacgacatgacgatgtctctttgaggatcacgcattgtggtgtctgttacgccgatgttatctggacaaaaaataggcacaatgactcggtgtaccctttagtccctgggcatgaaattgctggagttgtaactgaggttggttcagatgtcaagggcttcaaactgggcgaccatgtggctgtcgggacatatgtcaactcatgccgtgactgtgacaactgcaatagcttcctcgagaaccactgctcaaagtttgttttcactttcaatggtgtcgatacggacggtgctgtcacaaagggaggatattccactcacattgtagttcatgaacggtactgctataaaatacctgatggctatccattggaaaaggcagcacctttggtttgtgctgggatcactgtgtatactccgatgacgcgacataacatgaaccagccgggaaagtcactgggtgtcattggtcttggtgggttgggtcacatggcagtgaaatttgggaaagcctttggcctgaaggtgactgttcttagtacaagtgaatcgaaaagagatgaagcaatcagcgttcttggtgcagataattttgtggtgtcatcagataaaaaacagatggagtccctgaaaaattctttggacttcattgtcgatactgcctctggtgaccacccatttgacccttatctcgcacttctgaaagttggtggcgtaatggcgctagttggctttcctggagaaatcagagtgcatcctgcaacacttaatctgggtgcacggactttgtctggtagtgtgactggaggcacgaaggacacccaggagatgatgaacttctgcgcggcaaacaaaatctacccagagattgaggttataaagatagactacgtcaacgaggcccttgagaggcttgtcaaccgggatgtgaggtaccggtttgtaatcgacatagagggctctttcaagtaatacgctcgcggctggcacattttgaatccttataaaagcatgtggaataagttgaatcttgtgggaatggagggctttcttctgtaa

SEQ ID NO: 4815 - DNA, 1400 bp, Leymus cinereus x Leymus triticoides
ccggccacgtctccgctcaccaccgccgcacatctcccctacctccgtttgcacacgagatctatctattcacacctcttcccccgccgctctcggctgtagaccggcaccggaaagatagagacgcgcgcgtcggctggttcctggtgccgccgccccgccctccacggcccgcttctcccgatccccttccgagtttagttggttggcatggctgctgaatccgagagtggcaactgtagtgcttgggcagcaaaagatccttctggaatactctccccacacagtttcaaccgtaggactgtacgacatgatgatgtttctttgaggatcacacattgtggtgtctgttatgctgatgttatctggacaaaaaataggcacaatgactcggtgtaccctttagtccctgggcatgagattgctggagttgtaactgaggttggttcagacgtcaagggcttcaaactgggcgaccatgtggccgttgggacatatgtcaactcatgccgtgactgtgagaactgcaatagcttcctcgagaaccactgctcaaaatttgttttcactttcaatggtgttgatacggacggtactgtcacaaagggaggatattccactcacattgtagttcatgaacggtactgctataaaatacctgatggctacccgctagaaaaggcagcacctttagtttgtgctggaatcactgtgtatactccgatgacgcgacataacatgaaccagccgggaaagtcaattggtgtcattggtcttggtgggttgggtcacatggcagtgaaatttgggaaagcctttggactgaaggtgactgttcttagtacaagtgaatcgaaaagagatgaagcaatcagccttcttggtgcagataattttgtggtatcatcagataaaaaacagatggagtccctgaaaagttctctggacttcgttgtcgatactgcctctggtgaccacccatttgacctgtatctcgcgcttctgaaagttggtggcctaatggcactagttggctttcctggagaaatcagagtgcatcctgcaacacttaatctgggtgcacggactttatctgggagtgtaaccggaggcacgaaggacacccaggagatgataaacttctgtgcggcaaacaaaatctacccagatgttgaggtgataaagatagactacatcaacgaggctctcgagaggcttgtcaaccgggatgtgaggtaccggtttgtaatcgacatagagagctctttcaagtaatatctttgtggttggcacattttgaatcctatgaaagtatgtaaaataagttgaatcttccacacaatcgcgactgattgttaatagagagggcttcccactgtaatgctctgatatattttcca

SEQ ID NO: 4816 - DNA, 1382 bp, Triticum aestivum
tcacacctcttcccccgccgctctccgctgcactgaccggcaccggaaaagatagagactccccgcgcgcatcggctggctcctggttccgtccgccgtccccccactgcccgcttctcccgatcccctctcgagtttagttgcctggctggcatggctgctgaatcccagaccgagagtggcaactgcagtgcctgggcggcaaaagatccttctggagtactctccccacacagtttcaaccgtaggactgtgcgacatgacgatgtttctttgaggatcacgcattgtggtgtctgttacgctgatgttatctggacaaaaaataggcacaatgactcggtgtaccctttagtccctgggcatgaaattgctggagttgtaactgaggttggttcagatgtcaagggcttcaaactgggcgaccatgtggctgttgggacatatgtcaactcatgccgcgactgtgacaactgcaatagcttcctcgagaaccactgctcaaaatttgttttcactttcaatggtgttgatacggacggtactgtcacaaagggaggatattccagtcacattgtagttcatgaaaggtactgctataaaatacctgatggttacccactggagaaggcagcaccgttagtttgtgctggaatcactgtgtacactccgatgatgcgacataacatgaaacagccgggaaagtcacttggtgtcgttggtcttggtgggttgggtcacatggcagtgaaatttgggaaagcctttggactgaaggtgactgttcttagcacaagtgaatcaaagagagatgaagcaatcagccttcttggtgcagataattttgtggtatcatcagatataagacagatggagtccctgaaaaattctctggacttcattgttgatactgcctctggtgaccacccatttgacccgtatctcgcgcttctgaaagttggtggcataatggcactagttggctttcctggagaaatcagagtgcatcctgcgacacttaatctgggtgcacggactttatctggcagtgtaaccggaggcacgaaggacacccaggagatgataaacttctgcacggcaaacaaaatctacccagatattgaattgataaagatagactacatcaacgaggctcttgagaggctggtcaaccgggatgtgaggtaccggtttgtaatcgacatagagagctctttaaagtaatatctccgcggttggcacatttcggatccttatggaagcatgtagaataagtagaatcttgcacacaatcgcgactgttttcctctgtaatgttgtgatatattttcctgtcccatgtgtttcgataacgcatatgttatgtggggacagcagtaaag

SEQ ID NO: 4817 - DNA, 1453 bp, Secale cereale
ctcttccgccgccgctctccgtcctactgaccggcaccggaaaagatagaggcgcgtcggctgcttcctggtcccgccgccggccgccctcccctgcctgcttctcccgatcccctcccgagtttagttggctgccatggctgctggatccgagaccgagagtggcaactgcagtgcctgggcagccaaagatccttctggaacactctccccacacagtttcaaccgtaggactgtacgacatgatgatgtttctttgaggatcacacattgtggtgtctgttacgctgatgttatctggacaaaaaataggcacaatgactcggtgtaccctttagtccctgggcacgagattgctggagttgtaaccgaggttggttcagacgtcaagggcttcaaactgggtgaccatgtggctgttgggacatatgtcaactcatgtcgtgattgtgagaactgcaatagcttcctcgagaaccactgctcaaagtttgttttcactttcaacggtgttgatactgacggtactgtcacaaagggtggatattccagtcacattgtagttcatgaacggtactgctataaaatacctgatggttacccactggagaaggcagcaccattagtttgtgctggaatcactgtgtacacgccgatgatgcgacataacatgaaacagccgggaaagtcacttggtgttgttggtcttggtgggttgggtcacatggcagtgaaatttgggaaagcctttggactgaaggtgactgttcttagtacaagcgaatcaaaaagagatgaagcaattagccttcttggtgcagataattttgtggtatcagcagataaaaaacagatggagtccctgaaaagttcgatggacttcattgttgatactgcctctggtgatcacccatttgacccatatctcgtgcttctgaaagttggtggcgtaatggcactagttggctttcctggagaaatcagagtgcatcctgcaacacttaatctgggtgcacggactttatctggcagtgtaaccggaggcacgaaggacacccaggagatgataaacttctgcgcggcaaacaaaatctacccagatattgaattgataaagatagactacatcaacgaggctcttgagaggcttgtcaaccgggatgtgaggtaccggtttgtaatcgacatagagagctctttaaagtaatatcttcgcggttggcacatctcgaatccttatagaagtatgtagaataagttgaatcctccacacaatcgcgattgctttcctctgtagtgttctgatatattttcctgtccatgtctttcgataactcatatgttatgtggggacaaaacttgtctttcagatttcacaattactttgaactaggcagttcaaaaaacatcaaaaggttgtatacaccttaaagaatatattgatttccttgct

SEQ ID NO: 4818 - DNA, 1260 bp, Secale cereale
gcgcggtcacgcgcgcctttcactgctcgatacccgtttcttccgttcggttcgtcatcgtatcgtagtttagttggctgccatggctgctgaatcagagaccaagagcggcaactgcagtgcctgggcggcaaaagatccttctggcatactctccccacacagtttcaaccgtaggactgtacgacatgatgatgtttctttgaggatcacacattgtggtgtctgttacgctgatgttatctggacaaaaaataggcacaatgactcggtgtaccctttagtccctgggcacgagattgctggagttgtaaccgaggttggttccgacgtcaagggtttcaaactgggcgaccatgtggctgttgggacatatgtcaactcatgccgtgactgtgacaactgcaatagcttcctcgagaaccactgctcaaagtttgttttcactttcaacggtgttgatactgacggtactgtcacaaagggtggatattccagtcacattgtagttcatgaacggtactgctataaaatacctgatggttacccaatggagaaggcagcaccattagtttgtgctggaatcactgtgtacactccgatgatgcgacataacatgaaacagccgggaaagtcacttggtgtcgttggtcttggtgggttgggtcacatggcagtgaaatttgggaaagcctttggactgaaggtgactgttcttagtacaagcgaatcaaaaagagatgaagcaatcagcctgcttggtgcagataattttgtggtatcatcagataaaaaacagatggagtccctgaaaaattctctggacttcattgtcgatactgcctctggtgaccacccattcgacccttatcttgcgcttctgaaagttcgtggcctaatggcattagttggctttcctggagaaatcagagtacatcctgcgacacttaatctcggtgcacggactttatctggtagtgtaaccggaggcacaaaggatacccaggagatgataaacttctgcgcggcaaacaaaatctacccagatattgaggttataaagatagactacatcaacgaggctctcgagaggcttgtcaaccgggatgtgaggtaccggtttgtaatagacatagagagctctttaaagtaatatcttcgcagttggcacatcacgaatcattatataagtgtgtataataagttgaatcgtccacacaatcgcgactcgttgttaatggagagggctttcctctttaa

SEQ ID NO: 4819 - DNA, 1391 bp, Hordeum vulgare
ggaagtcaaaccggccacggcagcgctcaccaccgccgcacatctcccctacctccgtttgcacacgggaacgggatcccctcttctctattcaccacgcttgcttcttcccccgccgctctcagtttaactggcgcccgccgcgcgcgtcggctggatcctgattccgccgccctgcccgctcctcccgatccccgaccgagtttagttggctggcatggctgctgaatccgggacagagagtggcaactgcagtgcttgggcagcaaaagatccttctggactactctccccgcacactttcaaccgtaggactgtacgacatgatgatgtttctttgaggatcacacattgtggtgtctgttatgccgatgttatctggacaaaaaataggcacaatgactcggtgtaccctttagtccctgggcatgagattgctggagttgtaaccgaggttggttcagacgtcaagggcttcaagctgggtgaccatgtggctgtggggacatatgtcaactcatgccgtgactgtgacaactgcaatagcttcctcgagaaccactgctcaaaatttgttttcactttcaatggtgttgatacggatggtactgtcacaaagggaggatattccagtcacattgtagttcatgaacggtactgctataaaatacctgatggctacccactggaaaaggccgcacctttagtttgtgctggaatcactgtgtacactccgatgacgcgacataacatgaaccagccagggaagtcacttggtgttgtcggtcttggtgggttgggtcacatggcagtgaaatttgggaaagcctttggactgaaggtgactgttttgagtacaagtgaatcgaaaagagatgaagcaatcaaccttcttggtgcagataattttgtggtttcatcagataaaaaacagatggagtccctgaaaagttccctggacttcattgtcgatactgcctctggtgaccacccatttgacccgtatcttgcgcttctgaaagttggtggcctgatggcactagttggcttccctggagaaatcagagtgcatccagcaacacttaatctgggtgcacggactttatctgggagtgtaaccggaggcacgaaggacacacaggagatgataaacttctgtgcggcaaacaaaatctacccagacattgagttgataaagatagactacatcaaccaggctctcgagaggcttgtcaaccgggatgtgaggtaccggtttgtaatcgacatagagagctctttaaagtgataatatgttcgcgattggcccatctcgaatccttataaaaacatgtaaaataagttgaatcttccacacaatggtgactgattgttaataaaaggctttcctc

SEQ ID NO: 4820 - DNA, 1051 bp, Secale cereale
ggcaactgcagtgcctgggcggcaaaagatccttctggcatactctccccacacagtttcaaccgtaggactgtacgacatgatgatgtttctttgcggatcacacactgtggtgtttgttacgccgatgttatctggacaaaaaataggcacaatgactcggtgtaccctttagtccctgggcacgagattgctggagttgtaaccgaggttggttcagacgtcaagggcttcaaactgggtgaccatgtggctgttgggacatatgtcaactcatgtcgtgattgtgacaactgcaatagcttcctcgagaaccactgctcaaagtttgttttcactttcaatggtgttgatacggacggtactgtcacaaagggaggatattccagccacattgtagttcatgaacggtactgctataaaatacctgatggttacccactggagaaggcagcgccgttagtttgtgctggaatcactgtgtacactccgatgatgcgacataacatgaaacagccgggaaagtcacttggtgtcgttggtcttggtgggttgggtcacatggcagtgaaatttgggaaagcctttggactgaaggtgactgttcttagtacaagcgaatcaaaaagagatgaagcaatcagcctgcttggtgcagataattttgtggtatcatcagataaaaaacagatggagtccctgaaaagttcgcttgacttcattgttgatacggcctctggtgaccacccatttgacccgtatctcgcgcttctgaaagttggtggcgtaatggcactagttgggtttcctggagaaatcagagtgcatcctgcgacacttaatctgggtgcacggactttatctggcagtgtaaccggaggtacgaaggacacccaggagatgataaacttctgcgcggaaaacaaaatctacccagatattgaattgataaagatagactacatcaacgaggctcttgagaggcttgtcaccgggatgtgaggtaccggtttgtatcgacatagagagctctttaaaagtaatatcttcg

SEQ ID NO: 4821 - DNA, 1166 bp, Zea mays
ctcctcccactccccctctcactcctacgcgcacgcacagcaccgcgcccggcaggccgcactccgctccacgctctcgccccgcacaatgcgccgcctcagccgcgccgtggcgttcctgctgctgctccttcccctcgccctcgcggccacaaccacgatggcggcggccgtcgtggcgaaagctcccgctgcggcggcggcgcctccgaacgtgacggcggagatggccaagggcgggtgcaaggcgttcgcggacctgatcgcggcgtcccccgacgcgtcgtccacgtaccagtcggccgtggagggcggcatgacggcgttctgcccctccgacgacgccgtgagggccttcctgcccaagtacaggaacctcagcgcggacgggaaggcggagctgctgctgttccacgccgtgccggtgcactactcgctggggagcctcaagtccaacaacgggcccatgaacacgctggccaccgacggcgccgccaggagcttcaacttcacggtgcagagccagggcgacgccgtcacgatcaggacggccgccgccgccgcgcccgcgcgggtcgagtccacggtgctggacaaggaccccctcgccatctacgtcatcgacgccgtggtggagcccgtggagctcttcaagcccgcgccgtcgccgtcgccgacgcccgcgcccgcgcctgccgcggatgcgcccaaggctggcaacggcaaggccgccgcgcgccagcgccacccggcgcccgccgtggccgacgcgcccggccccgccgcggaagacgacgctgctcctgtggaccagaaggacgtcaagaagagcgcggccgatggcgcgccgtgctcccggtggtggctcgccgccgcgctggccgcggcctcggcattggtttagcgatccatggacggaagtgctttgtttttttttgtcttttttttgtttctccggtgttgatccattggcgtgtgatcgtggttgtggtggcgtgcttcgaggtttgtgtttttttttctcggtcgagagaaaatagtgtatgcgtgcttacgtattcgtgagtgagggtgaggctcagtgcgagtttatgaggaggtgtttgtatttttggttctgacggacgagtgaaatctgggcactggctgaattgccgcttgtgacg

SEQ ID NO: 4822 - DNA, 1131 bp, Sorghum bicolor
ccctctcactcccccacgcgcacgcacagcatccgctccagctccacgctctcgccccgcacaatgcgccgcctcagccgcgccgccgcgctccccctcctcctcctcctcgccctcgcagccgccaccaccaccacaacggtggcggcggcggcggcggcgaaggcgaaggctcccgcggcagcggcgccgccagcgcctccgaacgtgacggcggagatggccaagggcgggtgcaaggcgttcgcggacctgatcgcggcgtccccggacgcgtcgtcgacgtaccagtcggccgtggagggcggcctgacggtgttctgcccctccgacgacgccgtgcgtgcgttcctgccaaaatacaagaacctcagcgcggacgggaaggcggagctgctgctgttccacgccgtgccggtgcactactcgctggggagcctcaagtccaacaacgggcccatgaacacgctggccaccgacggcgccgcccggaacttcaacttcacggtgcagaaccagggcgacgtcgtcaccatccggacggccgccggcagcggcgcgcccgcaagggtcaagtccacggcggtcgacaaggacccgctcgctgtctacgtcatcaacgccgtggtggagcccgtggagctgttcaagcccgcgccgtcgccgacgccggcccccgcgcccgcgcccgccgccgcggcggacgcgcccaaggccgggaagaagggcgccgcgcgccacgcgccgcccgccgtggccgacgcgcccgggcccaacgcggacgacaacgcggctcctgtggaccagaaggacgccaacaagaagagcgcggccgccggcgcgccgtgcgaccggtggtggctcgccaccgtgctggcggcggccgtggcctcagcattggcttagcgatcgatggaagggctttcttttttttgcgttttgtttatttttttttccggtgatgatccattggcgtgtgatcgtggtttgtgatggcgtgcttgcgaggtttctgtttttttttttctcgatcgggagaaaatagtgtatgcttgcttgttacataatattcgagctcctgtttaagccttgtttagtttgagaaaaattttggatttcgctactgcagca

SEQ ID NO: 4823 - DNA, 1275 bp, Sorghum bicolor
gaaaaaaaaaacgaagcaatggcatgccatgcaaataacctgaacaccaggggggcagtggcatcactctcacacaccgagctaaagtgcacgccactgtccatcctgttgccactcccctctcactcccccacgcgcacgcacagcatccgctccagctccacgctctcgccccgcacaatgcgccgcctcagccgcgccgccgcgctccccctcctcctcctcctcgccctcgcagccgccaccaccaccacaacggtggcggcggcggcggcggcgaaggcgaaggctcccgcggcagcggcgccgccagcgcctccgaacgtgacggcggagatggccaagggcgggtgcaaggcgttcgcggacctgatcgcggcgtccccggacgcgtcgtcgacgtaccagtcggccgtggagggcggcctgacggtgttctgcccctccgacgacgccgtgcgtgcgttcctgccaaaatacaagaacctcagcgcggacgggaaggcggagctgctgctgttccacgccgtgccggtgcactactcgctggggagcctcaagtccaacaacgggcccatgaacacgctggccaccgacggcgccgcccggaacttcaacttcacggtgcagaaccagggcgacgtcgtcaccatccggacggccgccggcagcggcgcgcccgcaagggtcaagtccacggcggtcgacaaggacccgctcgctgtctacgtcatcaacgccgtggtggagcccgtggagctgttcaagcccgcgccgtcgccgacgccggcccccgcgcccgcgcccgccgccgcggcggacgcgcccaaggccgggaagaagggcgccgcgcgccacgcgccgcccgccgtggccgacgcgcccgggcccaacgcggacgacaacgcggctcctgtggaccagaaggacgccaacaagaagagcgcggccgccggcgcgccgtgcgaccggtggtggctcgccaccgtgctggcggcggccgtggcctcagcattggcttagcgatcgatggaagggctttcttttttttgcgttttgtttatttttttttccggtgatgatccattggcgtgtgatcgtggtttgtgatggcgtgcttgcgaggtttctgtttttttttttctcgatcgggagaaaatagtgtatgcttgcttgttacataatattcgagctcctgtttaagccttgtttagtttgagaaaaattttggatttcgctactgcagcactttcgtttgtttatatcaaatattat

SEQ ID NO: 4824 - DNA, 1765 bp, Pennisetum glaucum
cggggcctccatgaacggtgtcggttttcccccaaatctgcgcagcgcatcgccagatttcccgcggcggccgagatggtggggagcgtgggcaacgggctcgcggatctgggcgcctcaatgaacggggcctccatgaacggtgtcgggaaggtggcggcggcggacccgctcccgatggagattgagccgccggcggacgtgatggcggcggctgcggcggccgaggcggaggggccggccgcgaacgggaggaaggagatcgtgatgggcaggaacgtgcacacctcctgcttcgcggtcaaggagcccgacgcggacgacgaggtcaccggcgagcgggaggcaaccatggccagcgtcctcgcgctctaccgccggtccctcgtcgagcgcaccaagcaccacctcggttacccatacaatcttgactttgattacggtgcactggggcagctgcagcacttctccattaacaaccttggagaccctttcattgagagcaactatggtgtccattcccggcagtttgaggttggagtccttgattggtttgctcgcctctgggagttggaaaaggatgagtactggggagataccactaactgctgcacagaaggaaatctgcatgggattcttgttgggagggaggtgtttcctgatggaatcttgtatgcctcccgtgagtcccattattcagtattcaaagcagcaaggatgtacaggatggattgtgtcaaggtcgacacccttatgtctggggaaatagattgtgctgatttccagagaaagatactgcagaaccgagacaagcctgccatcattaatgtcaacattggtacaactgtgaagggagcagttgatgatctagacttggttatcaaaacccttgaggaaagcggctttaaagaccggttttatattcattgtgatggtgccctatttggattgatgataccttttgtcaagaaggcacctaaagtgacatttaaaaagcctattgggagtgtcagtgtctctgggcacaagtttgttggatgcccgatgccatgtggtgtccagataacaagattggagcacattaacgtcctttctagcaatgtggagtatctggcgtcaagggatgcgacgatcatgggaagcaggaatggccatgctcctatcttcctctggtacaccctcaacaggaagggttacagaggctttcagaaggaagtccagaaatgcttgagaaacgcacattacctgaaagatcgcctcaaggaatcaggaattggagcgatgcttaatgagctcagcagcacggttgtgtttgaaaggccaaaggatgaggagtttgtgcgaaggtggcagcttgcctgcgaggggaatatagcccatgttgtggtgatgcccagcgtcaacattgacaagttggactatttcctgaatgaactagtggagaagcgggcgacctggtaccaggatggaacaagcaagccaccctgccttgccagggacttaggcgtggagaactgcctctgtggccttcacaagtagtgtgagccttttgtgaccagcggtgttcattcgcgagttgagttagtcctcgctaatgtgttatgttgtactgtatccatgcgttctgtatgtgatagtgtgttatcccgtgtagcctatttgttgtcatgagaataaaattccttaagtagatgggtggaaattgtagctcatttggtgtcataccataacattccttcaatcaaattgataggtggaagttgca

SEQ ID NO: 4825 - DNA, 1709 bp, Brachypodium distachyon
atggcgcatagctcgacccatgaagccactacgagagccgagtcaaccaaccattcctcgcccgcccagccgccagctcctgcagtctccgcctctgcctccacccttctcgaatccacaatcccactctccagttcggccgccatggcgggcagcgtcagcaatggcctggcagagctagggaagcgggggctccccgaagaggccgcagcggcggctgcggagccgctgcccgaggagctggagccggaggtagcggaggggataagggagatcgtgatggggagaaacgtgcacgcgtcgtgcttcgcggttaaggagcccgacgccgacgacgaggtcaccggcgagcgggaggccaccatggccggcgtcctcgcgcggtaccgccgctgcctcatcgagcgcaccaagcaccatctcggctacccatacaatctggactttgattatggtgctcttgcccagctgcaacacttctccattaacaacctaggcgacccattcattgagagcaactatggtgtccactctaggcagtttgaagtgggtgtgttggactggtttgcgcgtttgtgggacctggaaaaggacgaatactggggatacattacaaactgtggcactgaaggaaatctgcatgggattcttgtaggaagagaagttttccctgatggggtcttgtatgcctctcgtgagtcccactactcagtattcaaagcagcaagaatgtacaggatggattgtgttaaagtggagactcttgtctctggagaaatagattgtactgattttggaagaaagctatttgaaaacaaagataaacctgctattattaatgtcaacattggaacaactgtcaagggggcagttgatgatcttgacttggttattgaaacacttgaaaaaactgggttccagaatcggttttatatacactgtgacggtgctctatttgggctgatgatgccatttgttaagctggcacctaaggtgtcctttaagaagcccattggaagtgtcagcgtgtctggtcacaagtttgttggatgccccatgccttgtggcgtccagataacaaggttgaagcacataaacgcccttgctagcaatgttgagtatctagcttcaagagatgctacaatcatgggaagcaggaatggtcatgctcccatcttcctctggtacaccctgaacaggaaaggttatagaggctttcagaaggaagtgcagaagtgcttgagaaatgcacattatctgaaagatcgtctcaggaatgctggaatcagtgcgatgcttaacgagctcagtagcacagtagtattcgagaggccaaaggatgaggagtttgtgcgacggtggcagcttgcttgcgagggaaatatatctcatgttgtggtaatgcctagtgtcaccatcaataagctggatagtttcttaaatgagttggtggagaagcgggtaacctggtaccaggaaggaatatgccaatctccttgcattgcaggagatgtaggccagcacaactgtctatgtactatgcataaggtgtgagtttgcctagggatgctctcttgttcatctgtgagttcaaatgttgaatagttgagtatttacattgttttatgttgtatatttcaccttacaatcttgcatcctttttgttccttttagttgtcatgcagtcaattaaaattaagtcaatgaat

SEQ ID NO: 4826 - DNA, 1803 bp, Brachypodium distachyon
tcgcccgcccagccgccagctcctgcagtctccgcctctgcctccacccttctcgaatccacaatcccactctccagttcggccgccatggcgggcagcgtcagcaatggcctggcagagctagggaagcgggggctccccgaagaggccgcagcggcggctgcggagccgctgcccgaggagctggagccggaggtagcggaggggataagggagatcgtgatggggagaaacgtgcacgcgtcgtgcttcgcggttaaggagcccgacgccgacgacgaggtcaccggcgagcgggaggccaccatggccggcgtcctcgcgcggtaccgccgctgcctcatcgagcgcaccaagcaccatctcggctacccatacaatctggactttgattatggtgctcttgcccagctgcaacacttctccattaacaacctaggcgacccattcattgagagcaactatggtgtccactctaggcagtttgaagtgggtgtgttggactggtttgcgcgtttgtgggacctggaaaaggacgaatactggggatacattacaaactgtggcactgaaggaaatctgcatgggattcttgtaggaagagaagttttccctgatggggtcttgtatgcctctcgtgagtcccactactcagtattcaaagcagcaagaatgtacaggatggattgtgttaaagtggagactcttgtctctggagaaatagattgtactgattttggaagaaagctatttgaaaacaaagataaacctgctattattaatgtcaacattggaacaactgtcaagggggcagttgatgatcttgacttggttattgaaacacttgaaaaaactgggttccagaatcggttttatatacactgtgacggtgctctatttgggctgatgatgccatttgttaagctggcacctaaggtgtcctttaagaagcccattggaagtgtcagcgtgtctggtcacaagtttgttggatgccccatgccttgtggcgtccagataacaaggttgaagcacataaacgcccttgctagcaatgttgagtatctagcttcaagagatgctacaatcatgggaagcaggaatggtcatgctcccatcttcctctggtacaccctgaacaggaaaggttatagaggctttcagaaggaagtgcagaagtgcttgagaaatgcacattatctgaaagatcgtctcaggaatgctggaatcagtgcgatgcttaacgagctcagtagcacagtagtattcgagaggccaaaggatgaggagtttgtgcgacggtggcagcttgcttgcgagggaaatatatctcatgttgtggtaatgcctagtgtcaccatcaataagctggatagtttcttaaatgagttggtggagaagcgggtaacctggtaccaggaaggaatatgccaatctccttgcattgcaggagatgtaggccagcacaactgtctatgtactatgcataaggtgtgagtttgcctagggatgctctcttgttcatctgtgagttcaaatgttgaatagttgagtatttacattgttttatgttgtatatttcaccttacaatcttgcatcctttttgttccttttagttgtcatgcagtcaattaaaattaagtcaatgaatcaagtttgtaccaactcaattcctcgctctctgtgtttatgagccagattttagcacagtagcatgcataactttatgtacttttgatgtgtcgttattgtcttcgtctattcttcaaataaagttctgtcgaaatgatatatgcaaccaa

SEQ ID NO: 4827 - DNA, 1765 bp, Hordeum vulgare
aaccaatcaaccataccatatttccatccagatctcaaatcaaagcctccaaccaaagcctcctcctccgccctctccaatcctaccactctcgtccccgacgccgacgccgacgccgacgccatgaagggcggcatcgccaatggcgtgacggcgccaagtggcccggggctccccgagaaggccgtcgcggcgccgctgcccgaggagctggcgccggaggtggtggagggggcgagggagatcgtgctggggaggaacatgcacgcctcctgcttcgcggtgaaggagcccgacgccgacgacgagttcaccggcgagcgcgaggccaccatggccggcgtcctcgcacgctaccgccgctccctcgtcgagcgcaccaaacaccacctcggctacccatacaatctggactttgagtacggtgctctttcccagctgcagcacttctctattaacaacctgggcgacccattcattgagagcaactatggcgtgcactcgaggcagtttgaagtgggtgtgttggattggtttgctcgcttgtgggacctggaaaaggatgaatattggggatacattacaaactgtggcaccgaaggaaacctgcatgggattcttgtcggaagagaagttttccctgatgggatcttgtatgcctctcgtgactcccactactcagtattcaaagcagcgagaatgtacaggatggattgtgtcaaagtggatactcttgtctctggagaaatggattgtgcggattttggaagaaagctacttgaaaacaaagataaacctgctattattaatgtcaacattgggacaactgtcaagggagcagttgatgatcttgacttggttatcgaaacacttgaaaaaagtgggttcaaggatcggttttatatacactgtgatggtgctctgtttggtctgatgatgccatttgttaagctggcacctagggtatcctttaagaagcccattgggagtgtgagcgtgtctggtcacaagtttgttggatgtcccatgccctgtggtgtccagataacaaggttgaatcacataaatgccctttctagtaatgtggagtatctagcttcacgtgatgctacaatcatgggaagcaggaatggtcatgctcccatcttcctatggtacaccctgaacaggaaaggctatagaggttttcagaaggaagttcagaaatgcttgagaaatgcacattaccttaaagatcggctcaaggatgctggaattagtgcgatgcttaacgagctcagcagtacagtagtttttgagaggccaaaggacgaggagtttgtgcgacggtggcagcttgcttgtgagggaagtatatcacatgttgtggtaatgcccagtgtcactgtcgataagctggatactttcttaaatgagttggtggagaagcgagtaacctggtaccaggaaggaaaatgccaatctccttgcattgcagctgatgttggccaggagaattgtctttgtactctgcacaagaaataagtttgtcaggggacactctgtgagttcaaatgttggatacttgagtatttacattggttggtgtcgtatttaccacctcccaatcgtgcatcctttattgttcattgttgtcatggactcatttaatgttagtcctcgctttatatctatacgagacagatcttagcacagtagcatgctgaactctatgtgttgtattcatcgtccgtcttccatctattcttcaataaagttctgtgca

SEQ ID NO: 4828 - DNA, 3630 bp, Triticum aestivum
acgcagcagccatggcggagatcctcgacccggccgccgcagccgccgcgggcgagccggcggaggagcaggaggaggcgcggccgctctccgccgcggcggcggccgcggccgcggacgacgacgaggacgaggaggaggagggggacgtgtgccggatctgccgcaaccgcggcgacgacgagcacccgctgcgctacccctgcgcctgcagcggcagcatcaagttcgtccaccaggattgcctcctccagtggctcgaccacagtaactcccgccagtgcgaggtctgtaaacacgcattctctttctcgcccgtctatgctcagaatgctccaacaagacttcctttccaagaacttgtgtttggcgttgggatgaaaacatgccatgtgtttcagtttgtcctccggcttgcctttgttctttcagtctggctcatgattatcccattcattacctactggatatggcggttaacatttgtgagaagtcttggtgaagctcaaaggctgttcttgagtcacatcagcgctcagttgattctcagtgattgcctacatggatttcttctctcagctatcattgtccttatatttcttggagctacctctttaagggactatataaggcacttgcgggaacttggaggacatgaagctgacagggacgatgcaggccgtgaaaggcatggtgcccgagctgtcagaaggctagctggtcctaataacagggttcccggtgcagacggaaatattgatgacttggctgaggcccaaggacttggtgctggggagcttctgaggagaaatgcagaaaatgttgctgctcgattggaaagactagaggcccaagttgagcagatgctagatggtctggatgatgcggatggtgcggaggatgttccttttgatgaacttgttggtatgcaaggcccagtatttcacttggttgagaatgcaattacggttttggccagcaatgctatattcctcattgttgtgatcttcgtaccattctcattgggaaggattgtcctgtattatctatcatggtttttctcttcagcctccagtcctatgctggctagggtgatgccatttacggaatctgctatttctttggctaatgaaacattgaatagtgcttttaatgccatgaagaatttctcttccgacagtcacaatgaaggtgttattgggcatgtgattgaggtggttactcagtccttgaagataaatgccactggtcttgctgtaatgcagggcactgggaagagcagtctggtgaaaggaacagttattggctcatcttatctttcagatctgacaactcttgctgttggatacatgtttatcttttgccttgtgtttttgtacattggatcactggctttacttcgatatgcccgtggagaacgttttactattggaagactctatggcatcgctgcaatactagaggccattccatctttatgcaggcagttcttttctggaatgaagcatctcatgaccatggtcaaagttgctttccttttggtgatagaactcggagtatttccccttatgtgtggttggtggcttgatgtctgcactcttaagatgttgggtaccacaattgctcaaagagttgaattctttacgatgtcacccttggcgagctcctcgatccattggcttgttgggattgtatatatgctccaaataagcatattcgtcagccttcttcgaggggtactgcggaatggagttctttacttcttaagggaccctgctgatccaaattacaatccttttagggacctgatcgatgatcctgtgcataaacatgctcgacgagtccttttatctgtcgctgtgtatggaagcttgattgtgatgctggtcttcttacctgtcaaactggccatgcgagtagctcctaaaacttttcctcttgacattaccatttttgacccttttaccgagattccagttgatgtgcttctgttccaaatatgcatcccatttgcgattgagcatttcaagccccgggcaactattaaagctctgttgcatcattggttcgctgtgattggctgggcactaggcttaacagatttcttactaccaaaacctgaagaaaatgctgctgggcaagagaactggaatggcagggcagaaagaagagatagagtacatggtgggatggaaatggtagccccacagcttgagcagcgtatgattcagcatgctgccatagataatgatggtaggggtaatgcaaatgaagccaatgacgttgctgaagaatctgatgtagatgatcaaggagattcagagtacagttttgcactccgtatcatactcttgcttatactggcatggatgacgctactcatattcaatgctggaatgattgttattcccatctcacttggccgtctagtttttgaggctgttccccgcctgccaatcacacatggcatcaagtgcaatgatctgttctcttttagcattggttgctatattatctggagtgcagcagctggaaccagatatgcagttgactacattagatcacgacgtcttggcttcctggtgcaacagatctgcaagtggtgctctattgtcctgaagagttccgctctcctgtcaatatggatcttcgttatccccgtgctgattggactcctttttgagctgctggtgattgtacccatgagggtgcctattgacgagagcccagtttttctgctgtatcaggattgggcacttggattaatattcttgaaaatttggactagactggtgatgctggatcaaatggcacctttggttgatgaaagctggaggatgaagtttgagagagtaagagaggatggcttctcccgtttgaaaggtctatgggtcctgcacgaaatcataacccccatcatcacgaagctccttactgctctctgtgtcccatacgtcctagcaaggggtgtgttcccggtgctgggctacccactgattgtgaactcggcagtctaccgttttgcctggctcgggtgcctgatattcagcacgctcttcttctgcggcaagagattccacgtttggttcaccaacctccacaactccatcagggatgaccgctatctcattggccggaggctgcacaactttggcgaggactcccgccggtcgaacgagcctgatgagactccaggttcattagaagacgaccttgcgctgatccctatagatcatcaggacaatgacgacgtcgggctgaggttcaggggcaacaaccgtcatgaagacgcgggggtggttgtcggttaagcaggagcgtgtgaccggcattgtagagtgaatgagttgccctgtagtagtgttagggtagtaggcaagcattgttgtacaacacacatagtagcgaggggaataagctagatagaaggatttgcgcgccgaaagctgatggtcaactgcctttttttggttcctgtggtagtcgttgctgaatgtatatattggtggaagacctaatcagacataatctgatgttgttctgatgtaatgtgtaaggataaatctgattcgacactggtgtaatggctgatgtttcacgttggacctactcgttctagttttcatctca

SEQ ID NO: 4829 - DNA, 1746 bp, Pennisetum glaucum
ctacccaccccacctctcccaccagagagtaccctgccggcctgcccgccgctgcacggcgagggagacgacacgagcggtcgccgcgcggcagcatccccgccccggtgacacctgacgcgccaccgcaccaccgctctggctgttgccatcccaccccgctgaccggcaccgcctcccgccttgcactcccgggggcggcgaccttcccacccgccccgcacgccgagcatctgtcttgttttttcttgacctcccacgcctttcgccccagattccttccccccgcgcagtcgccagtcgcccaccccgttccacacttccattcccaacccccaccaggcctccgcccctcctgggagccgccgctccctcccacccaaggacgtgcgcggcggagccggccgaaactacccagcttcatatctagtggtgttgctcccaccaaggtgctgaaatgtcctttctattcaaatccagcaacagtggtacaactgagaaaggtttatccctagaagaacagcaagacaaaataaatgaactacgcaaggagctgggtgaatactcatcagcagccattcatgatttcctttcagatgcctcgttatcacgatttcttcgagcaaggaactggaatgtgcagaaagctagtaagatgatgaaagcagctgtgaagtggcggcttgcattcaagccggaaaacattttttgggatgatattgcacaagaagcggagactggaaagatatatagagcagactacaaggacaagcatgggagaactgttcttgtattgaggcctggcttagagaacactacctcagcaacagggcagatcaaatatctagtttactctctggaaaaagcgattatgaacctgacagaagaccaagagaagatggtgtggttgacagatttccagtgctggacattgggaagcacaccactgaaggtgacccgcgagactgtcaatgtcttgcaagactgttatcctgagaggttgggactagcaatcctttacaatcctcctaggatatttgaatcattctggaagatagtgaagccgttcctggaccatgagacccggaagaaggtgaagtttgtgtactccgacgacaaggagagccagaagataatggcagaggtctttgacattgaggagctcgactcggcattcgggggaaagaaccctgctacatttgagtacaacagttatgcagagcgaatgcaggaggatgacaagaaaatgggatctttgcacagctcaaccgatagcttgcttgaatcagcagggaaggataccaatggtgcggactcggatgcctcgagtgaggcctccttctacagtggaactgactctccgaagcatgaagtcggtgaacatggcgccccaaagaatggttgagctgaactgctttggctgctggagctgagagatggattataggtcgacaactcggcatacaattatctaactggagagattgtcatgatcgatagctgcgccagtttacaagctggttagatcacgctgtcgggtctaggaggaatgtatatttgctgcccataatattagagaattcggaaagggagtctagaccatcaatggcaatgcactacatacatgaatatccccaataagatggacttgtttgagcatatggttactcgtggcaggagccacatatgtgttgcactaaccgttccctagtttttctgaacagacccttagtagtaataacaatt

SEQ ID NO: 4830 - DNA, 1762 bp, Setaria italica
ggccatcataccatacccaccagtctcagacaccctgccccgccggtgcacggccagggaggtcgccgcgcggcagcatccccggtgacacctgacgcgccaccgcaccaccgctctggctgttggcatcccaccccgctgacccgcaccgcctccaccttccacgcccgggggcggcggacctcccacccgccccgaacgccgagcacctgtccgtttttcttttatctcccacgcctttcccctcgattcctttccccaccgccccgcgcagtcgccagtcgcccaccccgttccacacttccattcccaaccccactaggccgccgctccctcccaaggacgtgcgcggcggagccgaaacgacccagctacgtatctagtggtgttgcttccaccaaggtgctgaaatgtcctttctattcaaatccagcaatggtggtacaactgagaaaggcttatccctagaagaacagcaagaaaaagtaaatgaactacgcaaggagcttggtgaatcctcgtcagcagccattcaagatttcctttcggatgcctcgttatcaagatttcttcgagcaaggaactggaatgtgcagaaagctagtaagatgatgaaagcagctgtgaagtggcggcttgcgttcaagccggaaaacattttctgggaagatattgcacaggaagcagagactggaaagatatatagagcagactacaaggacaagcatgggagaactgttcttgtattgaggcctggcttagagaacactacctcagcaacagggcagatcaaatatctagtttactctctggagaaagctattatgaacctgacagaagatcaagagaagatggtgtggttgacagatttccagtgctggacattgggaagcacaccactgaaggtgacccgtgagactgtcaatgtcttgcaagaatgttatcctgagaggttgggactagcaatcctttacaatcctcctaggatatttgaatcattctggaagatagtgaagccattcctggaccacgagacccggaagaaggtgaagtttgtgtactccaacgacacggagagccagaagataatggcagaggtctttgacattgaggagctcgactcagcattcgggggaaagaacccagctacatttgagtacaacagctatgcagagcgaatgcaggaggacgacaagaagatgggatctttgcacagctcaaccgatagcttgcttgaatcagcagggaaggatactcatggcgcggcctcggacgcctcgagtgaggcctccttctacagtggaaccgactctccgaaacatgaagatggtgaacacggcgccccaactcgacatacaattatctaactggagcgattgtcaggaccgatggctgcgccagtttacaagctggttagatcacgctgtcgggtctaggaggaatgtatatttgctgcccatgatattatagagaatatggaaagagagtctggaccatcaatggcgatgcactgcatgaatatcccaataagatggactcctttgaaccatgtgctcggttactcgtggcaggagccacatatgtgttgcactagccgttcctcgatttttctgaatgttgccaaagaacgtgtcgtgtatcgacttaataacaattataaaaggtctagcagctagccaaccaccgcaatttgtctcgaatacgagacaggtgatgaccttttaggatcttgtttctggcttacaaaacatttttcttaccc

SEQ ID NO: 4831 - DNA, 1528 bp, Setaria italica
gtcgcccaccccgttccacacttccattcccaaccccactaggccgccgctccctcccaaggacgtgcgcggcggagccgaaacgacccagctacgtatctagtggtgttgcttccaccaaggtgctgaaatgtcctttctattcaaatccagcaatggtggtacaactgagaaaggcttatccctagaagaacagcaagaaaaagtaaatgaactacgcaaggagcttggtgaatcctcgtcagcagccattcaagatttcctttcggatgcctcgttatcaagatttcttcgagcaaggaactggaatgtgcagaaagctagtaagatgatgaaagcagctgtgaagtggcggcttgcgttcaagccggaaaacattttctgggaagatattgcacaggaagcagagactggaaagatatatagagcagactacaaggacaagcatgggagaactgttcttgtattgaggcctggcttagagaacactacctcagcaacagggcagatcaaatatctagtttactctctggagaaagctattatgaacctgacagaagatcaagagaagatggtgtggttgacagatttccagtgctggacattgggaagcacaccactgaaggtgacccgtgagactgtcaatgtcttgcaagaatgttatcctgagaggttgggactagcaatcctttacaatcctcctaggatatttgaatcattctggaagatagtgaagccattcctggaccacgagacccggaagaaggtgaagtttgtgtactccaacgacacggagagccagaagataatggcagaggtctttgacattgaggagctcgactcagcattcgggggaaagaacccagctacatttgagtacaacagctatgcagagcgaatgcaggaggacgacaagaagatgggatctttgcacagctcaaccgatagcttgcttgaatcagcagggaaggatactcatggcgcggactcggacgcctcgagtgaggcctccttctacagtggaaccgactctccgaaacatgaagatggtgaactcggcgccccaactcgacatacaattatctaactggagcgattgtcaggaccgatggctgcgccagtttacaagctggttagatcacgctgtcgggtctaggaggaatgtatatttgctgcccatgatattatagagaatatggaaagagagtctggaccatcaatggcgatgcactgcatgaatatcccaataagatggactcctttgaaccatgtgctcggttactcgtggcaggagccacatatgtgttgcactagccgttccccgatttttctgaatgttgccaaagaacgtgtcgtgtatcgacttaataacaattataaaaggtctagcagctagccaaccaccgcaatttgtctcgaatacgagacaggtgatgaccttttaggatcttgtttctggcttacaaaacatttttcttacccaaccttggaatactccgtaaatgaactattataacgtattctaaac

SEQ ID NO: 4832 - DNA, 2123 bp, Oryza sativa
ccgtgatcgcgcatcatacttaaccacccccaccccgaccccgcgcttgacccggcatctttggccggtcatacacgcggggggcctttgcctttggcacccggcgcgcgtcccgtctcccacgcccgcacccgcaccaccgcccaccaccaccacgccacggcagccgcaccgcaccgcaccgcaccaccatccttcctaggaaaaccccacccaccctcaccctccagttccaccgtcgtctccactctcgccctcctcacgtcacccccacccccaccaccaccactctcccacctcggccggcgccacctccccaccccagccctcgccgtcgtgcccaggcggcgggccctgatccgcgagcctccccggttgttgggggctgggggtgcatcgatccagttccgtatctagtggacccttctctgtcgaggtactaaaatgtcctttctattcaagtcaagcaatggtgctacaacagagaaaaacttgaccctagaagagcagcaggagaagataaatgacttgcgtaaggagcttggtgaacactcatcagaagaaatacaagatttcctttcagatgcctcgtgcctgagatttcttcgagcaagaaactggaacgtgcagaaagcaagtaaaatgatgaagtcagctgtaaagtggcgggtgtcatatatgccacaaaagattaactgggatgatgttgcacatgaagcagagacaggaaagatatatagggctgactacaaggacaaacatggaagaactgttcttgtcctgaggccaggcttagagaacactacttcaggaaagggacagatcaaatatcttgtttactgtctggagaaagcaattatgagcctgacggaagatcaagagaagatggtctggctgacagacttccagagttggacattggggagcacaccgctgaaagtgacccgagagactgtgaacgtcttgcaagactgttaccctgagaggcttgggttagcaatcctttacaatcctcctaggatatttgagtccttctggaagatagtgaagccatttttggaccatgagacctacaagaaggtgaaatttgtgtactccagcgataaagagagccagaagataatggctgacgtctttgacttggacaagctcgactcagcattcggaggaaggaatccagctaccttcgaatacaatagctatgctgagcgtatgagagccgatgacattaagatgggttcttcattcaaatcaaacggcatcaccctgcctcaggaccattcacatgtatccgctgacaaggaggctaatggtggcggttcggacgcctcaagtgaggcctccttctatagtggaactgattccccgaatcacgaagagggaggtagcatactggcttgagagctcctccctcttcgtgcttagctgagttgaactgcttgcttgctccagtcatgggttgggaatatcggataggtcaatatatacagttagctaactaggatggaacgtttggaccatcggctgtgatgcattgacatcttcctgaaatataaatgagaaaattctgatggataaattcggtcggggcatttctttgctgctggcccggcggaaaaaaaattctgatggataccctgtggcattcctccataataaataatttgatgtgccgtgtacttgtatgcgttcaattcctgtgcatctgaatatttgctagctttggacatttgtgttgtttcgtgctgtgctagaaaggaaatggctggtcagtgatgtacatcttcaggcctcctttgaagatatgggatttggaaacaaattttatgggaattgggctaattcctataaaattgttgcattttaaaggagcccttaaaatggtcaagctcagttgtgtttcattcctacaacagaacactacttcagcattagctcggttgagacttgagagatgggacaaatcaaatttgtcaatgacagtcagctaggagtaggtgtagagacctgaatgaatgtttggacccatttcgccagtttacgagctggaggataataattaattatgtatatcttctgttcatgatatcattgaaaatccgtgagaaaagtttgggcaatca

SEQ ID NO: 4833 - DNA, 1827 bp, Sorghum bicolor
cgcgaccacctcacttcccccacctacgacgcaacttcccacgccccatcacacccgccaccgctttaaaacctcctcctcacaccctcactccccacactcacacaccacaccacaccacaccacagcgagagcaaggctccccaagcaaccaccactccacagccaaccgcgagaacaagtcgcagccgagaactcgtctccacgtctcccagcgaagccaagcttgccgtgccatgtcttccatggagctgctccacgccgtcatcccggagaagcagagcgaggagctgatggcgcccgcggcggcgacgacgaccacgaccacgagcagcagcgccaccgccatgagcggcgacgaggttgcccacgtgccccaggggtgggccaagaagaagcgctcgcgccgccagcgatcggaggaggagaacctcgcgctctgcctcctcatgctctcccgcggcggcaaccaccgcgtccaggcggcgccgccgctggtcccgtccgcggcgccggtcgccgcggagttcaggtgctccgtctgcggcaagtccttcagctcctaccaggcgctggggggccacaagaccagccaccgtgtcaagctgccgacccctcctgctcctcctgctgctgctgtcccggcagcagtgcccctcgtggaggtggaggcccccgcaccgctcaccgtcatcccgccgcctccagtcgaggtcgtcgtccgtgagccggccacgtcatccaccgccgcgtcctccgacggtgcggcggcgtcgagcagagtccacaggtgctccatctgccacaaggagttcccaaccggccaggcgctcggcgggcacaagaggaagcactacgacggtggcgtcggcggcagcagcgccgcgtccaccgacgtcctggcggccactgccccggcggcaactgctgagacgtccgaggtggggagctccggaaacgggagctccgccgcccgcgcgttcgacctcaacctcccggccgtcccagagttcgtgttccggtgcggcaaggctggcaagatgtgggaggaggacgaggaggtgcagagccctctcgccttcaagaagccccgcctccttatgaccgcgtgagccgctgcgcggatctctcaaccgtccaagattttggtctagatcagctgctgccaagttcggtggtggaacacactattcgttcattcattcgtatggtgtcagtattattgtttgatttgttgctgctcttcttgtacagtacagagagagctagttgtgagagatgcatagtcatcatacacataggtcgatcttcctattcatggaagcgtatacttgtatccttaactgtcagtatactgtagttcatacacacatacttcattctcattaagagatgattgatgaattagtgctttgtaacatacagtaagcttattataaatggattggggattaatatggaatcagataccttctcgcatcactttgtgttcatgccttgccggtagtaccatggccgatcgatgcgctttcgcttgccagctcaaaccaccctctttgcttgctttcatgggaagaaacggagcagtctgcttcggctctcagaagcaacgtccgctacctttttctcgcaagagttttcggtcgctagcttggccactcatcgtcctcgcgtactcagtgacgtccatcccggctgggctggcgataacttaatccggttccgtccacgagcttccaccacttgctctgctggttccggagcagcgacgccctgtgcagtgcggccgccgcaagtgggaacaacaaacctggggccgttgcggct

SEQ ID NO: 4834 - DNA, 1364 bp, Sorghum bicolor
acactcacacaccacaccacaccacaccacagcgagagcaaggctccccaagcaaccaccactccacagccaaccgcgagaacaagtcgcagccgagaactcgtctccacgtctcccagcgaagccaagcttgccgtgccatgtcttccatggagctgctccacgccgtcatcccggagaagcagagcgaggagctgatggcgcccgcggcggcgacgacgaccacgaccacgagcagcagcgccaccgccatgagcggcgacgaggttgcccacgtgccccaggggtgggccaagaagaagcgctcgcgccgccagcgatcggaggaggagaacctcgcgctctgcctcctcatgctctcccgcggcggcaaccaccgcgtccaggcggcgccgccgctggtcccgtccgcggcgccggtcgccgcggagttcaggtgctccgtctgcggcaagtccttcagctcctaccaggcgctggggggccacaagaccagccaccgtgtcaagctgccgacccctcctgctcctcctgctgctgctgtcccggcagcagtgcccctcgtggaggtggaggcccccgcaccgctcaccgtcatcccgccgcctccagtcgaggtcgtcgtccgtgagccggccacgtcatccaccgccgcgtcctccgacggtgcggcggcgtcgagcagagtccacaggtgctccatctgccacaaggagttcccaaccggccaggcgctcggcgggcacaagaggaagcactacgacggtggcgtcggcggcagcagcgccgcgtccaccgacgtcctggcggccactgccccggcggcaactgctgagacgtccgaggtggggagctccggaaacgggagctccgccgcccgcgcgttcgacctcaacctcccggccgtcccagagttcgtgttccggtgcggcaaggctggcaagatgtgggaggaggacgaggaggtgcagagccctctcgccttcaagaagccccgcctccttatgaccgcgtgagccgctgcgcggatctctcaaccgtccaagattttggtctagatcagctgctgccaagttcggtggtggaacacactattcgttcattcattcgtatggtgtcagtattattgtttgatttgttgctgctcttcttgtacagtacagagagagctagttgtgagagatgcatagtcatcatacacataggtcgatcttcctattcatggaagcgtatacttgtatccttaactgtcagtatactgtagttcatacacacatacttcattctcattaagagatgattgatgaattagtgctttgtaacatacagtaagcttattataaatggattggggattaatatgg

SEQ ID NO: 4835 - DNA, 2188 bp, Zea mays
actttcccactagcagctagggtttctcccctcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaagttgctatctatagagaggagccctcccattgaagaagttatcaaatcaggtgtagttccaagatttgtgcagttgctcacaagagaggatttgccccagctgcagttcgaagcagcatgggctctcacaaatattgcttctggcacttcagaaaatacaaaggttgttattgatcatggggctgttcctatatttgtgaagcttcttgggtctggtagtgatgatgttcgtgagcaggctgtgtgggctttgggcaatgttgctggcgattctccgaagtgtcgtgaccttgttctcgccaatggtgcattgatgcctctgctagcccagttgaatgagcatgcgaagctctccatgttgaggaatgccacctggactctgtccaacttttgcaggggaaagccacagccatcatttgatcagactaagcctgctctgccagcacttgcacgacttatccattccaacgatgaggaagttctcactgatgcttgctgggctttgtcatacttatctgacggcactaatgataagatccaagctgtaattgaagctggtgtttgcccccggcttgtggagctccttctccatccatcaccgtcggtgcttatacctgctctacgaactgttgggaacattgtaactggagatgatcagcaaactcagtgtatcattgatcatcaagctcttccccgcctcctgaatttattgacacagaaccacaagaaaagcattaagaaagaggcatgctggacgatttcaaatattactgctggaaacaaagatcagatacaggctgtcataagtgctggtattatcgctcctttgttgcaactgcttcaaggagcagagtttgatatcaagaaggaggctgcttgggccatctcaaacgctacctctggtggttcccatgagcaaatcaagtacttggtgtctgagggctgcatcgtgccgctgtgcgaccttcttgtttgccctgatccgagaattgtaacagtttgtctggagggtcttgagaatattcttaaagtaggggagcacgacaagaccatgggcgcaacaggtgacattaatgttttcgctcagatgattgacgacgcggaaggcctggaaaagatcgagaacctacagagccatgataataatgaaatctatgaaaaggctgtgaagcttcttgagacttactggatggaggaggaagatgatgcaatggctactgctggggaagctgctcctgctgtttttgactttagccaaggtggcaaccctcctggtggtggtttgaacctcaactgaatacagtatttgaccaaaagggtgttaattccctcatgacaacctagtctggtcgattccatgtgggataatggtttgtggttggtccagtaaattcgagatttcaagggagatgggttagcattattcccaagctgtcatggatatcagtatcgcagggtctgtaacaggaccataatcgtcgaacatgagtctgggtttttgagcaggctactctctagggtttgcgtcatttatgttttatatctggctactgtatagcctgagtctaattatctgcaatgccgtaggacattcctgagtggtttggttttgaggttcctcaggaatggtctgcgttgcaggttgtccagagttgtaaaccttcaagtggtttgagtatattgctcggcctcgctttactacggtcgatccaacctgttggaggccaaatgacttataaaaagctgttggcagctgca

SEQ ID NO: 4836 - DNA, 2184 bp, Panicum virgatum
ccccctcctccccgctcccccttcaatcccccgacgccggctagggttttgcctcctcccctccgccgccaccgccggcgctggagcgagcgagaccgagggggtagggagcgagcggagcgtaggcagccatgtcgctgcgcccgagcgagcgggtcgaggtgcggcggaaccgctacaaggtggcggtggacgcggaggaggggcggcggcggcgcgaggacaacatggtggagctccgcaagaaccgccgcgaggagagcctcctcaagaagcgccgcgaggggctccaggcccaggtccccgtccccgcctccggggtcgagaagaagcttgaaagcctcccagctatggttagtggggtttattcggacgacaacaaccttcagcttgaggccacaacacaattccgcaagttgctctccatagagaggagccccccgattgaggaagttattcagtcaggtgttgttcctagatttgtgcagttcctcaccagagaggatttccctcaactgcagtttgaagcagcatgggcacttacaaatattgcttctggcacttcggaaaatacgaaggttgtcattgatcatggggctgttccgatatttgtgaaacttcttcagtctgctagtgatgatgttcgtgagcaggctgtatgggctttgggcaatgttgctggtgattctccaaagtgccgcgaccttgttctcgccaatggtgccttgatgcctctgctagcccagttaaatgagcatgctaagctctccatgttgaggaatgctacatggactctgtcaaacttctgcaggggaaagccgcagccatcatttgatcagactaagcctgctcttccagcacttgcacgacttatccactccaatgatgaggaagttctcactgatgcatgctgggctctttcatacttatctgatggcactaatgacaaaatccaagctgtgattgaagctggtgtgtgtccccgccttgtggagctcctcctccatccatcaccttcggtgcttatacctgctctacgaactgttggaaacattgtcactggagatgatttgcaaactcagtgcatcattgatcatcaagctcttccctgccttctgaatctattgacacagaaccataagaaaagtattaagaaagaggcttgctggacaatttcaaatattactgctggaaacaaagatcagatacaggctgtgattagtggtggaattatcgctcctttattgcatctactccaaacagcagagtttgatattaagaaagaggctgcttgggctatctcaaatgctacctcaggtggttcccacgagcaaatcaagtatttggtgtctgagggctgcatcaagccattgtgcgaccttcttgtttgccctgatccaagaattgtaacagtgtgtttggagggtcttgagaatattctcaaagtgggtgagcatgacaaggctgcaggtgcaacaggtgacatcaatgtctttgctcagatgattgatgaagctgaaggcctggagaagattgagaacctacagagccatgataacaatgaaatctatgaaaaggctgtgaagcttcttgaggcatactggatggaggaggaagatgaggcaatggctactgctggggaagctgctcctgctgtttttgactttggccaaggtggcaaccctccagctgctggtggtttgaacttcaattaagtacagtcttttaaccaaagggtggtaataccctcagtgatggcttgtcatgattagtcaatgtagtcagtttggttccatgtgcgggatgatggctgtggtgggtccaataagcttgagatttcgagggagctgggttaccattattcccaagagggagtcatggatatcaatatcgcatggtctgtaacaggattataattgtcaacccgagtctggatttttgagaaggctactctagagtttgcgtagtttggtgtgttatatctggctactgtatagcccgtcgtctgcaaggccgttaagacattcctgaatagtttggttgaggtttttcaggaattggctgcgttgcagtttgtctggagttgtaaacctttaatggtttctgagtatattgctaggccttgagttactacggtccatccaacctgttggagcttaaaataacttgcatattctctagatt

SEQ ID NO: 4837 - DNA, 2351 bp, Sorghum bicolor
aagaaaaagaaaagaagaatatttcgatcgtggtgtgagctttaactccgctttcccactcgccgctagggtttctcccctctccttttccccccctcctcccgctcccctcggctcccccgacgcccggctagggttttgcctccttcccgccgcctccgtccagcgagcgagaccgagggctagaggacgagcggtgcttcgccagccatgtcgctgcgcccgagcgagcgggtcgaggtgcggcggaaccgctacaaggtggcggttgacgcggaggaggggcgccggcggcgcgaggacaatatggtggagatccgcaagaaccgccgcgaggagagcctgctcaagaggcgccgcgaggggctccaggcccagttccctgcccctccctccggggtcgagaagaagcttgaaagcctcccagctatggttagtggggtttactcggatgacaataaccttcagcttgatgccaccacacagttccgcaagttgctctctatagagaggagcccccccattgaagaagttataaaatctggtgtagttccaagatttgtgcagttcctcaccagagaggatttcccccagctgcagttcgaagcagcatgggctctcacaaatattgcttctggcacttcagaaaatacaaaggttgttattgatcatggggctgttcctatatttgtgaagcttcttgggtctgctagtgatgatgttcgtgagcaggctgtgtgggctctggggaatgttgctggtgactctccgaagtgccgcgaccttgttcttgccaatggtgcgttgatgcctctgctagcccagttgaacgagcatgctaagctctccatgttgaggaatgccacttggactttatctaacttctgcaggggaaagccacagccatcatttgatcagactaagcctgctctgccagcacttgcacgacttatccattccaacgatgaggaagttctcactgatgcatgctgggctctgtcatacttatctgatggcactaatgataagatccaagctgtgattgaagctggtgtttgcccccggcttgtggagctcctcctccatccatcaccatcagtgcttatacctgctctacgaactgttgggaacattgtcactggagatgatatgcaaactcagtgtatcattgatcatcaagctcttcctcgcctcctgaatctattgacacagaaccacaagaaaagcattaagaaagaggcatgctggacgatttcaaatattactgctggaaacaaagatcagatacaggctgtcataagtgctggcattatcgctcctttgttgcaactgctccaaacagcagagtttgatatcaagaaggaggctgcttgggccatctcaaatgctacctctggtggttcccatgagcaaatcaagtacttggtggcagagggctgcatcaagccattgtgcgaccttcttgtttgccctgatccaagaattgtaacagtttgtctggagggtcttgagaatattcttaaagtgggggagtatgacaagaacatgggtggtgcaacagctgatggcaatctctttgctcagatgattgatgaagcggaaggcctggaaaagattgagaacctacagagccacgatattaatgaaatctatgaaaaggctgtgaagcttcttgaggcatactggatggaggaggaagatgacacaatggctactgctgcggaagctggtcccactgtttttgacttcagccaaggtggcaaccctcctgctggtggtggtttgaacttcaactgaatacagtctttaaccaaagggcgttaattccctcggcgatgggcttggcattggcttgtcatgacaatgtaatgtggtcgattacatgtgggataatggtttgtggtgggtccaataagctcaagatttcgggagatgggctagcattattcccaagctgagtcatggatatcaatgtcgcaggttctgtaacaggattataatcgtcgaacatcagagtctttagttttttttaaggctactttctagggtttgcgtcgtttagctatgttatatctggcatagtgtagcctgagtgcaatcatctgcaaggccgaaagacattcctgagtggtttggttttgaggttccttaggaatggtctgcgttacagtttgtccggagctgtaaacctttaacggtttgagtatattgctcggccttgctttactacggttgatccaaccagttgaggctatataaatggcctctaaaaatgctgtttgcatctgcattgttggtggttggtgcttaagtttgtgtgggtgaaataagagcattcttcaatagtttgc

SEQ ID NO: 4838 - DNA, 2398 bp, Sorghum bicolor
aaatctcgaaatgcaatttagcggcctaaacaaaggaaaaagaaaaagaaaaagaaaagaagaatatttcgatcgtggtgtgagctttaactccgctttcccactcgccgctagggtttctcccctctccttttccccccctcctcccgctcccctcggctcccccgacgcccggctagggttttgcctccttcccgccgcctccgtccagcgagcgagaccgagggctagaggacgagcggtgcttcgccagccatgtcgctgcgcccgagcgagcgggtcgaggtgcggcggaaccgctacaaggtggcggttgacgcggaggaggggcgccggcggcgcgaggacaatatggtggagatccgcaagaaccgccgcgaggagagcctgctcaagaggcgccgcgaggggctccaggcccagttccctgcccctccctccggggtcgagaagaagcttgaaagcctcccagctatggttagtggggtttactcggatgacaataaccttcagcttgatgccaccacacagttccgcaagttgctctctatagagaggagcccccccattgaagaagttataaaatctggtgtagttccaagatttgtgcagttcctcaccagagaggatttcccccagctgcagttcgaagcagcatgggctctcacaaatattgcttctggcacttcagaaaatacaaaggttgttattgatcatggggctgttcctatatttgtgaagcttcttgggtctgctagtgatgatgttcgtgagcaggctgtgtgggctctggggaatgttgctggtgactctccgaagtgccgcgaccttgttcttgccaatggtgcgttgatgcctctgctagcccagttgaacgagcatgctaagctctccatgttgaggaatgccacttggactttatctaacttctgcaggggaaagccacagccatcatttgatcagactaagcctgctctgccagcacttgcacgacttatccattccaacgatgaggaagttctcactgatgcatgctgggctctgtcatacttatctgatggcactaatgataagatccaagctgtgattgaagctggtgtttgcccccggcttgtggagctcctcctccatccatcaccatcagtgcttatacctgctctacgaactgttgggaacattgtcactggagatgatatgcaaactcagtgtatcattgatcatcaagctcttcctcgcctcctgaatctattgacacagaaccacaagaaaagcattaagaaagaggcatgctggacgatttcaaatattactgctggaaacaaagatcagatacaggctgtcataagtgctggcattatcgctcctttgttgcaactgctccaaacagcagagtttgatatcaagaaggaggctgcttgggccatctcaaatgctacctctggtggttcccatgagcaaatcaagtacttggtggcagagggctgcatcaagccattgtgcgaccttcttgtttgccctgatccaagaattgtaacagtttgtctggagggtcttgagaatattcttaaagtgggggagtatgacaagaacatgggtggtgcaacagctgatggcaatctctttgctcagatgattgatgaagcggaaggcctggaaaagattgagaacctacagagccacgatattaatgaaatctatgaaaaggctgtgaagcttcttgaggcatactggatggaggaggaagatgacacaatggctactgctgcggaagctggtcccactgtttttgacttcagccaaggtggcaaccctcctgctggtggtggtttgaacttcaactgaatacagtctttaaccaaagggcgttaattccctcggcgatgggcttggcattggcttgtcatgacaatgtaatgtggtcgattacatgtgggataatggtttgtggtgggtccaataagctcaagatttcgggagatgggctagcattattcccaagctgagtcatggatatcaatgtcgcaggttctgtaacaggattataatcgtcgaacatcagagtctttagttttttttaaggctactttctagggtttgcgtcgtttagctatgttatatctggcatagtgtagcctgagtgcaatcatctgcaaggccgaaagacattcctgagtggtttggttttgaggttccttaggaatggtctgcgttacagtttgtccggagctgtaaacctttaacggtttgagtatattgctcggccttgctttactacggttgatccaaccagttgaggctatataaatggcctctaaaaatgctgtttgcatctgcattgttggtggttggtgcttaagtttgtgtgggtgaaataagagcattcttcaatagtttgcca

SEQ ID NO: 4839 - DNA, 3397 bp, Setaria italica
agaaaaagaaacgaaataaaggggaatatttcgatcgtggtgtgagctttaactcccctttcccacccgccgctagggtttctcctctctatttttcccctccttgtgctccccctccacttccccgacgccccgctagggttttgcctcctccccgccgccgccgccgccggcgctgcagcgagcgagacccaggggttgagagcgagcggagcttcagccatgtcgctgcgcccgagcgagcgggtcgaggtgcggcggaaccgctacaaggtggcggtggacgcggaggaggggcggcggcggcgcgaggacaacatggtggagatccgcaagaaccgccgcgaggagagcctcctcaagaagcgccgagaggggctccaggcccaggtccccgtccccgcctccggtgtcgagaagaagcttgaaagcctcccagctatggttagtggagtttattcggatgacaacaacattcagcttgaggccacaacacagttccgcaagttgctctctatagagaggagccccccgattgaagaagttatccaatcgggtgttgttcctagatttgtgcagtccctcaccagagaggacttccctcaactgcagtttgaagcagcatgggcacttacaaatattgcttctggaacttcggaaaatacgaaggttgtaattgatcatggggctgttccaatatttgtgcagcttcttcagtctgctagtgatgacgttcgtgaacaggctgtgtgggctttgggcaatgttgctggtgattctccaaagtgccgtgaccttgttctcgccaatggtgcgctgatgcctctgctagcccagctgaatgagcatgctaagctctccatgttgaggaatgctacctggacactgtcaaacttctgcaggggaaagccgcagccatcatttgatcagactaagcctgctctgccagcacttgctcgacttatccattccaatgatgaggaagttctcaccgatgcttgctgggctctttcgtacttatctgatggcactaatgacaagatccaagctgtgattgaagctggtgtttgtccccgccttgtagagctcctcctccatccatcaccgtcagtgcttatacctgctctacgcactgttggaaacattgtcactggagatgatttgcaaacacagtgcataattgatcatcaagctcttccctgcctcctgaacctattgacgcagaaccacaagaaaagcattaagaaagaggcttgctggacaatttcaaatattactgctggaaacaaagaccagatacaggctgttataaatgctggaattatcgcccctttgttgcaactgctccaaacagcagagtttgatattaagaaagaggctgcttgggccatctcaaatgctacctcaggtggttcccatgagcaaatcaagtatttggtgtctgagggctgcatcaagccattgtgtgaccttcttgtttgccctgatccaagaattgtaacagtgtgtttggagggtcttgagaacatcctcaaagttggtgagcatgacaagaccgcgggcgcaacaggtgacatcaatgtctttgctcagatgattgatgaacacgaaggcttggaaaagatcgagaacctacagagccacgataacaacgaaatctatgaaaaggctgtgaagcttcttgaggcatactggatggaggaggaagatgatgcaatggcaactgttggggaagctgctcccgctgtttttgactttggccaaggtggcaaccctccagctggcttcaattaaatacagtcttttaaccaaagggtggcaatttcctggcgatggcttcggagttggcttgtcatgagtagtcaatgtagtacgtttgattccatgtttgggataatggctgtggtgggtacaataagcttgagttttcgagggagctgggttaacattattcccatgtgagtcatggtatcagtatcgcagggtctgtaacaggattatacttgtcaacctgagtctggatttttgagaaggctactctctagggtttgttcgtttagtttggtgtgttatatctggctactgtatagcccgagccgaagcgtctgcaagacattcctgaatggtttggttttgagtttcttcaggaatgggctgcgttgcccaaagtatcttacatattctataaactgccactttgctactttcacatttgcgttattcaagtttagctggtgcttaaatgtgtaacaaaaacaatgcggtagctgatgctattggagtactgtaatctcacgattattcttggaaaggttgatgcaaagccttttacaactcaatgcgaatctattcccaacttgaaaatgatttttttacatttacaaagaaataatattagtgcgtaacaaacttcataaggcggcaaagaatgtagcattagctgtgctactgctctgcttgacgtttgatctcgcaagcgtttcacacttcggcgacctccttggtgatgagggacgcacggctgggctccacctgacacggcgccgccgttatctccggcgcgcctggcgcggtcggcgccggatgagggtggggatgggggtgcggcatcggcgggcggaggtgctggtgctggacgcccgggtagggagcgccgtggccgacgaagtggccgccgccgtagtgctgctgcccgcgcaggcgctgcgcctgcacggccgtgacgtagaccacgaagccgacgacgacggtgatgagccccaggatccccgcggccgcgaacatccccggccgcacccggtggcacactggccgcggcttccgccagtcgctgatgtggccggactcgatgccgatcccgatcatgagcagcacctcggcgagcccgaagcagatcctgcgggggaagaagaggcagcaggtctgccaggtgagcgtggcggcggacgacgcgacgcgcgggtggtcctgcgcgacggcgaggccggcggaggcggagtccggcactgcgacggcgacgagcatgtaggcgtgctcggcgaacatggcgacggcgagcaggatgaaggcgccgacggcgtaggcgagcgcggtgcggccgctgctgttgtagaagcacacgtccagctggtcctggctgccgcccacgctcatcaggtagtacgacacctgcagcacgcgagccctcggcggcgaggcagaggatgaaggcgacgaggccgcagatgacggagagcgcgacgagggcgacggcgacctggccgctggaccgcgcggcacggcgctcctgcgccttgcggagggacaggtcgtcgtgggtcaccgccgccggcatcgccaccgccgccgtcgtcggcgccgcgtgcatggatgaagcgaggcggagctgacgaaccta

SEQ ID NO: 4840 - DNA, 2227 bp, Setaria italica
cgacgctagggtttctcctctctatttttcccctccttgtgctccccctccacttccccgacgccccgctagggttttgcctcctccccgccgccgccgccgcggcgctgcagcgagcgagacccaggggttgagagcgagcggagcttcagccatgtcgctgcgcccgagcgagcgggtcgaggtgcggcggaaccgctacaaggtggcggtggacgcggaggaggggcggcggcggcgcgaggacaacatggtggagatccgcaagaaccgccgcgaggagagcctcctcaagaagcgccgagaggggctccaggcccaggtccccgtccccgcctccggtgtcgagaagaagcttgaaagcctcccagctatggttagtggagtttattcggatgacaacaacattcagcttgaggccacaacacagttccgcaagttgctctctatagagaggagccccccgattgaagaagttatccaatcgggtgttgttcctagatttgtgcagtccctcaccagagaggacttccctcaactgcagtttgaagcagcatgggcacttacaaatattgcttctggaacttcggaaaatacgaaggttgtaattgatcatggggctgttccaatatttgtgcagcttcttcagtctgctagtgatgacgttcgtgaacaggctgtgtgggctttgggcaatgttgctggtgattctccaaagtgccgtgaccttgttctcgccaatggtgcgctgatgcctctgctagcccagctgaatgagcatgctaagctctccatgttgaggaatgctacctggacactgtcaaacttctgcaggggaaagccgcagccatcatttgatcagactaagcctgctctgccagcacttgctcgacttatccattccaatgatgaggaagttctcaccgatgcttgctgggctctttcgtacttatctgatggcactaatgacaagatccaagctgtgattgaagctggtgtttgtccccgccttgtagagctcctcctccatccatcaccgtcagtgcttatacctgctctacgcactgttggaaacattgtcactggagatgatttgcaaacacagtgcataattgatcatcaagctcttccctgcctcctgaacctattgacgcagaaccacaagaaaagcattaagaaagaggcttgctggacaatttcaaatattactgctggaaacaaagaccagatacaggctgttataaatgctggaattatcgcccctttgttgcaactgctccaaacagcagagtttgatattaagaaagaggctgcttgggccatctcaaatgctacctcaggtggttcccatgagcaaatcaagtatttggtgtctgagggctgcatcaagccattgtgtgaccttcttgtttgccctgatccaagaattgtaacagtgtgtttggagggtcttgagaacatcctcaaagttggtgagcatgacaagaccgcgggcgcaacaggtgacatcaatgtctttgctcagatgattgatgaacacgaaggcttggaaaagatcgagaacctacagagccacgataacaacgaaatctatgaaaaggctgtgaagcttcttgaggcatactggatggaggaggaagatgatgcaatggcaactgttggggaagctgctcccgctgtttttgactttggccaaggtggcaaccctccagctggcttcaattaaatacagtcttttaaccaaagggtggcaatttcctggcgatggcttcttgtcatgagtagtcaatgtagtacgtttgattccatgtttgggataatggctgtggtgggtacaataagcttgagttttcgagggagctgggttaacattattcccatgtgagtcatggtatcagtatcgcagggtctgtaacaggattatacttgtcaacctgagtctggatttttgagaaggctactctctagggtttgttcgtttagtttggtgtgttatatctggctactgtatagcccgagccgaagcgtctgcaagacattcctgaatggtttggttttgagtttcttcaggaatgggctgcgttgcccaaagtatcttacatattctataaactgccactttgctactttcacatttgcgttattcaagtttagctggtgcttaaatgtgtaacaaaaacaatgcggtagctgatgctattggagtactgtaatctcacgattattc

SEQ ID NO: 4841 - DNA, 2170 bp, Pennisetum glaucum
ccgccgctagggtttctcctctattttccccctcctcccgctcccctccgcatccccgacgccccgctagggttttgcctcctccctgccgccgccgccgccgccggcgctgcagcgagcgagacccaggggttgagagcgagaggagcttcagccatgtcgctgcgcccgagcgagcgggtcgaggtgcggcggaaccgctacaaggtggcggtggacgcggaggaggggcggcggcggcgcgaggacaacttggtcgagatccgcaagaaccgccgcgaggagagcctcctcaagaagcgccgagaggggctccaggctcaggcccccgtccccgcctccggggtcgagaagaagcttgaaagcctcccagctatggttagtggagtttattcggatgacaacaacactcagcttgaggccacaacacagttccgcaagttgctctctatagagaggagccccccaattgaagaagttatccaatcgggtgtcgttcctagatttgtgcagtccctcaccagagaggacttccctcaactgcagtttgaagcagcatgggcacttacaaatattgcttcgggaacttctgaaaatacgaaggttgttattgatcacggagctgttccaatatttgtgcagcttcttcaatctgctagtgatgacgttcgcgaacaggctgtgtgggctttgggcaatgttgctggtgattctccaaagtgccgtgaccttgttctcgccaatggtgcattgatgcctctgctagcccagttgaatgagcatgctaagctttccatgttgaggaatgctacctggacactgtctaacttctgcaggggaaagccacagccatcatttgatcagactaagcctgctctgccagcacttgctcgacttatccattctaatgatgaggaagttctcaccgatgcttgctgggctctttcatatttatctgatggcactaatgataagatccaagctgtgattgaagctggtgtttgtccccgccttgtagagctcctcctccatccatcaccgtcggtgcttatacctgctctacgcactgttggaaacattgtcactggagatgatttgcaaactcagtgcataattgatcatcaagctcttccctgcctcctgaacctattgacgcagaaccacaagaaaagcattaaaaaagaggcttgctggacaatttcaaatattactgctggaaacaaagatcagatacaggctgtgataaatggtggaattatccctcctttgttgcaactgctccaaacagcagagtttgatattaaaaaagaggctgcttgggccatctcaaatgctacctcaggtggctcccatgatcaaatcaagtatttggtaactgagggctgcatcaagccattgtgcgaccttcttgtttgccctgatccgagaattgtaacagtgtgtttggagggtcttgagaacatcctcaaagttggtgagcatgacaaggctgctggtgcaacaggtgatgccaatgtctttgctcagatgattgatgaacacgaaggcttggaaaagattgagaacctacagagccatgataacaacgaaatctatgaaaaggctgtgaagctccttgaaacatactggatggaggaggaagatgacgcaatggctactgctggggaagctgctcccgctgtttttgactttgcccaaggtggcaaccctccagctggctttaattaaatacagtcttgtaaccaatgcttggtaattccatgggcgatggatttggagttggcttgtcatgctgtcaatgtagcacgtttgattccatgtttgggggtaatggctgtggtgggtacaataagcttgttttcgagggagctgggttaacattattcccatttgagtcatggatatcagtattgccagggtctgtgtaacaggattatacttgtcaacctgagtctggatttttgagaaagctactctagggtttgttcgtttagtttgtgtgttaaatctggctactgtatagcccgagctgaagcgtctgcaagacattcctgaatggtttggttttgagtttcttcaggaatgctccggagttgtaaacctttgatggtttcctagtgtattgctcgtcttagcttttccgtgggctcgtacttgttgcccaaagtat

SEQ ID NO: 4842 - DNA, 2128 bp, Hordeum vulgare
tctcctctccctcttaattttctcccttcccctcgcgctcctccccgcccccagagccccgtcgcctagctagggtttttgtctccccgccgccaccgccgcgcgcgcgcgagagagagagaccagagcaactaacccagccatgtcggtgcgcccgagcgagagggccgacgcgcggcggaaccgctacaaggtgacggtggacgccgatgaggggcggcggcggcgcgaggacaacatggtggagatccgcaagaaccgccgcgaggagagcctcctcaagaagcgccgcgaggggctccaggcccaggctcccatacccgccgccggcgtcgagaagaagcttgaaagcttacctgctatggttggtggggtttattcggaggataacaacctgcagcttgaggcaacgacacaattccgcaagttgctttctatagaaaggagccccccaatcgaagaagttatccaatcaggcgttgttcctcgatttgtgcagtttcttactagggaggatttcccccaactccagtttgaagcagcgtgggcactcacaaacattgcgtctggcacatcagagaataccaaggttgtcattgatcatggggcagttccaatatttgtgaagcttcttgcgtctggcagtgatgatgttcgtgagcaggcggtctgggcactgggcaatgttgctggtgactccccaaagtgccgtgaccttgttctcgcaaatggcgcattgatgcctctgctagcacagttgaatgagcatgctaaactctccatgttaaggaatgcgacctggactttatcaaatttctgcagaggaaagccacaaccagcatttgatcagactaagcctgctctgccagcacttgcacgacttatccattccaatgatgaggaagttttaactgatgcatgctgggctctttcctatctctctgatggcaccaatgacaagatccaatctgtgattgatgctggtgtctgtccccgacttgtggagcttctcctccatccatcaccttcagtgcttatacctgcactacgaactgttggaaatattgtcacaggagatgactcacaaactcagtgcatcattgatcatcaagctcttgggtgtctcctcagtctgttgacagaaaatcacaagaaaagcattaagaaagaggcctgctggactgtttcaaatatcactgctggtaacaaagatcagatacaggctgtgattactgctggaattatttttcctttggtgcatctgctgcaaacggctgagtttgatatcaagaaggaggctgcttgggccatctcgaatgctacctccggtggttcccatgaccaaataaagtatttggttagcgagggctgcatcaagccactgtgtgacctcctcctttgcccagatccaagaatcgttacagtttgcttggagggtcttgagaacattctcaaagttggagaaactgataagaatttgggtgcttctggggagggaaatgtctatgcacagatgattgatgaagcagaaggcctggaaaagattgagaacctgcagagccatgataacaatgaaatctatgagaaggctgtgaagattcttgaggcttactggatggaggaggaagatgatgcgatggggacaactatggaagctcccacaggtgttgcctttgactttggccaaggtggcaaccctgatctgaacttgggctgaatacagatttgaccaatggtggcaattcccttgtctctggagttgtcaccatttggtgtagtcggtgtgtgggggtaaggtcatggttgtggtgggtccaataagctgaagatttcaagaaagcaactggtcctgggtatcaaatatcacagcgattgtaagaggagtataatcgtcgaacttgaggagtctgggtttttttctatcaggctactatgtaggggttgcatctttagtatggtgtgcactattttgctactgtatagcctgagttgagcttctgcaactctgcgaggcatttaggtgacaatttcttgaatgatttggtatgtgcggttcttcaggaatgaagtgagttgcagtttgttcgaacatgtcaatgtctggtttcacttaattattctatctgtg

SEQ ID NO: 4843 - DNA, 2071 bp, Triticum aestivum
cccccagagccccgtcgcctagctagggtttttgcctccccgccgccaccgccgcgcgcgcgcgagagagagaccacagcgaccaacccagccatgtcggtgcgtccgagcgagcgggccgacgcgcggcggaaccgctacaaggtgacggtggacgccgatgaggggcggcggcggcgcgaggacaacatggtggagatccgcaagaaccgccgcgaggagagcctcctcaagaagcgccgcgaggggctccaggcccaggctcctatccctgccgccggcgtcgagaagaagcttgaaagcttacctgctatggttggtggggtttattccgaggataacaacctgcagcttgaggcaacgacacaattccgcaagttgctttctatagaaaggagccccccaatcgaagaagttatccaatcaggcgttgttcctcgatttgtgcagtttcttactagagaggatttcccccaactccagtttgaagcagcgtgggcactcacaaacattgcgtctggcacatcagagaataccaaggttgtcattgatcatggggcagttccaatatttgtgaagcttcttgcatctggcagcgatgatgttcgtgagcaggctgtctgggcattgggcaatgttgctggtgactccccaaagtgccgcgaccttgtactcgcaaatggtgcattgatgcctctgctagcacagttgaatgagcatgctaaactctccatgttaaggaatgcgacctggactttatcaaatttctgcagaggaaagccacagccagcatttgatcagactaagcctgctctgccagcacttgcacgacttatccattccaatgatgaggaagttttaactgatgcatgctgggctctttcgtatctctctgatggcaccaatgacaagatccaatctgtgattgatgctggtgtctgtccccggcttgtggagcttctcctccatccatcaccttcagtgcttatacctgcactacgaactgttggaaatattgtcacaggagatgactcgcaaactcagtgcatcattgatcatcaagctcttgggtgtctcctaagtctgttgacacaaaatcacaagaaaagcatcaagaaagaggcctgctggactgtttcaaatatcactgctggtaacaaagatcagatacaggctgtgattactgctgggattattggtcctctggtgcatctgctgcaaacggctgaattcgatatcaagaaggaggctgcttgggccatctcgaatgctacctccggtggttcccacgaccaaatcaagtatttggttagcgagggctgcatcaagccactgtgtgacctcctgctttgcccagatccaaggattgttactgtttgcttggagggtcttgagaacattctcaaagttggagaaactgataagaatttgggtgcttctggggaggggaatgtctatgcgcagatgattgatgaagcagagggcctggaaaagattgagaacctgcagagccatgataacaatgaaatctatgagaaggctgtgaagattctcgaggcttactggatggaggaggaagatgatgcgatgggggcaactatggaagctcccacaggtgttgcctttgactttggccaaggtggcaaccctgatctgaacttgggctgaatacagatttgaccaatggtggtaattcccttgtcgctgcagttgtcaccatttggtctagtcggtgtgtggggtaaggtcatggttgtggtgggtccaataagctgaagattttcaaggaagcaactggtcctgggtatcaatatcgcagcgtttgtaagaggagtataatcgtcaaacttgaggagtctgggtcttttttatcaggctactatgtaggggtttgcatctttagtatggtgtgcactattttgctactgtatagcctgagtttaagcttctgcaactctgcgaggcatttaggggacaattcttgaatggtttggtttgtggggttcttcaggaatgaagtgagttgcagtttgtccgaacatgtcaatgtcagctttcacttaattattag

SEQ ID NO: 4844 - DNA, 2169 bp, Secale cereale
ttccccgttttaccgccaaggtccggaccggcctagggttttccgtacctcctccctccttttccttcccccgtccctcgtccgcgcctaccctccccacccccacgagccccgtcgcctagctagggtttttgcctccccgccgccatcgccgcgcgcgcacgcgagagagagaccacagcgactaacccagtcatgtcggtgcgtccgagcgagcgggccgacgcgcggcggaaccgctacaaggtgacggtggacgccgatgaggggcggcggcggcgcgaggacaacatggtggagatccgcaagaaccgccgcgaggagagcctcctcaagaagcgccgcgaggggctccaggcccaggctcctatccccgccgccggcgtcgagaagaagcttgaaagcttacctgctatggttggtggggtttattccgaggataacaacctgcagcttgaggcaacgacacaattccgcaagatactttctatagaaaggagccctccaattgaagaagttatccaatcaggcgttgttcctcgatttgtgcagtttcttactagagaggatttcccccaactccagtttgaagcagcgtgggcactcacgaacattgcgtctggcacatcagagaataccaaggttgtcattgatcatggggcagttccaatatttgtgaagcttcttgcgtctggcagtgatgatgttcgtgagcaggctgtctgggcattgggcaatgttgctggtgattccccaaagtgccgcgaccttgttctggcaaatggcgcattgatgcctctgctagcacagttgaatgagcatgctaaactctccatgttaaggaatgcgacctggactttatcaaatttctgcagaggaaagccacagccagcatttgatcagactaagcctgctctgccagcccttgcacggcttatccattccaatgatgaggaagttttaactgatgcatgctgggctctttcgtatctctctgatggcaccaacgacaagatccagtctgtcattgatgctggtgtctgtccccggctcgtggagcttctcctccatccatcaccttcagtgcttatacctgcactacgaactgttggaaatattgtcacaggagatgactcacaaactcagtgcatcattgatcatcaagctcttgggtgcctcctaagtctgttgacacaaaatcacaagaaaagcattaagaaagaggcctgctggactgtttcaaatatcactgctggtaacaaagatcagatacaggctgtgattactgctggaattattggtcctttggtgcatctgctgcaaacggctgagtttgatatcaagaaggaggctgcttgggccatctcgaatgctacctctggtggttcccacgaccaaatcaagtatttggttagcgagggctgcatcaagccactgtgtgacctcctcctttgcccagatccaagaattgttacagtttgcttggagggtcttgagaatattctcaaagttggagaaactgataagaatttgggtgcttctggggaggggaatgtctatgcacagatgattgatgaagcagaaggcctggaaaagattgagaacctgcagagccatgataacaatgaaatctatgagaaggctgtgaagattctcgaggcttactggatggaggaggaagatgatgcgatgggggcaactatggaagctcccacaggtgttgcctttgactttggccaaggtggcaaccctgatctgaacttgggctgaatacagatttatccagtggtggtaattcccttgtcagctgcagttgtcaccatttggtctagtcggtgcgtggtgggttaaggtcatggttgtggtgggtccaataagctgaagattttcaaggaagcaactggtccagggtatcaatatcgcagcgtttgtaagaggagtataatcgttaaacttgaggagtctgggtcttttttatcaggctactatgtaggggttgcatctttagtatggtgtgcactattttgctactgtatagcctgagtttaagcttctgcaactctgcgaggcatttaggggacaattcttgaatggtttggtttgaggggttcttcaggaatgaaggtgttgcagtttgtccgaacatgtcaatgtcagctttcatttgat

SEQ ID NO: 4845 - DNA, 2096 bp, Avena sativa
ctctccctcttttctctcctctccttctggcgctcctcctcccaccccagagccccgtcgcctagctagggtttttgcctctccgccgccacagccgcgcgagagagaacagagcgagcagccagccatgtcggtgcgcccgaacgaccggatcgacgcgcggcgcaaccgctacaaggtgacggtggacgccgatgaggggcggcggcggcgcgaggacaacatggtggagatccgtaagaaccgccgcgaggagagcctcctcaagaagcgccgcgagggcctccaggcccaggctcccatccccgccgccggcgtcgagaagaagcttgaaagcctccctgctatggttgctggggtttattcggaagataacaacatgcagcttgaggcgacgacgcagttccgcaagttgctatctatagaaaggagccccccaattgaagaagttatccaatcaggtgttgttcctcgatttgtgcagttccttaccagagaggattttccccaactccagtttgaagcagcgtgggcactcacaaatattgcgtcaggcacatcagataatacaaaggttgtgattgatcatggggcagttccaatatttgtcaagctgcttgcatcgggtagtgatgatgttcgggagcaggctgtctgggcattgggcaatgttgctggcgactccccaaagtgccgtgaccttgttcttgcaaatggcgcattgatgcctctgctagcccaattgaatgaacatgctaaactgtccatgctaaggaatgccacctggactttatcaaatttctgcagaggaaagccacaaccagcatttgaacagactaagcctgctctgccagcacttgcacgacttattcattccaacgacgaggaagttttaactgatgcatgctgggctctttcgtatctctctgatggcaccaatgacaagatccaatctgtgattgatgctggtgtctgcccccggcttgtggagcttctgcttcacccgtcaccttcagtccttatacctgcactacgaactgtcggaaatattgtcactggggatgactcacagactcagtgcatcattgatcatcaagctctttcctgcctcctaagtctgttgactcagaatcacaagaaaagcattaagaaagaggcctgctggacagtttcaaatattactgctggtaacaaagatcagatacaggctgtggttaatgctggaattattggtcctctggttcatctgcttcaaacagcagagtttgatatcaagaaggaggctgcttgggccatctcgaacgctacctcgggtgggtcccatgatcagatcaagtatttggtcaccgagggctgtatcaagccattgtgtgaccttctgctttgcccagacccaagaattgttacagtttgcttagagggtctcgagaacattctcaaagttggagagactgacaagaatttgggtgcctctggtgatggaaatgtctatgcgcagatgattgatgaagcagaaggtttggaaaagattgagaacctgcagagccatgataacaacgaaatctacgagaaggctgtcaagattcttgaggcttactggatggaagaggaggatgatgcgatgggagcaggtatggaagctccccaaggtgtttcctttgactttggccaaggtgggcaaccctgatttgaacttgggctaaatacagattcgatcaatggtggaaatttccttgtcgcaccatttggtccagtcgatgtgggggtaatggttgtggtggtccaataagctaaggtttcaaaggagaaattatttccagcttgtcctgggtatcgtatcagtgtttgtaagaggattatatcgtcaaagttgaggagtctgggtttttttaatcaggctactatgtaggggttgcatctttagtatggtgtgcactattttggtactgtatagcctgagtttaagcttctgcaactctgcgaggcaattagggaacgttcctgaatggtttggttttggggttccctcaggaatgaactgagttcactttgtccgtacttgtcaactgtaatgcttccacttaattatatttctg

SEQ ID NO: 4846 - DNA, 2060 bp, Brachypodium distachyon
ccccgtcgcctagctagggttttggcctctccgccgccaccaccgcgcgagagagaccagagcgagtagccagccatgtcgctgcgtccgaacgagcgggtggaggcgcggaagagcagctacaagtcgacggtggacgccgatgacgggcggcggcggcgcgagggcgacatggtggagatccgaaagagccgccgtgaggagagcctcctcaagaagcgccgcgagggcctccaagcccaggcccccgtccccgcagccggcgtcgagaagaagctagaaagccttcctgctatggttgcgggggtttattcagatgatattaatcttcagcttgaggcgacgacacagttccgcaaattgctttcaatagagaggagccctccaatcgaagaagttatcaagtcaggtgtcgttcctcgatttgtgcaatgtcttggcagagatgatttcccacaactccagtttgaagcagcgtgggcactcacaaacattgcttctggcacatcggaaaatacaaaggttgtcattgatcatggcgcagttccaatatttgtgaagcttcttgggtctggtagtgatgatgttcgtgagcaggctgtctgggcgttgggaaatgttgctggcgactcccccaggtgccgtgaccttgttcttgaaagtggtgcattgatgcctctgctcgcacagttgaatgagcatgctaaactctccatgttaaggaatgccacctggactctatcaaatttctgcagaggaaagccacaaccagcctttgatcagactaagcctgccctgccagcacttgcacgacttattcattccaatgacgaggaagttttaactgatgcatgctgggctctctcgtatctctctgatggcaccaatgacaaaatccaatctgtgattgacgctggtgtctgtccccggcttgtggaacttctcctgcatccatcaccctcagtgcttatacctgcactacgaactgttggaaatatagttactggagatgactcacaaactcagtgcatcattgatcatcaagctcttgcctgcctcctaagcctcttgacacaaaatcacaagaaaagcattaagaaagaggcctgctggacggtttcaaatattactgctggtaacaaagatcagatacaggctgtgataaatgccggaattattggtcctttggtacatctgctgcaaacagcagagtttgatatcaagaaggaggctgcctgggccatctcaaatgctacctcgggtggttcccatgatcaaatcaagtatttggtcagcgagggttgcatcaagccattgtgcgaccttcttatttgcccagattcaagaattgttacagtttgtttggagggtcttgagaacattctcaaagttggagaaacagacaagaatttgggtggtgatgggaatgtatatgccctgatgattgatgaagcagaaggcctggagaagattgagaacctgcagagtcatgataacaatgaaatttatgaaaaagctgtgaagattcttgaggcttactggatggacgaggaagacgatgcaatggggggtgctatggaagcttctcaaggtgtttcctttgatttcggccaaggtggcaaccctgatttgaacttgggctaaatacagatttgatcgatggtgctggtttctcgtcgctgcagttcaccatttggtccagtcgatgtgtgggggggcggtccaataagcttaaaagatttcgaatgggcaattatttccagctggtcctggggtatcatgtcgcacgcagtgtttgtaacaggattacaatggtcatacttgggagtctgtttttttttatcaggctactatgtagggtttgcatctttagtatggtgtgctattttgctactgtatagcctgagttaaggttctgcaactcttgagaggccgtagtcaacgttcctgaatggtggtttggttttgagaatcttcaggaatgaatagttgcaattcgtacgaacttatgaaccctaatgcatcctcttttatgttacattttctcaattgtttagttc

SEQ ID NO: 4847 - DNA, 2862 bp, Brachypodium distachyon
gggaatatctcgatcgtggtgtgggctttaaactccctttggcaccggccactagggtttctccttcttttctcccccgctctcgcgctcctcccccgtcgcctagctagggttttggcctctccgccgccaccaccgcgcgagagagaccagagcgagtagccagccatgtcgctgcgtccgaacgagcgggtggaggcgcggaagagcagctacaagtcgacggtggacgccgatgacgggcggcggcggcgcgagggcgacatggtggagatccgaaagagccgccgtgaggagagcctcctcaagaagcgccgcgagggcctccaagcccaggcccccgtccccgcagccggcgtcgagaagaagctagaaagccttcctgctatggttgcgggggtttattcagatgatattaatcttcagcttgaggcgacgacacagttccgcaaattgctttcaatagagaggagccctccaatcgaagaagttatcaagtcaggtgtcgttcctcgatttgtgcaatgtcttggcagagatgatttcccacaactccagtttgaagcagcgtgggcactcacaaacattgcttctggcacatcggaaaatacaaaggttgtcattgatcatggcgcagttccaatatttgtgaagcttcttgggtctggtagtgatgatgttcgtgagcaggctgtctgggcgttgggaaatgttgctggcgactcccccaggtgccgtgaccttgttcttgaaagtggtgcattgatgcctctgctcgcacagttgaatgagcatgctaaactctccatgttaaggaatgccacctggactctatcaaatttctgcagaggaaagccacaaccagcctttgatcagactaagcctgccctgccagcacttgcacgacttattcattccaatgacgaggaagttttaactgatgcatgctgggctctctcgtatctctctgatggcaccaatgacaaaatccaatctgtgattgacgctggtgtctgtccccggcttgtggaacttctcctgcatccatcaccctcagtgcttatacctgcactacgaactgttggaaatatagttactggagatgactcacaaactcagtgcatcattgatcatcaagctcttgcctgcctcctaagcctcttgacacaaaatcacaagaaaagcattaagaaagaggcctgctggacggtttcaaatattactgctggtaacaaagatcagatacaggctgtgataaatgccggaattattggtcctttggtacatctgctgcaaacagcagagtttgatatcaagaaggaggctgcctgggccatctcaaatgctacctcgggtggttcccatgatcaaatcaagtatttggtcagcgagggttgcatcaagccattgtgcgaccttcttatttgcccagattcaagaattgttacagtttgtttggagggtcttgagaacattctcaaagttggagaaacagacaagaatttgggtggtgatgggaatgtatatgccctgatgattgatgaagcagaaggcctggagaagattgagaacctgcagagtcatgataacaatgaaatttatgaaaaagctgtgaagattcttgaggcttactggatggacgaggaagacgatgcaatggggggtgctatggaagcttctcaaggtgtttcctttgatttcggccaaggtggcaaccctgatttgaacttgggctaaatacagatttgatcgatggtgctggtttctcgtcgctgcagttcaccatttggtccagtcgatgtgtgggggggcggtccaataagcttaaaagatttcgaatgggcaattatttccagctggtcctggggtatcatgtcgcacgcagtgtttgtaacaggattacaatggtcatacttgggagtctgtttttttttatcaggctactatgtagggtttgcatctttagtatggtgtgctattttgctactgtatagcctgagttaaggttctgcaactcttgagaggccgtagtcaacgttcctgaatggtggtttggttttgagaatcttcaggaatgaatagttgcaattcgtacgaacttatgaaccctaatgcatcctcttttatgttacattttctcaattgtttagttctgtcatttgctcaattatgctatgtgcgtcgtagaatcgtaggaagtaactaaataatgcttcaggaatgaagggttagagttcgtcagggggtattacatgcaatttagtcaatcacgaatcaagtaattgtacatttgatatctcgtacatttcgaaacaaattgttacacatgagcaaataatgctttgtcgcaaagctgaaagcaattcttaaaattgacaaatggatagagggatacgtgtgcaggacacacactgtctctgcccgcattctcgactgggcgctcaaacttcagacagccgtggacaccttggtaatgcatccggcgttgctgggctgcacttggcacggggcagcagtgatctccggcgcattcggcagcatcggatgtggatgtgggtgtggttgtgggtacgggtgcggagccgggtgtggcgggtacgacacgggcggcaggtggtggtgcgggacgcccgcgtgtcccgggtagtggtgtccggcgccgccgtgatggccacgcagcttgtgcgcctgcacggcggtgacatagacgacgaagccgacgacgacggtgatgagccccaggatcccggccgccgcgaacatccccgggcgcacccggtggcacacgggccgcggcttccgccagtcgctgacgtgcccggactccaccccgatgccgatcatcagcagcacctccgccag

SEQ ID NO: 4848 - DNA, 1948 bp, Festuca arundinacea
  misc_feature (127)..(127): n is a, c, g, or t
  misc_feature (143)..(143): n is a, c, g, or t
  misc_feature (944)..(944): n is a, c, g, or t
  misc_feature (968)..(968): n is a, c, g, or t
  misc_feature (977)..(977): n is a, c, g, or t
  misc_feature (1055)..(1055): n is a, c, g, or t
  misc_feature (1607)..(1607): n is a, c, g, or t
  misc_feature (1655)..(1655): n is a, c, g, or t
  misc_feature (1659)..(1659): n is a, c, g, or t
  misc_feature (1669)..(1669): n is a, c, g, or t
  misc_feature (1671)..(1671): n is a, c, g, or t
ggcacgagggttttgcctcccgccgccgccgccaccgccgcgagagagaccagagccagcatccagccatgtcggtgcgcccgaacgatcggatcagcgcgcggcggaacacctacaaggtgacggnggacgccgatgagggncggcggcggcgcgaggacaacatggtggagatccgcaagggccgccgcgaggagagcctcctcaagaagcgccgcgaggggctccaggcccaggtccccatccccgccgccggcgtcgagaagaagcttgaaagcctccctgctatggttgctggggtttattcagatgagaacaacatgcagcttgaggcgacgacgcaattccgcaagttgctatctatagaaaggagccccccaattgaagaagttatccagtcaggtgttgttcctcgatttgtgcagtttcttaccagagaggattttccccaactccagtttgaagcagcatgggctctcacaaacattgcatcgggtacatcagataatacaaaggttgtgattgatcatggggcagttccaatatttgtgaagctgcttgcggccggtagtgatgatgttcgtgagcaggctgtctgggcattgggcaatgttgctggtgactccccaaagtgccgtgatcttgttctcgcaaatggcgcattgatgcctctgctagcccagttgaatgagcatgctaagctctccatgttaaggaatgccacctggactttatcaaatttctgcagaggaaagccacaaccagcatttgaacagactaagcctgctctgccagcacttgcacgacttattcattccaatgatgaggaagttttaactgatgcatgctgggctctttcgtatctctctgatggcacgaatgacaagatccaatctgtgattgatgctggtgtctgcccccggcttgtggagcttctgcttcanccatcaccttcagtgcttataccngcactacgnactgttggaaatattgtcacaggggatgactcacagactcagtgcatcattgatcatcaagctctctcctgcctcctnagtctattgactcagaatcacaagaaaagcattaagaaagaggcctgctggacagtttcaaatattaccgctggtaacaaagatcagatacaggctgtggttaatgctggaattattggtcctctggtacatctgcttcaaacagcagagtttgatatcaagaaggaggctgcttgggccatctcgaatgctacctctggtggttcccatgatcaaatcaggtatttggtcagcgagggctgcatcaagccattgtgtgaccttctcctttgcccagacccaagaattgttacagtttgcttagagggtcttgagaacattctcaaggttggagagactgacaagaatttgggtggctctggtgatggaaatgtctatgcgcagatgattgatgaagctgaaggcctggagaagattgagaacctgcagagccatgataacaatgaaatctatgaaaaggccgtgaagattcttgaggcttactggatggaagaggatgatgatgcgatgggaggagctatggaagttccccaaggtgcttcctttaacttnggccaaggtggcaaccctgatttgaacttgggctaaatacagatttgnccantggtgttaantnccctgtcgcagcagctctcaccatttggtccagtcgatgttgtgttagtccaataagctaaggtttcaagggagcaattatttcagctggtcctgggtatcgtatcgcagtgtttgtaagaggattatgatcgtcaaacttgtggagtctgggttttttttaatcaggctactatgtaggggttgcatctttagtatggtgtgcactattttggtactgtatagcctgagttgagcttctgcaactctgcgaggcaattagggaaacgttcctgaat

SEQ ID NO: 4849 - DNA, 2067 bp, Manihot esculenta
taatcatgtctttgaggccaagcgcgaggaccgaggtccgcaggaatagatacaaggttgctgttgatgctgaggaaggtcgtcgcaggcgagaagacaacatggtggagatccgaaagaatcgtcgcgaggagagcctgcagaagaagcgccgtgagggactccaagcgcagccgatgcctgcttcgattcactcctccgctgtcgagaagaagttggagcatctcccatcaatggttgctggtgtttggtctgatgatagtaatttgcagcttgaggcaacaacacaattcaggaaattgctctccattgagcgtagccctccaattgaggaagtaatacaggctggtgttgtcccccgttttgttgagtttcttatgagggaggattttcctcagcttcagtttgaagcagcttgggctctcacaaatattgcttctgggacttctgagaatacaagggtggtaattgatcatggagctgtccccatatttgtaaagcttcttggttctccaagtgatgatgttcgtgaacaggctgtgtgggcattgggaaatgttgctggagattctcctaaatgtcgtgatcttgttcttggccatggagctttgattcctttgcttgcacagttgaatgagcatgctaaactatctatgctaaggaatgctacatggacgctgtctaacttctgccgaggcaagccacagccaccttttgaccaggttaaacctgccctccctgctcttgcacgtttaattcattctaatgatgaggaagtcttgactgatgcatgttgggcactctcgtatctttctgatggtaccaatgacaaaattcaagctgttattgaagccggagtatgccctcggctagttgagcttttattacacccatctccttcagttctgattcctgcactccgcactgttgggaacattgtcactggtgatgatatgcagacccagtgtatcatcaatcatcaagcactgccttgccttctgaatttgttgacaaataactataagaagagtatcaagaaggaagcttgttggacaatttctaacataactgccggaaacaaagagcagattcaggctgtaattgaggctaatatcattggcccattagttcatctacttcaaaatgctgagtttgacattaagaaggaggctgcatgggcaatctcaaatgctacttccggtggttctcatgaacaaatcaagtaccttgttagccaaggttgcattaagcccttatgtgaccttctcatatgccctgatccaaggatagttacagtgtgtctagaaggtcttgaaaacatcttgaaggtaggagaagctgacaagaatttaggcaacactggaggggtaaatcaatatgcacaaatgattgatgatgctgaagggttggagaaaattgaaaatctacagtctcatgacaacacagagatttatgagaaggctgtgaagatgcttgagacatattggctggaggaggaggatgagacaatgcctccaggagatgcttcccaatctgggttccaatttggtgggggtgaaatgcctgctgttccatctggtggatttaatttcagctagacgagttgtcactggttcagtattgaagttgtgaaatgtggcgaaacagttgtcagcttcaggctgggtgtcatggtgtcatgtttgggtctactggttcagtcttaaggtgtggtagaaaaggcaggacagttcggggttttcagattgacgagattaatattggtgtgggaagacaaaatgagttgggtcacattatgaacatgggttttctctgctataaacttgagaaaaccgtgctcatttttggtgggggggattgttcttggaggttgggctctcagaacgaaaatggggtctttttgaatgtatttgttgtcatagtttgttttagtagcgtctctgccctttccacagtctgtcgattttggcactcccagaatccatttagtggcgtgcttgtacttactaggaatatggaaaaatatatatatatttatttatttataatttttagagtcagttgcgt

SEQ ID NO: 4850 - DNA, 2407 bp, Eucalyptus grandis
acgatcggggcccaatctcatttccggggcgtcgactcgcacgagctccgctataaagcagatcctccttcgagcctcttctcttcactcactttctctctctagctcttccccgctctctgaccgatcgcaaccctctctaaaaccctctcgctttctctctctagggttttgcccgctccccttccctggtccaccacctcggctgcgcccccgatcgatcccccgccccgacgatgtcgctccggccgaacgcgaggacggaggtccgccgtaaccgctacaaggtggcggtcgacgcggaggaggggcggcggcggagggaggacaacatggtggagattcgcaagaaccggcgcgaggagagcctgcagaagaagaggcgggagggcctccaggcccagcagcagaccgcgccgtcgctccactcttccgccgtcgagaagaagctggaacatttgccttccatgattggtggtgtatatagtgatgataataacttgcaactggaggccactactcaatttagaaaattactctctattgaacgcagccctccaattgaagaagttatacaatctggagttgttccacggtttgttgagtttctaatgagggaggattttcctcaactccagttcgaagcagcgtgggctcttactaatattgcttccgggacatctgagaacactaaagttgtggttgatcacggagccgtccctatatttgttaaacttcttgcttctcctagtgatgatgttcgtgagcaggctgtgtgggcactgggaaatgttgctggtgattctcctaaatgccgtgatctggttcttgcaaatggagctttgcttcctttattggcacagttgaatgagcatgctaaactgtcaatgctgagaaatgctacctggactctctcgaacttttgtaggggaaagccacaacctccttttgatcaggttaggcccgcacttccagctcttgaacgtcttatccattcaaatgatgaagaggtcttgactgatgcatgttgggcactatcctatctttctgatggaacaaatgacaaaattcaagctgtaattgaagctggcgtttgtcccaggcttgttgaactgcttctccatccatctccgtcagtgctgattcctgcccttcgcactgttgggaatatcgtaactggggatgatttacaaactcagtgcatcatcaaccaccaagcactaccatgccttcttaacctgttgactggaaattacaagaaaagcatcaagaaggaagcatgttggaccatctcaaacatcactgctggaaacaaggagcagattcaggctgtcatagaggctaatataatagctccactcgtccatttacttcaaaatgctgaatttgacatcaaaaaggaagctgcatgggcaatctccaatgctacatccggaggttctcatgaacagataaagttccttgtttgtcaagggtgtataaagcctctgtgtgatcttctcatctgtcctgatccaagaattgtgaccgtctgtttagaaggtcttgagaacattttgaaggttggggaagctgagaaaaacctaggaggtacaggtgatgtgaatctttatgctcaaatgattgacgatgccgagggcttagagaagattgagaacttgcagagtcatgacaacaatgagatatatgagaaagcggttaagcttcttgaaacatactggttggaagaagaagatgaggcgatgcctcctgaggattctgcgcaccctggtgtaccgtttggaggaaatgagctgcctcctgttccgtctggtggtttcaagtttggctaagggaaagctgttgctgaattatataaagttgtcaaactgcggagggatggaatggaatctgcattgaggtcaggtgtcgctcatagtcgccctgttgtgtccagtttttatgagattttggagtcatgcttggaatggcttgggtctggattaagctttgtgaagagagcaattcggtgtggttatatgtggattgatgacgctgcagctaaagagcgctcttggtcgaagtttttgttgcaagaggtcgtcgctgtcagttgggctcctgtcaaggatcttgcagttttaaagtaattactgtcgggctattgtagtcttgttgtcttcacaatggtatattgttatattgctccgctgaaatcttgagcagtattttatttctttacagttgttaagggtcactattatagttattttccattttccattttctccctgttcttgcggatttttctgtcgtcgagacagagcgtggcagcaattgccttctatttgttgaaatgtcaactcttatgttatatgcaaaagatgtgaataaatgattcctttggtacttttgcttctctggacaa

SEQ ID NO: 4851 - DNA, 2341 bp, Elaeis guineensis
ttctcttctctcctgtcctcgccctttctctctctctctgtcgagctttgctagggttggggtataggcctcggtcctccgcttcctcgtccagtgttcttctcttctaggtctctcttcttctttctagggcgtcgggtgccatgtcgctgaggccaagcgagcgggcggaggtccgccggaaccggtacaaggtggcggtggacgcagaggagggccggcggcggagggaggacaacatggtggagatccggaagagccgccgggaggagagcctccagaagaagcgccgcgagggcatgcaggcccagcccttcccccctccctcgatgcacgcttcggctctggagaagaagttggagagccttccagcgatggtggcgggggtttattcggacgacagcacgctgcagcttgaggcaaccacacagttccgaaagcttctttctatagaacgaagccctccgattgaggaggttatccaatctggagtggttccccgctttgtggaattccttacaagggaagattttccccaacttcagtttgaagcagcttgggcacttaccaacatcgcctcagggacctcagagaataccaaggttgtgatagatcacggagctgttccgatatttgttaagcttctaagttccccaagcgatgatgtccgcgagcaggcggtatgggctttgggaaacgttgcgggtgattccccaagatgccgcgatcttgttttggccaatggcgcattgattccactgttggctcaactgaacgagcatgccaagctctcaatgttaaggaatgccacatggactctctcgaatttctgcaggggaaagccacaaccagtttttgagcaggttaagccagctcttcctgcacttgagcgcctcattcattccaatgatgaggaagttctaaccgatgcatgctgggcactgtcatatttgtcagatggtaccaatgacaaaatccaggctgtaattgaagcgggcgtcatccctcggcttgtagagctgcttatgcatccttccccgtcggtgcttattccagctctcaggactgttggtaacattgttactggagatgatgtgcagacacagtatgttatcaattatcaagcacttccttgccttctgagcctcttgacgcacaatcataagaaatccatcaagaaagaagcttgctggaccatatcaaatatcacagctggaaataaggatcagatacaggccgtaattgctgctggtatcattggtcctttagtgcacctgctgcagactgctgagtttgatatcaagaaagaggcagcatgggccatctcaaatgcaacttctggtggtacccatgatcaaattaagtttctagtgagccagggctgcatcaagcccctgtgtgatctccttatttgccccgatccaagaattgttacggtctgtttggaaggactcgagaacatcttgaaggttggtgaggccgaaaagaacttaggtgccaccgggggtgtgaacctctatgcgcagatgatagatgaagctgagggcttggagaaaattgagaatcttcagagccatgacaacacagagatctatgagaaggctgtaaagatcctcgagacatattggttggaggaggaagatgatgccatgcctacaggtgatgctgctcaaagtggattccattttgggaacaacgagcaggtccaagttccatctggtggattcaacttcagttgaaaggattttctgcagtcatcgaagggtggtgccccgacaacgttgatggggcctagtcaaatgtcagttgggcgagtctgtgttattgtccggtcggtcgggtccagtaggtccagtctgaagcgttgatgaagggtgtaccaaataaagaaagcaggttttatggaagaaatcattccaggatgcattctggttctgagacgagtttattggcctagcccatctggcttcctaccactggatatgaggtagcctgaagtttatgaatatcagaaagggagaggaaaagatttggcccatttagagtcaaagtatgtgttgttggatgttgcaggtgattataagcacagattatatagtctttttacctcatgtatagcatgagttctcttttagaggtttaataggagttcattcttggtttgttttctcttgaaggggtcgtttgtttgacctttctgatagagtgtattgtagcatgtcgtgcaagtcatagcaccttcaaagtgttgagaaatggaattgaagtatcttatttgtgtcaaaaaaaaaaaaaactaagcgaacgtccaacgagacacaggaggtagcgcccccccccc

SEQ ID NO: 4852 - DNA, 2279 bp, Eucalyptus grandis
ctctgaccgatcgcaaccctctctaaaaccctctcgctttctctctctagggttttgcccgctccccttccctggtccaccacctcggctgcgcccccgatcgatcccccgccccgacgatgtcgctccggccgaacgcgaggacggaggtccgccgtaaccgctacaaggtggcggtcgacgcggaggaggggcggcggcggagggaggacaacatggtggagattcgcaagaaccggcgcgaggagagcctgcagaagaagaggcgggagggcctccaggcccagcagcagaccgcgccgtcgctccactcttccgccgtcgagaagaagctggaacatttgccttccatgattggtggtgtatatagtgatgataataacttgcaactggaggccactactcaatttagaaaattactctctattgaacgcagccctccaattgaagaagttatacaatctggagttgttccacggtttgttgagtttctaatgagggaggattttcctcaactccagttcgaagcagcgtgggctcttactaatattgcttccgggacatctgagaacactaaagttgtggttgatcacggagccgtccctatatttgttaaacttcttgcttctcctagtgatgatgttcgtgagcaggctgtgtgggcactgggaaatgttgctggtgattctcctaaatgccgtgatctggttcttgcaaatggagctttgcttcctttattggcacagttgaatgagcatgctaaactgtcaatgctgagaaatgctacctggactctctcgaacttttgtaggggaaagccacaacctccttttgatcaggttaggcccgcacttccagctcttgaacgtcttatccattcaaatgatgaagaggtcttgactgatgcatgttgggcactatcctatctttctgatggaacaaatgacaaaattcaagctgtaattgaagctggcgtttgtcccaggcttgttgaactgcttctccatccatctccgtcagtgctgattcctgcccttcgcactgttgggaatatcgtaactggggatgatttacaaactcagtgcatcatcaaccaccaagcactaccatgccttcttaacctgttgactggaaattacaagaaaagcatcaagaaggaagcatgttggaccatctcaaacatcactgctggaaacaaggagcagattcaggctgtcatagaggctaatataatagctccactcgtccatttacttcaaaatgctgaatttgacatcaaaaaggaagctgcatgggcaatctccaatgctacatccggaggttctcatgaacagataaagttccttgtttgtcaagggtgtataaagcctctgtgtgatcttctcatctgtcctgatccaagaattgtgaccgtctgtttagaaggtcttgagaacattttgaaggttggggaagctgagaaaaacctaggaggtacaggtgatgtgaatctttatgctcaaatgattgacgatgccgagggcttagagaagattgagaacttgcagagtcatgacaacaatgagatatatgagaaagcggttaagcttcttgaaacatactggttggaagaagaagatgaggcgatgcctcctgaggattctgcgcaccctggtgtaccgtttggaggaaatgagctgcctcctgttccgtctggtggtttcaagtttggctaagggaaagctgttgctgaattatataaagttgtcaaactgcggagggatggaatggaatctgcattgaggtcaggtgtcgctcatagtcgccctgttgtgtccagtttttatgagattttggagtcatgcttggaatggcttgggtctggattaagctttgtgaagagagcaattcggtgtggttatatgtggattgatgacgctgcagctaaagagcgctcttggtcgaagtttttgttgcaagaggtcgtcgctgtcagttgggctcctgtcaaggatcttgcagttttaaagtaattactgtcgggctattgtagtcttgttgtcttcacaatggtatattgttatattgctccgctgaaatcttgagcagtattttatttctttacagttgttaagggtcactattatagttattttccattttccattttctccctgttcttgcggatttttctgtcgtcgagacagagcgtggcagcaattgccttctatttgttgaaatgtcaactcttatgttatatgcaaaagatgtgaataaatgattcctttggcttttgcttc

SEQ ID NO: 4853 - DNA, 2196 bp, Elaeis guineensis
gggttttgccctcagcctacagcttcttcgtctagggattctttctcttctaggtctctctttttcgttctccggcttcgggagccatgtcgctgaggccaagcgagcgggcggaggtccgccggaacaagtataaggtagcggtggacgcggaggagggccgccgtcggagagaggacaacatggttgagatccggaagagccgccgggaggagagcctccagaagaagcgccgcgagggcatgcaggcccagcccttccccccctcctcgatccacacctccgccctcgagaagaagctggagagtcttccggctatggtggcgggggtttattcggacgacagcacgcttcagctagaggcaaccacacagttccgaaaacttctttctatagaacgaagccctccaattgaggaggttatccaagctggagtggttccccgcttcgtggaatttcttacaagggaagattttccccaacttcagtttgaagcagcttgggcgctcaccaacatcgcctcaggaacctcagacaacaccaaggttgtgatagatcatggggctgttccgatatttgttaaacttctcagttccccgagtgatgatgtccgtgagcaggcggtatgggctttgggaaacgttgctggtgattccccaagatgccgtgatcttgttttggccaatggcgcattgattccactgctggcgcagctgaatgagcatgcgaagctttcaatgttgaggaacgccacatggactctgtcgaacttttgcagggggaagccacaaccagtttttgagcaggtcaagccagctcttcctgcacttgagcgcctcatacattcaaacgatgaggaagtcctgactgatgcgtgctgggcattgtcatatctgtctgatggtaccaatgacaaaatccaagctgtaattgaagcaggcgtcatccctcggcttgtagagctgcttctgcatccttcaccttctgtgcttattccagctcttcggactgttggtaacattgtcactggagatgatgtgcagacacagtatgttatcaatcatcaagcacttccttgcctcctgagcctcttgacacacaatcataagaaatccatcaagaaggaagcttgctggaccatatcaaatatcacggcagggaataaggaacagatacaggctgtgattgctgccggtatcattggtcctttagtgcacctgctgcagactgctgaatttgatatcaagaaagaggccgcgtgggccatctcaaatgcaacttctggtggcacccatgatcaaataaagtttctagtgagccagggatgtatcaagcccttgtgtgatctccttgtttgccccgacccaagaattgtcacagtttgtttggaagggcttgaaaacatcctgaaggttggtgaagcagaaaagaacttggggacaaccgggggtgtgaacttgtatgcacagatgattgatgaagctgagggtttggagaagattgagaatcttcagagccatgacaacactgagatctatgagaaggctgtgaagatccttgagacatattggttggaggaggaagacgatgccatgcccgcaggcgatgctgctcaaactggattccattttgggaacaacgagcagctccaagttccatctggcggattcaacttcagctaaaaggctatgcagacattggaggatggtggcccagcaatgctgatggggccgagtcaaatgtcagttgggggagtcgtgtttattgtccggtcaggtccagtcggtccggtagtgttggtcggggtggtaccaaataaagaagcggtttttatggaagacatcgtaccgggttgcattttggttcaaaggcaagtctctggcttcctatcagtggatcagcggtagccagatgtggatcatttgtcagcggtttatgaatgccagaaaggggaggaaatgattttgacgaatttaatgtcaaagtatgtattgttgcaggtgattaaaaagcacagggtatagtctttttacctcctgtatagcatgagtttctttttgaggtttaatagaagaattcattcttggtttgtttatcttgaaagtgtcttttgtatgagctctgttaagagtataatgtagtatgtcatttaagtctggcaacttgaaaacgttgagagaaggaaatgaagtgttt

SEQ ID NO: 4854 - DNA, 1975 bp, Amorphophallus konjac
ctcatctgtctgtcgctgtggtggtgtggtttgttggcggccgctatttcccctccgttgctgtggttattcttgttggatttctagggttagggtttttcggaggaggcgaagatgtcactgaggccgagcgcgaggacggaggtgcggcggaacaggtacaaggtggcggtggacgccgaggaggggcggcggaggagggaggacaacatggtggagatccggaagagcaagagggaggagagcctccagaagaagaggagggagggcatgcaggcccaggcgctcgcgcccgccgtccacgcctccgccgtcgaaaagaagctggaaagccttccggcgatggtggcgggagtttattcggatgatagcaatctacagctcgaggcgacgacccagttccggaagctcctctcgatagaacgaagtcctccgatcgaggaggtgatccaatctggtgtggtcccccgctttgtcgagtttcttacaagggaggattttccccaacttcagtttgaggctgcttgggctctcacgaacattgcctctggcacctcggagaacactaaggtggtgatagatcatggtgcggtgcctatatttgttaatctcctcaattcacacagcgacgatgtccgggagcaggctgtgtgggcattggggaatgttgccggtgattccccaagatgccgagatcttgttctggcacatggcgcattgctaccgctcctgaatcaactgaatgagcatgcaaagctttctatgcttagaaatgcaacgtggaccttatccaacttctgtagaggcaagccgcagccttcttttgagcagacaaaacctgcacttccagtgcttgttcgtctcattcattcaaatgatgaggaagttctcactgatgcctgttgggcactgtcctatctttctgatggaacgaatgacaaaattcaagctgttattgaagctggtgtctgccctcggattgttgaactacttctccatccttcaccttcagtgttgattcccgcccttagaactgttggcaacattgttactggagatgatctacagacccagcatatcattgatcatcaagcactttcttgccttcttaacctcttaacacacaatcacaagaaaagcataaagaaggaagcttgctggacgatttcaaatataactgctggaaataaggagcaaatacaggctgtaattaatgctggaattattgctcctctagtccatttgcttcaaactgcggagtttgacatcaagaaggaggctgcctgggccatctcgaatgctacttctgggggaacacatgatcagataaagtatctggtgagccaaggctgcatcaagcctctctgtgatctcctcgtttgcccagaccctaggatagtcacagtctgcctggagggccttgagaatatcattaagattggggaagccgagaagaacctgggcacaacagaaggcattaatctttatgcacaaatgattgatgatgctgagggcttggagaagattgagaatcttcagagccatgacaacacagagatatatgagaaggcagtgaagatcctcgagacatattggctggaggatgaagacgacgcaatgcctacgaccgacgctacacaaactggctttcgttttgggaatagcgaagtccctgttccttctggcggattcaacttcggctaatgggcttctgttctgggtccaaaaagcacagtgtgcccaaatggtggcgggtcttgtggtgtcgtcgggtcacgttggtccggtcctagtcatgattgaagtggtggcggtacaataaaatataaaaagggttatgagggggaatttcatatatattttgataccatgagtgctgaatgtattgccttccgctccacgtgcctgcagggcggcgatgtttgtcatcgctgttgaagtcacagtctgaagctggtcggtcggtcggtcggtt

SEQ ID NO: 4855 - DNA, 1601 bp, Manihot esculenta
tggtaatcatgtcgttgcggccaagcgcgaggaccgaggtccgcaggaataggtataaggtcgccgtcgatgctgaagagggtcgccgaaggcgagaagataatatggtggaaatccggaagaatcgtcgggaggaaagcttgcagaagaagaggcgtgaaggcctccaagcccaacccgtgccagctgcaattcattcctcggctgtcgagaagaagttggagcatctaccttccatggttgctggtgtctggtctgaagatagcaatttgcagcttgaggcgaccactcaattcaggaagttgctctcaattgaacgtagccctccaattgaggaagtcatacaggctggtgttgttcctcgctttgttgagttccttatgagggaggactttcctcagcttcagtttgaagcagcttgggctctcacaaacattgcttcagggacatctgaaaatactagggtggtaattgatcatggagctgttcccatatttgtaaagcttctgggttctccaagtgatgatgttcgcgaacaggctgtgtgggcgttgggaaatgttgctggagattcacctaaatgtcgtgatcttgttcttggccatggagctttgattcctttgcttgctcagttgaatgagcacgctaaactttctatgcttaggaatgctacatggacactctcaaacttctgtcgaggcaagccacagccaccttttgaccaggtcaagcctgctcttccagctcttgcacatttaattcactctaatgatgaggaagtcttgactgatgcatgttgggccctctcgtatctttctgatggtaccaacgataaaattcaagctgttattgaagcaggagtatgccctcggctagttgagcttttactgcacccatctccctccgttctcattcctgcacttcgcactgttgggaatattgtcactggtgatgatatgcagacccagtgtatcatcaatcatcaagcactgccgtgccttctgaatttgctgacaaataactataaaaagagtatcaagaaggaagcttgttggaccatatctaatatcaccgctggcaacaaagagcagattcaggctgtcattgaggctaatatcattggtccattggttcatctacttcaaaatgcggaatttgacattaaaaaggaggctgcatgggccatctcaaatgcaacatctggtggtactcatgatcaaatcaagtaccttgttagccagggttgcatcaagcccttgtgtgaccttctcatatgtcctgatccaaggatagtgacagtctgcttagaaggtcttgaaaacatcttgaaggtaggagaagctgacaagaatttaggcaacactggagacgtaaatcaatatgcacaaatgattgatgatgccgaggggttggagaaaattgaaaatctacagtcacatgataacacagagatttatgagaaggctgtgaagatccttgagacatattggcttgaggaggaggatgagacaatgccgccaggagatgcttcccagtctgggttccagtttggcgggagtgagatgcctgctgttccatctggtggatttaattttagctaa

SEQ ID NO: 4856 - DNA, 2004 bp, Aquilegia formosa
cttttcgaaaacacaacactctctctttctctttctctaaggtattctaaggtgtagcgatgtcgctcagaccaaacgcgagaactgaggttcgaaggaaccgatataaggttgctgtagatgcagaagaaggaagaagaaggcgagaagataatatggttgagatccgaaagaataaaagagaagaaagcttgcagaagaagagaagagaaggaatgcaaccacagcaatttcctgctgcgttgcacgcttcgaatattgagaaaaagttagaaagtcttcctgttatggttcaaggggtatttgcagatgataaccagttgcagcttgaggcaactactcagttccgaaagctactatcaatagagcgaagcccaccaattgaggaagtgattcagtcaggtgttgtacctcgctttgtcgagttccttatgagagaagattttccacagcttcagtttgaggcagcttgggctcttaccaatattgcttcgggaacctcggacaacactaaagttgtaattgatcatggtgctgtccctatctttgttaagcttcttggttctcccagtgatgatgtcagagagcaggctgtttgggctcttggtaatgttgctggggattctcctagatgccgagatctggtcctttcgcatggtgcattgatcccactgctagctcagttgaatgagcatgctaagctttctatgttgagaaatgcgacttggaccctatccaatttctgcaggggcaagccacagcctccttttgatcagacaaaacctgcacttccagctcttgaaagacttatccattcaaatgatgaagaagtactaactgatgcatgctgggcactttcatacctctctgatggtacaaatgataaaattcaagctgttatcgaagcaggtgtttgtcctcggcttgtggaacttcttctgcatccttcgccttcagttctcattcctgccctgcgtacagttggaaacattgttacaggagatgatgtccagacccagtgtattatcaatcatcaagctcttccatgcctcttaaacctgttgactcacaatcacaagaagagcattaagaaagaagcttgctggaccatttccaacatcacagctggaaacaaggatcaaatacagtccgtgattgctgctgatattattggtcctcttgttcatctcctacaaactgctgagtttgatatcaagaaagaagctgcctgggctatctcaaatgctacatctggtggtactcacgaacagatcaagtaccttgtggtccagggttgcataaaaccattgtgtgatctacttgtctgccctgatccaagaatagtcactgtctgtttggaaggactagagaacatcttgaaggtcggagaaactgaaaagtccttgggcaacactggaggtgtcaatgtctatgcccagtatattgacgaggctgaagggttggagaagattgagaatctacaaagtcatgataacactgaaatatatgagaaagccgtgaagattcttgaaacctattggttagaagaggaggatgagccattgcctccaggtgatgctgcacaaactgggttccgatttggggggagtgagattccttctggtggattcaactttggttgaaggtgtggatggctgtcgtgtgaagcactgtcgagtgcaggcaaaggagagtcctttttatttattatgttttcatgtaggggtagttactgcaaagtcggtcgggatattgttgtttcgagttcttgtagtccgatgcagccttggctagtgtatagctaggagggaaatacaggaaagagtttttattatggttttgttgtcaagttgattcttggaattaagtcttcattttgttttgaagggtaatgttccttccagttctatgaaagatatatatgtagattatgtcaaaccttactggatgatgaaagttaatagtatcatttccatttgttagcttgttacaagtctttttcag

SEQ ID NO: 4857 - DNA, 2309 bp, Theobroma cacao
ctcttcaaatcaatcaaaatccccccaaaatcttattttcattttccctctagggttttcagccgaaggaaaacaagaagaacaagaaaaagagaaggagttcttgagggttttagttcgatcactgtctttttctctttagggttgtgttttttcgggaattgagagaagatgtcgttgaggccaaacgcaaggacggaggttcggaggaacaggtacaaagtggcggtggacgccgaggaaggaaggcggaggagggaggataacatggtggagattaggaagaaccgccgtgaagagagtttgcagaagaagcgacgtgaaggactccaagctcagccaatgcctgcttctcttcactcctctgctgttgaaaaaaagttggaaaatttgccagccatggttgctggtgtttggagtgaggatagtaatctgcagcttgagtcaaccactcagtttaggaaattgctttcaattgaacgcagcccacctattgaggaagtaatacaagctggtgttgttcctcgctttgttgagttccttatgagggaagatttcccgcagcttcagtttgaggcagcatgggccctcacaaatattgcttctggaacatctgagaacacaaaggtggtaattgatcatggggctgttccaatatttgtgaagttacttggttcccctagtgatgatgttcgtgagcaggctgtgtgggcattgggaaatgttgctggtgattctcctagatgtcgtgatcttgtccttggccatggtgctttgcttcctttgttggcacagttgaatgagcatgcaaagctttctatgctgagaaatgctacttggacactctcaaatttttgtcggggcaagccacagcctccctttgatcaggttaaacctgcacttcctgctttggcacgccttattcactcaaatgatgaagaagtcttaactgatgcatgctgggcgctctcatatctttctgatggtacaaatgacaaaattcaagctgttatcgaagcgggtgtatgtgcgcgtctcgttgaacttttgctgcacccatctccgtcagtgctcattcctgctcttcgcactgttggaaatattgttacaggagatgatctgcaaacccagtgtatcatcaatcatcaagcattgccatgccttttgaatctgttgacaaataattttaaaaagagcatcaagaaggaagcttgttggacaatttcaaatatcacagctggaaataaggagcagatacaggctgtgattgaagctaatattattgctccactggttcatctgcttcaaaatgccgaatttgatattaagaaagaagctgcgtgggccatttcaaatgctacatctggtggaactcatgatcaaatcaagttccttgtaagtcaaggttgtatcaagccgttgtgtgatcttcttaactgccctgatccaaggatagttacagtttgtttagaagggcttgaaaatattttgaaggtaggagaagctgataagaatcagggcaatactggaggtgtgaatctctatgcacaaatgattgatgatgcagagggtttagagaagattgagaatttacagtctcacgataacactgagatctatgaaaaggctgtgaaagttcttgagacatattggttggaggaggaggatgagacaatgccaccaggtgatgcctctcaaacagggtttcagtttggaccgggtgaggttcatgttccgtcagggggattcaatttcagctagaggaattatatctggtcctgtgtaagtccttatggatatggtggaacaatagttgggttccaggtcaggcgtcttgttgtcatgtttgggtcctgtcaagggtcgggtgtggtgtcgagggtgctgggctggcttggaagaacacagccaggttcatattatgcaagaaaggaaatggagggaagatgagattggtgatctgctacaataaattgaggaatcagagtgtttattttgggtgctcgtgaaacaaatattggagtctgtctcaatttgtagttgtcatggttagtggtgatgtctttgcaatggcattgctgggtgattttggcaattcccaaaacagttacaacttgttatgagtaacatgggaatattcttttgcttctacgtaattggagtgttgtgttgtcatatcatgcatcaaaatatgcctcttttagatagtcttatattttttgtgtagtgtatacaatgcctcgttggaagctttgtcaaaacatatcatttggaggggaaatagagttactactaatgtaattgatggt

SEQ ID NO: 4858 - DNA, 2427 bp, Aristolochia fimbriata
cgacaaatcgccaccgactcggttgaactcgttcgcgcagagtggcgaaagccgccagctttcttgccctttcttccttcccgcttccgttctggttttgggaattcggggctctgcttcgcgctctctctcgctatctctctcgctatctctctctcgctatctctctctatttcctctcaacaggcgataggcttctccgatcgtcgttgccatgtcgctcaggccgaacgccaggacggaggttcgacgcaaccgatacaaggttgccgtcgatgcggaagaagggcgtagacggagagaggacaacatggttgagatccgcaagaataggagggaggaaagccttcagaagaagaggagggaaggcatgcaggctcagcaattcccgacttcgatccatgcctctgctgtcgagaagaagttggaaagtcttcctgccatggtgaatggagtttggtcggacgatagtaatttgcagcttgaggccactacacaatttaggaagctgctttctatcgaacggagtccacctatagaagaagttatccaagctggtgttgttccacgttttgtggacttccttttgagggaggattttcctcagcttcagtttgaggctgcttgggctctcacaaatattgcgtcaggaacctcggagaatactaaagttgttattgatcatggggctgtgcccatatttgtgaagcttcttggttctccgagtgatgatgttagggagcaggcggtgtgggctttgggaaatgttgctggtgattccccaagatgcagggatcttgtccttggccatggtgccttgattccattgctggcacaattgaatgaacatgccaagctttccatgctgagaaatgccacctggaccctctccaacttctgcagaggcaaacctcaaccaccatttgagcagaccaaacctgctctgccggcacttgagcggcttatccattccaatgatgaagaggtccttaccgatgcgtgctgggcactttcttacctttcagatggtacaaatgataaaattcaggctgtcattgaagctggtgtctgccctaggcttgttgaactgcttatgcacccttctccttcagtgcttatcccagctctccgaactgttggcaatattgtcactggggatgacatgcaaactcagtgtattatcaatcatcaagcacttccctgccttttgaatctgttaacacacaatcacaagaagagtataaagaaggaagcatgctggaccatctcaaacatcactgctggcaacaaggaacaaatacaggctgtgattaatgccgatattatcggtccattggtcaatttacttcatactgctgagtttgacataaaaaaggaggctgcatgggcaatctcgaatgccacttctggtggtacccacgatcagatcaaatatcttgtgagccaaggttgcattaagcctctttgtgatcttctggtttgtcctgacccgaggattgtaacagtctgtttggaagggttggagaacattctgaaggttggagaggctgagaagaatgttggtaacactggaggagtgaacctctatgctcagctgattgacgaggctgagggattagagaagatagagaatcttcagagccatgataacactgaaatttatgaaaaagctgtgaaaattcttgaaacatactggttagaggaggaagatgaattgcctcctggtgatgctgcagcagcagcgcaagctggtggattccgctttgggggcgagttaccagttccctctggtggattcaacttcagttgaagaggtatggccagaggtgctaaaagcatgaatgcccagttgtcgaagggctggtcttggtttggttggtcagtcaggggagtcgcgtcgcgtcggtgttgtccagtcttgaagtacggtcgaagggggtgatgctgagaagtcttgctgtcggcctgtagaataaaaaaggatgaaagatggagctgggttttggaaggatggacgatggtgattcaagatgtggggtgttggcttcctgttacgagggagtggtaggagccaaactatactcgtcctatatcgcttgtatttgtcttaaaggcgatgggatacttgtctgccttctttaatttgttgttaggaagtagcatagtgttagcaactccaagatcgaggttttgttgttgcagggtggtacagagtccaatgtctggtttttcctctcagctaatatcatgcctcttaatgtatagcgagagcagaagagtttctctatttgaaattcggttttgattggtgatttgtctttttgtgtaagtcacaactcttttctgttactgtgagagaggggaagggagggatcaatttgtagttaaacttttacaaattagtatcactgcatttaaaaaaaaaaa

SEQ ID NO: 4859 - DNA, 2358 bp, Cajanus cajan
ctcgcgaagaaacccaaaatcccttggtatctctctacctttcccatatccatatatcccaaaccctacgctcaattctcttcgtcaattcaacaatcgctgcgcagcttcgcagattgcctccgaaacgatgtcgtatcgcccgagcgggaactccaggaccgaggtccgccggaaccgctacaaggtggcggtggacgcggaggaaggccggagacggcgagaagacaccatggtcgagatccgcaagaaccgcagagaagagagcttgcagaagaagaggcgcgaggggctccagcctcagcagatgcctgcctccgttcactctactttggtagagaagaagttggaacacctgccatccatggttgctggtgtttggactgatgataataacctgcaactcgaggccaccactcagtttcggaagctgctttcgattgaacgtagtcctccaattgaggaggttatacagaccggtgtagtttctcgctttgttgagttcctgatgagggaagactttccgcagcttcagtttgaggctgcttgggctttgacaaatatagcttctggaacgtctgagaacaccaaggtggtgattgaccacggggctgtcccgatttttgtgaagctacttgcttctcctagtgacgatgttcgtgaacaggcagtgtgggcattagggaatgtcgctggggattctcccagatgccgtgatcttgttcttagtcatggggctttgcttcctttgttggcacaattaaatgaacatgctaagctttccatgcttagaaatgctacctggacgctttcaaacttctgcaggggcaagccacagcctccttttgatcaggttaaacctgcacttcctgctcttgcccgccttatccattcaaacgacgaagaagtcttgactgatgcgtgttgggccctatcatatctttctgatggtacaaatgataaaattcaagctgtaattgaagctggtgtttgtccccgacttgttgagcttctactgcacccatccccttcagtgctaattcctgctcttcgaactgttggaaatatagtcaccggggatgatatgcaaactcagatcatcatcaaccatcaggctctaccttgccttctgaatctgttgaccaataattataagaaaagcatcaagaaggaagcttgttggaccatatcaaacatcacagctggaaataaactgcagattcaggcagtgattgaggctaacataattgctcctttggtcaacctgcttcaaaatgctgagtttgatatcaagaaggaggctgcttgggctatctcaaatgctacatccggtggttctcatgaacaaatcaagtacctagtaagtcaagggtgtattaagcccttgtgtgatcttctcatctgtcctgatcctaggattgtaacagtttgtctggaaggccttgagaacatcttgaaggtaggagaagctgataaaaatataggtaatactggtgacgtgaatctgtatgcccaaatgattgatgatgctgaggggctggagaaaattgagaacctgcagagtcatgacaacacggagatttatgaaaaagcggtgaagattcttgagacatactggttggaggaggaagatgagactatgcctccaggggatgcttctcagtcagggttcaactttggtaacagtgaggctccttctgtgccttccggtggattcaactttaattagaagatatccatactctactgggatttttggtcggtgtatccgtgaagttctccattatgacgggacagcagttgggggacaagtcaatgtctcgtcattgtccttgggtctcgtacaaggtccagcaagtaaatacatggttgctggatcggcttgggtttttgcaatgcctggtatttcatatctcatgctgtaaaatgctttgtggctatattttttttgcaaccgtagagaatactagaatcctctttctgtcaagtgatcattccatagagttaatgaatgttcagtctcgtgatattttttcctttgttttatgtgtcatagtttggagtataagttacgattgttgtttttttggcaaatgccaaatgctactgcctatctgttagttacaaggaactttggagtctttcttttatcctcttcctttgtaagtttttttgatgttgaagtgtttaccccaaagttcaattattcatcaagttatgtaggcccccctacattatgtagtacttcagcttggaactacgttctcaaaagaaaatatactgcaattattatgtattctctcaaattatatttatacgcggggctattaagcctattctatccgtttcaggctcgtt

SEQ ID NO: 4860 - DNA, 2400 bp, Glycine max
aaaacactcagcaaaagaataaaagaaacccaaaatctctctctctctctcgttcgctttccgtatccatatatatcccaaaccctaccgttaggttccccaattcttcaacaccccgtggaccggtgctctgcttcttagtagttcgtacggtttttccgtcgattgcctccgaaacgatgtcgtatcgcccaagcgggaactccaggaccgaggtccgccggaaccggtacaaggtggcggtggacgcggaggaaggtcggagacggcgagaggacacgatggtggagatccgcaagaaccgcagagaagagagtttgcagaagaagaggcgcgaggggctccaacctcagcagatgcctgcgtccgttcactctagtttggttgagaagaagttggaacatctaccatcgatggttactggtgtttggactgatgataataacctgcagctcgaggcgacgacgcagtttcggaagctgctttcgattgaacgtagtccaccgattgaggaggttatacagactggtgtggtttctcgatttgttgagtttctcatgagggaagactttccgcagttgcagtttgaggcagcttgggctttgacaaatatagcttctggaacgtctgaaaacacaaaggttgtgattgatcacggggctgtcccaattttcgtgaagctacttgcttctcctagtgatgatgtccgcgaacaggcagtgtgggcattaggaaatgtcgctggggattcgcctagatgtcgtgatcttgttctaagtcatggggctttgcttcctttgttggcacaattaaatgaacatgcgaagctttctatgcttagaaatgctacctggacactttcaaacttctgcaggggcaagccacagcctccttttgatcaggttaaacctgcacttcctgctcttgcccgtcttatccattcgaacgatgaagaagttttgactgatgcatgttgggcactgtcatatctttctgatggtacaaatgataaaattcaagctgtaattgaagctggtgtttgtccccgacttgttgagctgctgctgcacccatccccttcagtgctaattcctgctcttcgaactgttggaaatattgtcactggagatgatatgcagacacaggttatcatcaatcaccaggctcttccttgccttctgaatctgttgaccaataattataaaaaaagcatcaagaaggaagcttgttggaccatatcaaacatcacagctggtaataaacagcagattcaggctgtgattgaggctaatctaattgctcctttggtcaatctgcttcaaaatgctgagtttgatatcaagaaagaagctgcttgggctatctcaaatgctacatccggtggttctcatgaacaaatcaagttcctagtaagtcaagggtgtatcaaacccttgtgtgatcttctcatctgtcctgatcctaggattgtgacagtttgtctggaaggccttgaaaacatcttgaaggtgggagaagctgataaaaatataggcaatactggtgatgtgaatctatatgcccaaatgattgatgaagctgaggggctggagaaaattgagaacctccagagtcatgacaacacagagatttatgaaaaggcggtcaagattcttgagacatactggttggaggaggaagatgagactatgcctccaggggatgcttctcagtcagggttcaactttggtagcagtgacgctcctactgtgccatccggtggattcaactttaattagaagatattcatgctctactggggagttttgggtggtctatccgtaaagtcctccattatgacgcgacagcagttgggggataagtcaacgtcttgtcattgtcctaatgtccttgggtcgtacgaagtccagcaagttaatacatggttgctggactggcttgggttttttgcaatgcctggtatttcatatctcatggtgtaaaatgctttgtggctatatttttttgccaccgtagagaatactagagtcttctttctgccaagtgatcatttcatagaattaatgaatgctcagtctcgtgattttttttccctttgttatatattgtcctagactggagtaaaaagttacgattgttggttttttggcaaatgccaaatgctactgcctatccattagttacaaggaacgttttggagtctttcttttatcctattcctttgtaagcttttttggttgaaaaagttccattatccatcacgttatgtaggtcccggtacatgtagtacttcaacttgggagttggggctatgttttcaaaagaaaatatgctgtaattaattgtgtatgctcggtgctattagcctattatttctatccgttcaatgctagttgtata

SEQ ID NO: 4861 - DNA, 2701 bp, Vitis vinifera
aaaccctcttcatagtctccaagcgctctcttgagtattctttttttcctttacagagtttttagggtttaatccaatcgaatcaaagccatgtctctgagacccagcgctagaaccgaggttcgccggaaccggtataaggtcgccgtcgatgccgaggaaggccggagacggagggaagacaacatggttgagatccgtaagagcaaacgcgaggagagcttgcagaagaagcgtcgtgaaggtctccaggctcagcagttccctgccgctgctcacgcttccactgtcgaaaaaaagttagagagtcttccttcgatggttgctggggtttggtcggataatagcagtttgcagctggaggccactactcagttccggaaactgctttctattgaacgtagtccgccaattgaggaagttattcaatctggggtggttcctcgctttgtggaatttcttgttagggaggatttcccacagcttcagtttgaggcagcttgggctctcacaaacattgcttctgggacatcagaaaataccaaggtggtaattgatcatggagcagtgccaatatttgtgaagctacttggttctccaagtgatgatgttcgggagcaggctgtctgggctttgggaaatgttgctggtgactcacccagatgccgtgatcttgtccttggtcatggggccttgattccattgctagcacagttgaatgagcatgccaaactttcaatgctaagaaatgccacatggactctatcaaacttctgcagaggcaagcctcagccaccatttgatcaggtgaagccggcacttccagccctggagcgtcttgttcattccagcgatgaagaagttctgacagatgcatgttgggcactctcatatctctctgatggtacaaatgacaaaattcaagcagtgatcgaggcaggtgtctgccccagacttgttgagctcctccttcatccatctccatcagtgctcattcctgcccttcgcacagttggaaacattgtgacaggagacgatatccagactcagtctataattaatcatggtgcacttccgtgccttctgagcctgttgacccataatcataaaaagagcatcaagaaagaagcttgctggactatttcaaatattacagctggaaacaaggaacagatccaggctgttatcgaggctggtgtaattgcccccttggttcatttgcttcaaactgccgagtttgatataaagaaagaggcagcatgggcaatatcgaatgctacttctggtggcactcatgaacaaatcaagtacctggtgagtcaagggtgcataaagccattgtgtgacctccttgtatgccctgatccaaggattgtgactgtctgtttggaaggactagagaacatactgaaggttggggaagctgagaagactctaggcaacagtggagatgttaattattatgcccaattgatagacgatgctgaagggttagaaaagattgagaatcttcagagtcatgataacaatgagatttatgaaaaggcagtgaagattcttgagacatattggttggaggaggaggatgaaacattgccttcaggtgatggttcccagcctggtttccaatttggaggcaatgatgtttcagttccatcaggtggattcaactttagctgaaggtacacaccatttacttttaagttttacaatttagacctacatgaagaagatcagatgagcctatatgcaggcattagcatgctaattatttcgaggatgtgttgtttttatcatcactctctgtttccttatttctatgaaaaattgcagggttttcagttggttggatgaagctcaaaagttcaggggggggcaacttatatgttgggtcaagtcaagtcaagtcaagtcagggcaccttgctgtgtctggttgcagtccggtcctgtgtccgttgtggttgaagaggagtcaaggtcggtcagtttatactacaatggtcaaataaaaaaggggtggggtggggtggggtgtggggtggggttgggttgggttgggttgggtttcatgacgaagtgaaggccaggtgggcgtcatttggttttttgccttgtaccaaagtatgtaatgggaagtgtctgaaggggatcattgctgcacaaggggggttccttattttgaatggtgtgcaagtatctctcttgaaattgcagcattgtctcttctatttgctctttaagagtcctttagctgtaccattaagttcctagtgagtcggtattcgttttgttgttgctgggtgaatatagtattcaaaaacattttctttattgcttggtttattgcaaggagaaagaaagaaaatagagcttattttctattatagacacccccatctctcattcaatgcaccgtatatcttttgttattttatgttgcaatgttgtcatttcattatcagaagcaccgttaaaggactccctttgtgaaggaagatgattccatctccttggatttactctagggtttggcaggtgacaatgagacaacccatggggatgagattaattttttttgttgttttgtagtcatgtggataccacataccacaatatcctatgtctgattacaaatcaagggttctagttggtacattgattttgtttcctaatttctagctgctctaaatccaagtcca

SEQ ID NO: 4862 - DNA, 1617 bp, Ricinus communis
gtaatttaaaagtaagataagatgtcgttgaggccgagcgctagaaccgaggttcgaaggaacagatacaaagtggcggtggatgcggaggaaggtcgccgtaggcgagaagataacatggtcgagatccgtaaaaatcggcgtgaggagagtttacagaagaagagacgtgaaggacttcaagctcagcctatgccagcttctcttcactcctcggccgtcgagaagaagttggagcatctaccatctatggttgccggtgtttggtctgatgatagtaacctgcagcttgaggcaaccactcaatttagaaaattgctttcaatcgagcgcagccctccaattgaggaagtcatacaagctggtgttgttcctcgctttgttgagtttcttatgagggaggactttccgcagcttcagtttgaagcagcttgggctctgacaaacattgcctctgggacatctgagaatacgagggtggtaattgatcatggagctgtccctatatttgtaaagcttcttgcttctccaagtgatgatgttcgtgaacaggctgtttgggcactgggaaatgttgctggtgattctcctaaatgtcgtgatctggtccttggcaatggagcattgcttcctttactggcacagttgaatgagcatgctaaactttctatgctgaggaatgctacatggacactctcaaacttttgccgaggcaagccacaaccattttttgagcaggttaagcctgcacttccagcccttgcacgtctaattcattctaatgatgaagaagttttgactgatgcatgttgggcgctctcgtatctttctgatggcaccaatgacaaaattcaagctgttattgaagcaggagtgtgccctcggctagttgaacttttactgcacccatctccatcagttctcattcctgcccttcgcactgttgggaatattgtcactggcgatgatatgcagacacagtgtattatcaatcatcaagcactgccctgccttctgaatttgttgacaaataactataaaaagagtatcaagaaggaagcttgttggaccatctctaatataacagctggcaacaaggagcagattcaggctgtaattgaggcaaatattattggtccattggttcatttgcttgaaaatgctgaattcgacattaagaaagaggctgcttgggcgatctcaaatgctacatctggtggtactcatgatcaaatcaaatatcttgttagccaagggtgcatcaagcccttgtgtgaccttctcatctgccctgatccaaggattgtgactgtctgcttagaaggtctggaaaacatattgaaggtaggggaagctgacaagaatttgggcaacaatgatggtggtgtaaatctatacgcgcaaatgattgatgatgctgaggggttggagaaaattgagaatctacagtcacatgacaatatagaaatttatgagaaggctgtgaagattcttgagacatattggttggaagaggaggatgagaccatgcctccaggagatgcttcacaatctgggttccaatttggagggagtgatatgcctactattccctctggtggatttaatttcagctaa

SEQ ID NO: 4863 - DNA, 2635 bp, Ricinus communis
acaagccctaccctccattagtacatcctatatatacatgcacaaaaccccctttctttctctcccttctctctcctttcaacatcaaaacccttaaaaacctctctgaaagaaaagttttgatttctctctctccatttcttttgagatcgttctatcaatcattccaacaatactttttgaatccatttaaaataacaaagtaatttaaaagtaagataagatgtcgttgaggccgagcgctagaaccgaggttcgaaggaacagatacaaagtggcggtggatgcggaggaaggtcgccgtaggcgagaagataacatggtcgagatccgtaaaaatcggcgtgaggagagtttacagaagaagagacgtgaaggacttcaagctcagcctatgccagcttctcttcactcctcggccgtcgagaagaagttggagcatctaccatctatggttgccggtgtttggtctgatgatagtaacctgcagcttgaggcaaccactcaatttagaaaattgctttcaatcgagcgcagccctccaattgaggaagtcatacaagctggtgttgttcctcgctttgttgagtttcttatgagggaggactttccgcagcttcagtttgaagcagcttgggctctgacaaacattgcctctgggacatctgagaatacgagggtggtaattgatcatggagctgtccctatatttgtaaagcttcttgcttctccaagtgatgatgttcgtgaacaggctgtttgggcactgggaaatgttgctggtgattctcctaaatgtcgtgatctggtccttggcaatggagcattgcttcctttactggcacagttgaatgagcatgctaaactttctatgctgaggaatgctacatggacactctcaaacttttgccgaggcaagccacaaccattttttgagcaggttaagcctgcacttccagcccttgcacgtctaattcattctaatgatgaagaagttttgactgatgcatgttgggcgctctcgtatctttctgatggcaccaatgacaaaattcaagctgttattgaagcaggagtgtgccctcggctagttgaacttttactgcacccatctccatcagttctcattcctgcccttcgcactgttgggaatattgtcactggcgatgatatgcagacacagtgtattatcaatcatcaagcactgccctgccttctgaatttgttgacaaataactataaaaagagtatcaagaaggaagcttgttggaccatctctaatataacagctggcaacaaggagcagattcaggctgtaattgaggcaaatattattggtccattggttcatttgcttgaaaatgctgaattcgacattaagaaagaggctgcttgggcgatctcaaatgctacatctggtggtactcatgatcaaatcaaatatcttgttagccaagggtgcatcaagcccttgtgtgaccttctcatctgccctgatccaaggattgtgactgtctgcttagaaggtctggaaaacatattgaaggtaggggaagctgacaagaatttgggcaacaatgatggtggtgtaaatctatacgcgcaaatgattgatgatgctgaggggttggagaaaattgagaatctacagtcacatgacaatatagaaatttatgagaaggctgtgaagattcttgagacatattggttggaagaggaggatgagaccatgcctccaggagatgcttcacaatctgggttccaatttggagggagtgatatgcctactattccctctggtggatttaatttcagctaaatgggtttacaggttcaatatggaggtccttgtgcaacgtggcagacagttttcaacttcaggtcaggtgtcttgttgtcatgtttgggtcttaccaggttcagtctagagttcggttgagaggcagctggcctggtttgggtttttgctatggcgggttgatatggtatggagagacgatggatgggtcacattagctactataatctgagaaacccacgatgatgctggtttgtcagggtggttgttcttggaggttgggatctcataaaagaacagacgtggaatggagtatttttgaatgtggtagtgggtcttagtagcgtctctgcattgccttctccagagttttgtcagattttggcactcccaaaatccttatagtggtgtgcttgtacttattaggtatattgaaattatatttatatatatattatatatatattgaatgtatcgagtcgggtgcaatgattttctgtctacagtcgacattctactagaacatgtaagttgtttttgcacggtatatacagtgtaagggtttctcatgtgaaagggaaaagtagagatgttactatttttgcattcgtctggcttatggcccttccttttttaggtatagaatgctttgaattttcactgcgcgacgggatgtgcgcacggatgcattacccattaactccgatactggttatctgtgcagaatgagcatgggatgggggtggggttcgtattaaagatttttgtaaatgttttatatttggatattaattaatgttcgattgaaacatgaatggccattgtggtaggttaatc

SEQ ID NO: 4864 - DNA, 2333 bp, Populus trichocarpa
tcaactttcaaaaaatcaaacaaaatcctcaattaattgttcgattgattgcttaatccttcaaccaactcgctaatccaaaataatcatcgtattagctaatcctttaatccgaatcgatgtcgttgaggccaagtgcaaggaccgaggtccgccggaacaggtacaaggtggcggtggatgcggaggagggaaggcggaggagggaggataacatggtggagatccgtaagaatcggagagaagagagtcttcaaaagaagagacgtgaaggacttcaggctcaagccatgcctgctagtctccactcttctgctgctgagaagaagttggaacatctgccatcaatggttgcgggtgtttggactgaagatggtaatctgcaattggaggcaaccactcagttcaggaaattactttcaattgagcgcagccctcctattgaggaagttatacaagctggtgttgttcctcgatttgttcagtttcttatgagggaggacttcccacaattacagtttgaagcagcttgggctctcacaaacattgcttctggaacatctgagaacaccaaggtggtgattgatcatggggctgttcctatatttgtacagcttcttgcttctccaagtgacgatgttcgtgagcaggctgtgtgggcattgggaaatgttgctggagattctcctagatgccgtgatcttgtccttggcaatggagctttgcttcctttactggcacaattaaatgagaatgccaaactttctatgctcagaaatgctacatggacactctcaaacttttgtcgaggcaagccacaacctccttttgatcaggttaagcctgcacttccagctcttgcacgccttattcattctgacgatgaagaagtcttaactgatgcatgctgggcactctcatatctctctgatggtacaaatgacaaaattcaagctgttatcgaagcaggagtatgtccacggctagttgagcttctgctgcacccatctccttcagttctgattcctgctcttcgcactgtgggaaatatcgtcactggggatgatatgcagacacagtgtatcatcaatcatcaagcgctgccttgccttttgaacttgttggccaacaattataaaaagagtatcaagaaggaagcttgttggaccatctctaatataacagctggtaacaaggagcagatccaggctgttattgaagctaatattatcggtccacttgttaatctgcttcaaaatgctgagtttgacatcaagaaagaggcagcatgggcaatttcaaatgctacatctggtggtgcccatgaacaaatcaagtaccttgtcagccagggttgtatcaagcccttgtgtgaccttctcatttgcccagatccaaggattgtaacagtctgtttagaaggccttgaaaacatcttaaaggtaggagaagctgacaagaatgtgagtgaaactggaggtgtaaatctctatgctcagatgattgatgatgctgaaggattggagaaaattgagaatctacagtcgcatgacaacactgaaatatatgagaaggcagtgaagattcttgagacatattggttggaagaggaggatgaaacaatgccaccaggagatgcttcccaatctgggttccaatttgggggtgaggctcctgctgttccctctggcggattcaacttcagctaaaggagttttagctgcaggctccattgaagtcctcgaggagtgtggtgagatggtcgtcaggttcaggtcaggtgtcttggtgtcatgtttggtctatctctggtttcgggtagtggttgatagggtgttggactggcttgcgtttcattatggccagtgtaatacgttgcgggaagagaaatgaatgtgattggtggcatgattgaacttgggtttccatgtctagaatattttgggaaacctgagttcattttaaagggagttgttatcccaggagactggggtcttataaaaaggacatggagtctctctctcagttttttttttttaatatttctattgtcctagtcttcatggtagcatctctgcttcccttttcatagtgttaatttttggcactcagaaaatctttatattgccatgcttgtagtttcaaggaatattggaatgatgtttcctttacattgtaagagtcggttgcaaagatacgagtctcctagctgttttctaggatatatacagtgtactggcttgttatttcaaagtgtcaaaaactcttatattgaagggaaatgttgaactgctatcagtattgatttattattttgatttcaccgttcacca

SEQ ID NO: 4865 - DNA, 2378 bp, Glycine max
caaaagaaacccaaaatctcttcggctctctctcttttccatatccatatatatccccaaaccctaccgttaggttccccaattcaacaccccgtggaccggtgcgctgcttctttgttcgtacggtttccgtcgattgcctccgaaacgatgtcgtatcgcccaagcgggaactccaggaccgaggtccgccgcaaccggtacaaggtggcggtggacgcggacgaaggtcggagacgacgagaggacacgatggtggagatccgcaagaaccgcagagaagagagtttgcagaagaagaggcgcgaaggattccaacctcagcagatacctgcgtccgttcactctagtttggtagagaagaagttggaacacctaccatctatggttactggtgtttggactgatgataataacctgcagctcgaggcgacgacgcagttccggaagctgctttcgattgaacgtagtccgccgattgaggaggttatacagactggtgtggtttctcgctttgttgagtttctcatgagggaagactttccacagttgcagtttgaggcagcctgggctttgacaaatatagcttctgggacgtctgaaaacaccaaggttgtcattgatcacggggctgtcccaattttcgtgaagctacttgcttctcctagtgatgatgtccgtgaacaggcagtgtgggcattaggcaatgtcgcgggggattcacctagatgtcgtgatcttgttctcagtcatggggctttgcttcctttgttggcacaattaaatgaacatgccaagctttctatgcttagaaatgctacctggacactttcaaacttctgcaggggcaagccacagcctccttttgatcaggttaaacctgcacttcctgctcttgcccgtcttatccattcaaacgatgaagaagtattgactgatgcatgttgggcactgtcatatctttctgatggcacaaatgataaaattcaagctgtaattgaagctggtgtttgtccccgacttgttgagctgctgctgcacccatccccttcagtgctaattcctgctcttcgaactgttggaaatattgtcactggagatgatatgcagactcaggttatcatcaatcaccaggctcttccttgccttcttaatctgttgaccaataattataaaaaaagcatcaagaaggaagcttgttggaccatatccaatatcacagctggtaataagcagcagattcaggctgtgattgaggctaatctaattgctcctttggtcaatctgcttcaaaatgctgagtttgatatcaagaaagaagctgcttgggctatctcaaatgctacatccggtggttctcatgaacaaatcaagttcctagtaagccaagggtgtattaagcccttgtgtgatcttctcatctgtcctgatcctagaattgttacagtttgtctggaaggccttgaaaacatcttgaaggtgggagaagctgataaaaacataggaaatactggtgatgtgaatctatatgcccaaatgattgatgaagctgagggattggagaaaattgagaacctccagagtcatgacaacacagagatttacgaaaaggcggtcaagattcttgagacatactggttggaggaggaagatgagactatgcctccaggggatgcttctcagtcagggttcaactttggtagcagtgacgctcctgctgtgccgtccggtggattcaactttaattagaagatattcatgctctactggggagttttggttggtctatctgtgaagtcctcctttatgacacgacagcagttgggggacaagtcaacgtcttgtcattgtcctaatgtccttgggttgtacgaggtccagcaagtaaatacatggttgctggactgccttgggtttttgcaatgcctgatatttcatatctcatggtgtaaaatgctttgtggctatatttttttgccaccgtagagaatactagagtcttctttctgccaagtgatcatttcatagaattaatgaatgctcagtctcgtgatttttttttcctttgttatatatgtcctagattggagtaaaaagttacgattgttggtttttttggcaaatgccaaatgctactgcctatccattagttacaaggaacgttttggagtctttcttttatcctcttcctttgtaagcttttttagttgacgtttaccccaaagttccatttttcatcacgttatgtaggccccggtacatttacattatttatttagtacttcaacttgggactatgttttcaaaagaaaacatgctgcaattattgtgtagtctcaaaagatatatttattctcggggctattatccgttccatg

SEQ ID NO: 4866 - DNA, 2216 bp, Amorphophallus konjac
gcttcctcccacccttctatccccttcccgtctgatctcttcctcatcatacaagggctcttcgtcggcgttccgtttgccttcttcctttcggcggcgttagggtttccggagcaggcgaagatgtcgctgaggccgagcgcgaggacggaggtgcgccgcaaccggtacaaggtggcggtggacgccgaggagggccggcggaggagggaggacaacatggtggagatccgcaagagcaagagggaggagagcctccagaagaagaggagggagggaatgcagcagaaccagccgctggcgcccgctgtccacgcctccgcgatggagaagaagttagagagccttccggcgatggtggctggagtgtattcggatgataggaatttgcagcttgaagcgacgacacaattccggaagctgctctcgatagaacgaagtcctcccattgaggaggtgatccagtctggcgttgttcctcgttttgtcgagtttctcacaaaggaagattttccccagctccagtttgaagcagcttgggctctcacaaacattgcttctggtacctcggagaacaccaaggttgtaatagatcatggtgcagtacctatctttgttaagctacttaattcgcccaatgatgatgttcgtgagcaggctgtttgggcattgggcaacgtggccggtgattcccccagatgccgagatcttgttttggcacatggagcattgctaccgctgcttaatcaactaaatgagcatgccaaactttctatgcttagaaatgcaacatggacattatccaacttctgcagagggaagcctcaaccttcttttgagcagacaaaacctgctcttcctgcacttgaacgtctcattcatacgaccgacgaggaagtccttactgatgcctgctgggcactttcgtatctttctgatggaacaaatgacaaaattcaagctgttattgaagctggtgtttgccctcggcttgtggaacttcttcttcatccttcaccttcagtgttgattcctgcacttcgaactgtggggaacattgttactggtgatgatttgcagacacagtacatcatcaactaccaagcacttccttgcctccttaatctgttgacacacaatcacaagaaaagcatcaaaaaggaagcttgctggacaatttcaaacatcaccgcaggaaataaggagcaaatacaggctgttattaatgtcgatatcattggccctcttgttcatttgcttcaaacggcggagtttgacatcaagaaggaggctgcttgggcaatctcaaatgctacttctggtggaacccatgaacagataaagtatttggtgaaccaaggttgcattaagccactctgtgatcttctggtttgcccggatccaagaattgttacagtctgcctggaaggcctcgagaatatccttaaggtcggggaagttgagaagaacatgggtacaacaggtggggttaatctctatgcacgaatgattgaagatgctgagggtctagagaagattgagaatctgcaaagccatgataacaccgagatttatgaaaaggctgtaaagattctcgagacatattggctggaggatgaagatgatgcaatgccgacaaatgatgccacccaaactggattcaattttggtaacagcgatgttcctgttccttctggtggctttaactttgggtgaagtttctggtctgagttcgaagttacagtgcgcagccgggggcaggaaagctcttctcattctctgggttgtgtcggtccagtttctgttgcgtttgaagcggtggcacatagaagtatacaacatcggttgttttgatatcttagagttgtgtacgccctgtctgccacttgattttagccgtaagatgtcgagtcttcatcgtagatttttagtcgcgagtgttggatggttgccgcgcttttgtagtggctcattcacccggtcgacgatatttgttactccaaatttttattcttgcctctgtatattatcagcagaaaagctgtttcattatagaggtcggattgtagttcgttgtcgttacatcttttctcgtctacccgtagggtcttgttatatgaaacatcttcatacggtatataggtggtagtctgttatttcagaaacattgtcatgcttgacctgtttacaaaagaaatggaaggattttgtgtttt

SEQ ID NO: 4867 - DNA, 2389 bp, Cirsium arvense
tcccctttcaaaacttctcccactctctatatagacctgcaattcatccttcactaacctcttctgtaaaccttcactccctccattttcttagggtttttttttcttcttcttcttagcaaccatgtcgttgaggcctaacgccaggacggaggttcgccggaatcggtacaaggtggccgtcgatgccgaggagggacgccggaggagggaagacaacatggttgagatccgtaagaacaagcgagaagagagtttgcagaagaagagacgagaagtcctcactggtagtcagttttctgttcctgttcaatctgcttctgctgccgaaaagaagttagaaaatctacctgcaatggttgctggagtttggtccgatgataacaatatgcagcttgaggctactactcagtttcgtaagctgttgtcaatagaacgcagccctcccattgaggaagttatccaatctggtgttgttcctcgttttgttgagtttcttgttagggaggatttcccccaactacagtttgaggcagcctgggcgttaactaacattgcttcggggacatctgaacacacaaaagtggtgattgatcatggtgctgtcccgatatttgtaaaacttcttgcatctccaagtgatgatgttcgagagcaggctgtatgggcgctagggaatgttgctggtgattcccctaagtgtcgtgatcttgtactcggacaaggtgctttgattcctttgctggctcagttaaacgagcatgctaaactgtctatgttgcgcaatgctacgtggacgctttccaatttttgtagaggcaaaccgcaaccctcttttgatcagaccaggcctgcactcccagctcttcagcaacttattcattcaaatgatgaagaagttttgaccgatgcttgttgggcactctcatatctttcagatggtaccaatgataaaatccaagcagtaatagaagcaaatgtatgtccaagattggttgagttactcaatcatccttctccttcagtactcatccctgcccttcgtacggttgggaacattgttactggtgatgatatgcaaactcagtatatcattaatcatcaagcattgccttgtcttctgaatctgctgagcaataatcacaaaaagagcatcaagaaagaagcttgttggactatatcaaacatcactgctggcaacaaggaacagattcaaactgttattgaagcaaatatcattggccctctagttcatttgcttcagaatgcagaatttgatatcaagaaggaggctgcatgggctatctcaaatgctacttctggtggaagccatgaccaaattaagtatctagttagtcagggatgtatcaaaccgttgtgcgacctacttgtctgtccagaccctagaattgtgactgtttgtctagaggggcttgagaacatactaaaggttggtgaagctgagaagaatttagggcgatcaggagatgtaaatctttatgcacaaatgattgatgatgctgaagggttggagaagattgaaaacctacagagtcatgataacaatgagatatacgagaaagcagtgaaacttctcgagacatattggttggaggaagaggatgatgcaatgccacctggtgaaaccactcagcctggtttccattttgaaggtggtgatgtttctattcccaatggtggatttaacttcaactgattgaaggactttctgcttgaagttaagtgtcatttacggtggagtaatgttggctacgcatcagtcttctgtctgttttcacttgggtcccgcttgctccgatattgtagtgtgcttgaagtttttggcctggttcaggttttcaccaaacaatagcagtgaaatgttaatggattgattatgtaaaagtaatatgtttgtttcattttggggaggctttttgacgattcaaattgggatttatagaatttcccctcttttgcgtctacccttgtatttcttctttggtatttcttttgttcagcagttgggaatttctaattccttacttgtgctttaatatgcctctgcttattggtgtatgttccatgaaaaccggttctctattacactagtcggtgaatgacaatatgttgggattcttgatattgaggtgaatttttgtgcatctttcttttcttgttaaatgcagtcttcgacttgtgttaaccaaatgatgtgattgatcttgttgccaattagtgatcggcatgtgattatggttatacacaatcgtaaattagttttggcaacttgaggtgtaaagtgttgggttgggtgttctaagtttacttgccgtttaatgttttgcaatcactttctcttgtgcaggaatagggccaatcacttatg

SEQ ID NO: 4868 - DNA, 1673 bp, Cannabis sativa
tttgtatctctctctagggtttcgaattccactacttcatcatgtcgttgaggccgagcgcgaggactgaggtccgccggaaccgatataaggtagccgtcgacgccgaggagggtcgaaggcgccgtgaggataatatggtggagatcaggaagaatcgcagagaagagagccttcagaagaagcgtcgtgagggacttccccctcagcaattgcagacttccattccaacctcagctgttgagaaaaagctagaacatctaccttcgatggtagcgggtgtttggtcagactcggatgatgggaatttgcagcttgagtctactactcagtttaggaagcttctttctattgagcgaagtcctccaatcgaggaagttatacaatctggtgttgttcctcgttttgttgaatttctaatgagggaagactttccacagctgcagtttgaagcagcttgggctctcacaaatattgcttcagggacctctgagaacacaaaggttgtaattgatcatggagctgtccctatatttgtcaaacttcttggttctccaagtgatgacgttcgtgagcaggctgtttgggccttgggtaatgttgcaggtgattcccccagatgtcgtgatctagtacttggtaatggggccttgctgccattgctggcacaattaaatgagcatgctaagctctctatgcttagaaatgctacgtggaccctttcaaacttctgtaggggcaagccacaacctccttttgatcaggttaagcctgcacttccagctcttgctcgccttatccattcaaatgatgaggaagttttgacagatgcttgttgggcactttcttacctttcagatggaacaaatgataaaattcaagcagttattgaagccggggtgtgcccccgacttgttgaacttttgcttcacccatcaccatctgtgctcattcctgctcttcgcactgttgggaatattgtcactggagatgatttgcaaactcaggtcatcataagtcatcaagctcttccctgtttgctgactttattgacaaacaattataagaagagtatcaagaaagaggcctgctggactatctcaaacatcacagctggaaacaaggagcagattcagtgtgtagttgaggctggtataattgccccccttgttaatcttcttcaaaatgctgagtttgatattaaaaaagaggctgcctgggctatctcaaatgctacatccggtggttctcatgaccaaataaagttcttagtaaatcaagggtgtatcaaaccattgtgtgatcttctaatctgccctgatcctaggattgtcacagtatgtttggaagggcttgaaaacattttgaaggttggagaagccgaaaagaatttgggtaacactggaggtgttaatctttatgctcagctaattgatgatgctgaagggttggagaaaattgagaatctacaaagtcacgacaatacagagatatatgaaaaggctgtaaagatccttgaaacgtattggctcgaggaagaggatgacacaatgccacctggtgactcggctcaatccggattcaactttggagggagtgaggttcctgccgttccttctggtggattcaacttcagctgaaggtagttagtgtatacagtacacataatctcc

SEQ ID NO: 4869 - DNA, 2127 bp, Euphorbia peplus
aaagatgtcgttgaggccaagcgctaggaccgaggttcgtcggaacaggtataaggttgctgtcgatgctgaggaaggtcgccgcaggcgagaagataatatggttgagatccgaaagaatcgtcgcgaggagagtctacagaagaaacgcagagagggacttcagtctcagcctatgccggcgtctcttcattcatctgctgttgagaagaggctggagcatctcccatcaatggtcgctggtgtgtggtctgatgatggtaatttgcagcttgaggcaacgactcaatttaggaagttgctatcaattgagcgtagccctccaattgaagaggtcatacaggctggtgttgttcctcgttttgttgagttccttatgagggaggactttcctcagctccagtttgaagcagcttgggctctcacaaacattgcttctggaacatcagaaaatactagagtggtaattgatcatggagctgtccctatttttgtaaagcttcttgcttctcctagcgatgatgttcgtgaacaggctgtgtgggcattgggaaatgttgctggtgattctccaaaatgtcgtgatctagtccttgggaatggagctctgcttcctttactttcacaattgaatgagcatgctaaactctcaatgctaaggaatgctacatggacactatcgaacttttgccggggcaagccacagccaccttttgagcaggttaagcctgctcttccagcacttgctcgtctaattcattctaatgatgaagaagtgttgactgatgcatgttgggctttgtcgtatctctctgatggtaccaatgacaaaattcaagctgttattgaagcaggtgtatgccctcggctagttgaacttctactacaccagtctccttcagttctcatccctgcacttcgcactgttgggaatattgttactggcgatgatacgcagacccagtgtatcatcaatcatcaagcgctgccttgcttactgaatttactgacaaataactacaaaaagagcatcaagaaggaagcttgttggacaatctctaatattactgctggcaacaaggaacagatccagtgtgtaatagagtccaatattattggtccactggttcatttgcttcaaaatgcggagttcgacattaagaaagaagctgcttgggctatatcaaatgctacttctggtggtgcacatgaacaaatcaagtaccttgttagccaaggatgcatcaagcccttatgtgacctgttaatttgccctgatccaaggatcgtaactgtctgtttagagggtcttgagaacatcttgaaggtaggagaatctgacaagaacttgggcgctaacggaggtgttaatatatatgcacaaatgattgatgatgctgaggggttggaaaaaattgagaatctacagtctcacgacaatacagagatttatgagaaggctgtgaagattctcgaggcatattggttggaagaggatgagacaatgcctccaggagatgcttcccagtctggtttccaatttgggggcaatgagatgccagctgttccatctggtggatttaatttcagctaaatggtttctcttgccggttctgtttggaggcctatggcgggactgttgtcatctttgaggtcaggtgtcttgttgtcatgtttgggtctagcagtccagtcagtctaaggtctggtcgggagggtactggcctggtccgggtcgtcatttggtcgagaattaatacggtgtggagagttaagtgggtggatttactactaaaatcttagaaacccattatcatcgctcgtctgtcgtcaggaattggtagttcgtggaggtcgagatctctcacagaacacatgcataaaaaagagtcggaatttgattgaatattttatctgctgtccaagtctatgtctctacagtatgccttttccacagtctgtcgattttggcactaccaaaatcccatctatggtggtttgcttgtacttactaggaaatatggaatactatatattttatttatttattcaaagagtatggtgttttcactttttttttgttgtgtttctacaaattgagatgttactagaaattctggaaattct

SEQ ID NO: 4870 - DNA, 1974 bp, Arnica chamissonis
caaaccttcacttcctatatagacctccttcatctgcgattgaccgatactggtgtgtattgtataaaccgtcactcgctgtagaccccaatttctagggttttcatcttatagtagcagcaaacatgtctttgaggcctagcgagagaacggaggttcgccggaaccgatacaaggtggcggtcgacgccgatgaggggcggcggaggagagaagacaacatggttgagatccgtaagaatcggagagaagagagtttgcagaagaagagacgtgaaggactcgctgctagccagttccctctgcccgttcaatctgcttccgccgccgaaaagaagttagaaaacctacctgcaatggttgcaggggtttggtcagatgataataatatgcagcttgaggctactacccagtttcgtaaactgttatcaatagaacgcagccctcccattgaagaagttattcaagctggtgctgttcctcgctttgttgagtttcttgtgagggaggattttccccaattacagtttgaggcagcttgggctttgactaatatcgcttcggggacatctgaacacacaaaagtggtgattgatcacggtgctgttcctgtatttgtgaaacttcttgcatctcctagtgatgatgttcgggagcaggctgtatgggctctaggtaatgtagccggtgattcccctaaatgtcgtgaccttgtacttggacaaggtgctttgattcctttgctggctcaattaaatgagcatgctaagctgtctatgttgcgaaatgccacatggacactttccaatttctgtaggggcaagccacaaccttcttttgagcagacaagacctgcgcttccagctcttcaacaacttatacattcaaacgacgaagaagttttgactgatgcttgttgggccctttcatatctttcagatggtacaaatgataaaatccaagctgtaatagaagcaaatgtatgtcccagattggtcgagttactaaatcacccatcgccttcagtgcttatccctgctcttcgtacagttggcaacattgttactggcgatgacatgcaaactcagtacattatcaatcatcaagctttgccctgtcttctgaatctgttgtccaataatcacaaaaagagcattaagaaggaagcttgttggactatatcaaacataacagctggcaacaaagaccagattcagacggtgatcgactcaaatattattgggccgcttgttcaattacttcagaatgcagaatttgacatcaagaaagaggctgcatgggccatctcaaatgctacttctggtggaagccatgaccaaattaagtatcttgttagtcaaggatgcatcaaacccttatgcgacctacttgtgtgtccagatcctagaattgtgactgtttgtctagaggggcttgagaacatactgaaagtgggtgaagcggagaagaatttgggaacatccggagaagtgaatgtttatgcacaaatgattgatgatgctgaaggattggagaaaatcgagaacctacaaagtcatgataacactgagatctatgagaaagcggttaagcttcttgaaacgtattggttggaggaagaggaggatgatgtgatgccacctggcgaaaccgctcagcctggtttccattttggtggtggtgatgtttccgttcccaatggtggcttcaattttaactgattcgaggttggtcttgttgaagtcggttggtttacgtggaggaagtagtgttgcgggcatctatctattttcatgaggttcgtttatgtagtagtgtggttgaagttttatggagtgattttgagggtttttacaatgaatattatcactaaaatggtgatgaaccgtgtaaaagtaatatgttatttctcttttgggagttggcatttgacaaattacattgggatttatagaattcccttcttttgctgtc

SEQ ID NO: 4871 - DNA, 1811 bp, Cirsium arvense
attgggaacttctcttcggcccgcccgtccctccctctcgctctatatagacctctgcaattgatccttactgacctacagtgtaaaccttcattctcttctttaccctatttctagggtttttttttttcttgctacgtatagcaaccatgtcgttgaggcctagcgcgaggacggaggttcgccggaatcggtacaaggtagcggtcgatgccgaagagggacggcggaggagagaagacaacatggttgagatccgtaagaacaagagagaggagagtttgcagaagaagagacgcgaagcactcactggtagtcagttttctgtgcctgttcaatctgcttccgctgccgaaaagaagttagaaaatctacctgcaatggttgctggagtttggtctgatgataacaatatgcaacttgaggctactactcagtttcgtaagctgttatcaatagaacgcagccctcccattgaggaagttattcaatctggtgttgttcctcgttttgttgagtttcttgttagggaggatttcccccaactacagtttgaggcagcctgggcgttaactaacattgcttcggggacatctgaacacacaaaagtggtgattgatcacggtgctgtcccgatatttgtaaaacttcttgcatctccaagtgatgatgttcgagagcaggctgtatgggcgctagggaacgttgctggtgattccccaaaatgtcgtgaccttgtactcggacaaggtgctttgattcctttgctggctcagttaaacgagcatgctaaactgtctatgttgcgcaatgctacgtggacgctttccaatttttgtagaggcaagccacaaccctcttttgatcagactaggcctgcacttccagctcttcagcaacttattcattcaaatgatgaagaagttctgacggatgcttgttgggcactctcatatctttcagatggtaccaatgataaaatccaagctgtgatagaagcaaacgtatgcccaagactggttgagttactcaatcatccttctccttcagtactcatccctgctcttcgcactgttggaaacattgttaccggcgatgatatgcaaactcagtatatcattaatcatcaagcactgccctgtcttctgaatctgttgagcaataatcacaaaaagagcatcaagaaagaagcttgttggactatatcaaacattactgctggcaacaaggaacagattcaaacagtaatcgaagcaaatatcatcggccctctagttcatttgcttcagaatgcagagtttgacatcaagaaagaggctgcatgggctatttcaaacgctacttctggtggaagccatgaccaaattaaatatttagttagtcagggatgtatcaaaccgctgtgtgacctactcatctgtccagaccctcgaattgtgacggtctgtttagaggggctcgagaacatactaaaggttggtgaagctgagaagaatttgggacggtcgggagatgtgaatcttttcgcacaaatgattgatgatgctgaaggattggagaaaatcgagaacctacagagtcacgataacaatgagatttatgagaaagcggtgaagcttctcgagacatattggttggaggaagaggatgacgcaatgccacctggcagtgatgcagcccagcctggtttccagtttggcggtgctgatgtttccgttccctctggtggattcaacttcaactgaaggtaattggatgttgatgttaggggagattaatggtgtgaagacatgtctatgttattctgctgc

SEQ ID NO: 4872 - DNA, 2366 bp, Vitis vinifera
tctctcttcaaatcaaacccctctctagggtttttcattttcactgtccagcaattctccgacaccatcgacgatgtctctccggccgagcgcgaggaccgaggttcgacggaaccgatacaaggtctctgtagatgcggaagaaggtcggaggcggagagaagacaacatggttgagatccgaaagaatcggagagaagagagcttgcagaagaagagacgcgaaggccttcaggcccagacgttacctgcgtcaatccattctgctgctgttgaaaagaagttggaatttttaccatccatggttgctggtgtctggactgatgacagtaacatacaacttgaggcaactacacaatttcgaaagttgctttcaatagagcgttgtcccccaattgaggaagttattcaatctggcgttgttcctcgctttgttgagtttcttgtgagggaggacttcccacagcttcaatttgaagcagcatgggctctcacaaacattgcttctgggacatctgacaacactaaggtggtaattgatcatggggctgtcccggtgtttgtgaaacttcttggttctccaagtgatgatgttcgtgaacaggctgtgtgggccctaggaaatgttgccggtgattcccccagatgccgtgatcttgtccttggccatggggctctgcttcctttgctggcacagttgaacgaacatgcaaagctgtctatgctcaggaatgctacctggacactttcaaatttctgtaggggcaagccacagcctccttttgatcagacaaagcctgctcttccagcacttgagcgtcttattcactcaaatgatgaagaggtgttaactgatgcatgttgggcactgtcttatctttctgatggtacaaatgacaaaattcaagctgttattgaagcgggtgtatgtcctaggcttgttgaacttttacttcacccatctccttctgttctcattcctgcacttcgcacggttggaaacattgtcactggagatgatatgcaaacccagtgcataatcaaccatcaggctctcccttgccttctgaacctgttgaccaataaccataagaagagcatcaagaaggaagcttgttggactatttcaaatatcacagctggcaacaaggagcagattcaggctgtaattgaggcaaacataattggtccccttgttcatctgcttcaaaatgctgagtttgatatcaagaaagaggctgcttgggcaatctcaaatgctacatctggtggttcacatgaacaaatcaagtacctagttagtcaagcatccatcaagcccttgtgtgatcttctggtctgccctgatccacggattgtcacagtttgtttagaagggcttgagaacatcttgaaggttggagaagctgagaagaatttgggcagtactagagaggtaaatctctatgctcagatgattgacgatgctgaagggttggaaaaaattgagaatttacaaagtcatgacaacactgagatctatgagaaggcagtgaagattcttgagacatattggttagaagaggaggatgagaccatgcctccaggtgattcttcccaaccagggttccgctttggtgaggttcctgttcccactggtggcttcaacttcagctaaaggatttctagttggtggttcattgtagacctagctgagtatgaaagggtaaatagttggggtcagttgaggcatcttgtccttgtccttgaggtcatggcttgtccagtctccggtgtggttgaagtctctggtgatccagtagccagaatatttgggaagagagggagatggacccccatttacagaaacttggttttgttgcttctgcatagcaatgtggtcgagaaccaggatgctctttttggcaagtggttgtccctggcaaaggtgttctcttaaagttaatgtccaagtttaatctacttctattttcttagctgttatacaagtcactacagcgtccttatactgtttgtgggtgggtgtttttttggcgcttctaccaaaaccgtcgttatcttgcccagcttgtagttttaagagatatggggattttcttttttcctttctattgtaagtgcttgctgtgatgattttgattttaattctttccgcctcttttttgtctcaaaaagtcttctcaggtggttttttttcttttgcaaaaaggaaatcatttagaaatgtgtcatgcataactgtcaaaagaacttctatactaaagaaagaaagattcaagtatcatctataaacagttttgttgtattttgttgtgattatatgcttatatttatgttattctatactattctcttgttcttctctt

SEQ ID NO: 4873 - DNA, 2356 bp, Cajanus cajan
ggggtgacattgagaaagcatcccatcggttggatcgtaacccgcatcgaacgccaaggtttagatccaataaaaggccattcaaatcccatttccagcctagggtttttcttttctgattcattctttcactcccaaccatgtcgctcaggccaaatgccagaaccgaggttcgccgcaaccgttacaaggtcgccgtcgacgccgacgagggccgccgtaggcgagaggacaatatggtcgagatccgcaagagcaagcgcgaagagagtttgcttaagaagcgtcgcgaaggcctccaacagttccccgctcctcttcagaattccaccgtcgacaagaagttagagagtcttcctgccatggttactggagtttggtcggatgataatagtctgcaactcgaggccacaacgcaatttcgaaagctgctttccattgagcggagtcctccgattgaggaagttattcaagcaggcgttgttccacgttttgttgagtttcttgttagggaggatttccctcaacttcagtttgaggcagcatgggctctcacaaatattgcatctgggacttctgagaacactaaggtggtcattgatcatggggcagttcctatatttgtcaagttacttagttctcctagtgatgatgttcgggagcaggcagtgtgggctttgggaaatgttgctggcgattctcctaggtgtagagatctagtgctcagcaatggtgctctcatcccactattagcccagttgaatgagcatgcaaaactctcaatgctgagaaatgccacgtggacattatctaacttctgtaggggtaagccacaacctccatttgagcaggtgagaccagcacttccggctcttgagcgtttggttttttccaacgatgaagaagttttgacagatgcttgttgggcactatcatatctctctgatggtacaaatgacaaaatccaagcagttattgaggcaggcgtatgcggcagattggtgcagctcctcatgcacccatctccctcagtgctgattccggctcttcgtacagtgggaaatattgtgactggagatgacatgcagactcagagtattatcaaccatggtgcactcccttgccttttgaacctgttgacgcataatcacaaaaaaagcatcaagaaagaagcttgctggactatatcaaacattactgctggaaataaggaacaaatacaggctgttattgaagcagctctgattgccccccttgtcaatcttcttcaaaatgccgagtttgacattaaaaaagaagctgcttgggcaatctcaaatgctacatcgggtggaacacatgatcagatcaagtacttggtgagccagggttgcataaagcctctctgtgatctgcttgtttgcccggacccaaggattgtcactgtctgtttagaaggtctagagaatattctcaaggttggagaagctgagaagagcctaggtaatactggagatgccaacttgtatgcacagatgatagatgatgccgagggattggagaagattgaaaacctgcagagtcatgacaacaacgaaatatacgaaaaggctgttaaaattcttgaaacatactggttggaagatgaggatgagacattaccttcaggagatggtgctcaagctggtttcaattttggaagcaatgagcttccagtcccatctggtggattcaactttagttgaagaccttttcctgagaagggagttgttggatgaagtaggagtttatgccggatggctgttgggatagtctggagggtcaatcattgcaccttgtgtctgcttatagtctggtctggtatggtctggtgtagtgtcgtccttcgtggttaatgagttgctggggttagtttacgctaccaagtccaagtaataaaggactggtggattcaacagcagcataatgacctttttttcagctgttttgttgtataaaatatatatataatatatattgctggtgagtggtgagaaatatctggaaggtcgtatgttgcagtgacacagacacgggctatatggcgaggggtttttctacaatgcggctttcagtgctgtttttatcgagtcctagttgtactgacaatttatttggtcagtctttatttgatttgggtaaatatattattccgaaacaatttttaagatctatttcaaattccaattgaagaattagtgctattttttcgcgtggttgtgaatattttgcaacatgattatttcactcgcaagacatgagctgaagagccccttgcattcaactgctgcacgtgatttaaatttcgaaattaaatttgattggtatttattctgcc

SEQ ID NO: 4874 - DNA, 2131 bp, Centaurea maculosa
  misc_feature (214)..(214): n is a, c, g, or t
  misc_feature (220)..(220): n is a, c, g, or t
  misc_feature (259)..(259): n is a, c, g, or t
  misc_feature (343)..(343): n is a, c, g, or t
  misc_feature (361)..(361): n is a, c, g, or t
  misc_feature (445)..(445): n is a, c, g, or t
  misc_feature (466)..(466): n is a, c, g, or t
  misc_feature (523)..(523): n is a, c, g, or t
  misc_feature (571)..(571): n is a, c, g, or t
  misc_feature (589)..(589): n is a, c, g, or t
  misc_feature (844)..(844): n is a, c, g, or t
  misc_feature (952)..(952): n is a, c, g, or t
  misc_feature (1042)..(1042): n is a, c, g, or t
  misc_feature (1045)..(1045): n is a, c, g, or t
  misc_feature (1048)..(1048): n is a, c, g, or t
  misc_feature (1057)..(1057): n is a, c, g, or t
  misc_feature (1063)..(1063): n is a, c, g, or t
  misc_feature (1084)..(1084): n is a, c, g, or t
  misc_feature (1127)..(1127): n is a, c, g, or t
  misc_feature (1132)..(1132): n is a, c, g, or t
  misc_feature (1135)..(1135): n is a, c, g, or t
ttctcttcggcccgcccgtctctctctctctcttcccgctctatatagagacctgcaattgatcatgtgctcacgtattctgtaaaccttcactcgctttagaccacatttctagggtttttttttttccttcttagcaaccatgtcggtgaggcctaacgcgaggacggaggttcgccggaatcggtacaaggtggcggtggatgccgagganggacgncggaggagagaagacaacatggttgagatccgtaagaanaagcgagaagagagtttgcagaagaagagacgagaagtgctcactggtagtcagttttctgtgcctgttcaatctgcttctgcngccgaaaagaagttaganaatctacctgcaatggttgctggagtttggtccgatgataacaatatgcagcttgaggctactactcagtttcgtaagctgttntcaatagaacgcagccctccnattgaggaagttatccaatctggtgttgttcctcgttttgttgagtttcttgttagngaggatttcccccaactacagtttgaggcagcctgggctttgactaanattgcttcggggacatcngaacacacaaaagtggtgattgatcatggtgctgtgccgatatttgtaaaacttcttgcatctccaagtgatgatgttcgagagcaggctgtatgggcgctagggaatgttgctggtgattcccctaaatgtcgtgatcttgtactcggacaaggtgctttgattcctttgctggctcagttaaacgagcatgctaaactgtctatgttgcgcaatgctacgtggacgctttccaatttttgtagaggcaagccncaaccctcttttgatcagaccaggcctgcacttccggctcttcagcaacttattcattcaaacgatgaagaagttctgactgatgcttgttgggcactctcatatctntcagatggtaccaatgataaaatccaagcagtaatagaagcaaacgtatgcccaagattggttgagttactcaatcatccttctccttcngtnctnatccctgcncttcgnacggttgggaacattgttacnggtgatgatatgcaaactcagtatatcattaatcatcaagcantgccntgncttctgaatctgctgagcaataatcacaaaaagagcatcaagaaagaagcttgttggactatatcaaacatcactgctggcaacaaggaacagattcaaactgttattgaagcaaatatcattggccctctagttcatttgcttcagaatgcagaatttgatatcaagaaggaggctgcatgggctatctcaaatgctacttctggtggaagccatgaccaaattaagtatctagttagtcagggatgtatcaaaccgttgtgcgacctacttgtctgtccagaccctagaattgtgactgtttgtctagaggggctcgagaacatactaaaggttggtgaagctgagaagaatttagggcgatcaggagatgtaaatctttatgcacaaatgattgatgatgctgaaggcttggagaagattgaaaaccttcagagtcatgataacaatgagatatacgagaaagcagtgaaacttctcgagacatattggttggaggaagaggatgatgcaatgccacctggtgaaaccactcagcctggtttccattttgaaggtggtgatgtttctattcccagtggtggatttaacttcaactgattgaaggactttctgcttgaagttaagtgtcatttacggtggagtactgttggctacgcatcagtcttctgtctgttttcacttgggtcccgcttgctccgatattgtagtgtgcttgaagtttttggcctggttcaggttttcaccaaacaatagcagtgaaatgttaatggattgattatgtaaaagtaatatgtttgtttcattttggggaggctttttgacgattcaaattgggatttatagaagttcccctctattgcgtctacccttgtatatcttctttgcgatttctttatgtcagcagtatgggatttctaattccgtacatgtgctataacatgcctctgcttattcgtgtatgtaccatgaaaaccagttctctattacactagt

SEQ ID NO: 4875 - DNA, 2148 bp, Populus trichocarpa
ctctctaactttcaaaaatcaaacaaaaacctcaaatccccatttctctctctctctctccccttctctctctctaaaaccctcagttgattgtttgatttatcgcgcaatcactcaatcaagtcgccaatcaaaataataatttaattagttattcaattaatctaaaacgatgtcgttgaggccgagcgctaggactgaggtccgccgtaacaggtacaaggtggcggtggatgcggatgagggacggcggaggagagaggataacatggtggagatccgtaagaatcggagagaagagagtcttcaaaagaagagacgtgaaggacttcaggcacaagccatccctgctgctcttcactcttccgctgctgagaaaaagttggaacatctgccatcaatggttgcgggtgtttggtctgaagatggtaatctgcaactggaggcgaccactcagttcaggaaattactttcaattgagcgcagcccgcctatagaggaagttatacaagctggtgtcgttcctcgatttgttcaatttcttatgagggaggatttcccacaactgcagttcgaagctgcttgggctctcacaaacattgcttctgggacatcagagaacaccaaggtggtgattgatcatggagccgtccctatatttgtacaacttcttggttctccaagtgatgatgttcgtgagcaggctgtttgggcattgggaaatgttgctggagattctcctagatgccgtgatcttgtccttggccatggagctttgcttcctttgctggcacaattaaacgagaatgccaagctttccatgctcagaaatgctacatggacgctctcaaacttttgtcgaggcaagccacaacctccttttgatcaggttaagcctgcacttccagctcttgctcgccttattcactctaacgatgaggaagtcttaactgatgcatgttgggcactctcatatctctctgatggtacgaatgacaaaattcaagctgtcattgaagcaggagtatgtccacggctaattgagcttttgctgcatccatctccttcggtcctgattcctgctcttcgcactgttggaaatattgtcactggggatgatatgcagacacagtgtattatcaatcatcaatcactgccttgccttttgaacttgttgaccaacaattataagaagagcatcaagaaggaagcttgttggaccatctctaatataacagctggaaacaaagagcagatccaggctgtaattgaggctaatcttatcggtccacttgtacatctgcttcaaaatgctgagtttgacatcaagaaagagtctgcatgggcaatttcaaacgctacatctggtggtactcatgaacaaatcaagtaccttgttagccagggttgtatcaagcccttatgtgaccttctcatttgccctgatccaaggattgtaacagtctgtttagaaggccttgaaaacatcttaaaggtaggagaagccgacaagaatgtgagtgacactggaggtgtaaatctttatgctcagatgattgatgatgctgaaggattagagaaaattgagaatctacagtctcatgacaactcagagatatatgagaaggcagtgaagattctcgaaacatattggttggaggaggatgacgagacaatgccaccgggtgatgcttcccaatctgggttccaatttggaggcgatgctcctgctgttccctctggtggatttaacttcggctaaaggagttttagctgctgctccattgaagtgtgatgagatggttcaggtcagatgtcttggtgtctcagtgatgagattgttgtcaggttcaggtcaggtgtcttggcgacccggtggtgagatggttgtcaggttcaggtcaggtgtcttggcgtcatgtctggtctatctccggtcccgggtgatagggtgttggactggcttgggtcttaccaaggccgggagagagaaatgtggttggtggcatgattgaccttgggttttcatgtctagaatattttgggaaacctgagttcattttaaaagtagttgtcctaggagattgggctctcttataaaacggatgttgagtcttttttcgtttaaaaatattcttcttttgtccc

SEQ ID NO: 4876 - DNA, 1869 bp, Euphorbia esula
  misc_feature (190)..(190): n is a, c, g, or t
  misc_feature (311)..(311): n is a, c, g, or t
  misc_feature (498)..(498): n is a, c, g, or t
  misc_feature (541)..(541): n is a, c, g, or t
  misc_feature (717)..(717): n is a, c, g, or t
  misc_feature (1440)..(1440): n is a, c, g, or t
  misc_feature (1646)..(1646): n is a, c, g, or t
attttcatctgccaccaaaaacctctcttatcgatttctctcccgcttcaaatccttcttgatcgttgatcaataatcaatactttcgttgattttacaaagtaaagatgtcgttgaggccaagcgctaggaccgaggttcgtaggaacaggtacaaggtcgccgtcgatgctgaggaaggtcgccgtanacgggaagataacatggtggagatccgaaagaatcgtcgtgaggagagtctccaaaagaaacgcagggagggacttcaatctcagcctatgccggcttctcttcattcatctgctgttganaagaggctggagcatcttccatcaatggttgctggtgtgtggtctgatgatagtaatttgcagcttgaggcaacgactcaatttcggaagttgctatcaatagagcgtagccctccaattgaagaggtcatacaagctggtgttgttcctcgttttgttgagttccttatgagggaggactttcctnagcttcagtttgaagcagcttgggctctcacaaacattgcttntggaacatcagaaaatactagggtggtaattgatcatggagctgtccctatttttgtaaagcttcttgcttctccaagtgatgatgttcgtgaacaggctgtgtgggcattgggaaatgttgctggtgattctcctaaatgccgtgatctagtccttggaaatggagctttgcttnctttactttcacaactgaatgagcatgctaaactctcaatgctaaggaatgctacatggacactatcgaatttctgcaggggcaagccacagccatcctttgaccaggttaagcctgctcttccggcacttgctcgcctaattcattctaatgatgaagaagtgttgactgatgcgtgttgggcactttcatatctttctgatggtaccaatgacaaaattcaagctgttattgaagcaggcgtatgccctcggctagttgaacttttactacacccgtctccttcagttctcatccctgcccttcgcactgttgggaatattgttactggcgatgatatgcagacccagtgtatcatcaatcatcaagcactgccttgcttactgaatttgctgacgaataactacaaaaagagcataaaaaaggaagcttgttggacaatctctaatattactgctggcaacaaagaacagatccagtgtgtaatagaggccaatattattgggccactggttcatttgcttcaaaatgcggagttcgacattaagaaagaagccgcttgggctatatcaaatgctacttctggtggtgcacatgaacaaatcaagtaccttgttagccaaggatgcatcaagcccttatgtgacctgctaatttgccctgatccaaggatcgtaactgtttgtttagagggtcttgaaaacatcttgaaggtaggagaanctgacaagaacttgggcgaaaacggaggtgttaatatatatgcacaaatgattgatgatgccgaggggttggagaaaattgagaatctacagtctcatgacaatacagagatttatgagaaggctgtgaagattctcgaggcatattggttggaagaggatgagacaatgcctccaggagatgcttcccagtctggtttccaattngggggcaatgagatgccagctgttccatccggtggatttaatttcagctaaatggattctcttgctggttctattgggaagcctatggtgggactgttgtcatcttgaggtcaggtgtcttgttgtcatgtttggggtctagcagtccggtcagtctaagttgtgggtcgggagggtactggcctggtccgggtcgtcactagctcaagaattaatacggcgt

SEQ ID NO: 4877 - DNA, 1812 bp, Cirsium arvense
ctcttctgtaaaccttcactccctccatttctagggttccttttcttcttcttcttagcaaccatgtcgttgaggcctaacgccaggacggaggttcgccggaatcggtacaaggtggctgtcgatgccgaggagggacgccggaggagggaagacaacatggttgagatccgtaagaacaagcgagaagagagtttgcagaagaagagacgagaagtgctcactggcagtcagttttctgtgcctgttcaatctgcttctgctgccgaaaagaagttagaaaatctacctgcaatggttgctggagtttggtccgatgataacaatatgcagcttgaggctactactcagtttcgtaagctgttgtcaatagaacgcagccctcccattgaggaagttatccaatctggtgttgttcctcgttttgttgagtttcttgttagggaggatttcccccaactacagtttgaggcagcctgggcgttaactaacattgcttcggggacatctgaacacacaaaagtggtgattgatcatggtgctgtcccgatatttgtaaaacttcttgcatctccaagtgatgatgttcgagagcaggctgtatgggcgctagggaatgttgctggtgattcccctaaatgtcgtgatcttgtactcggacaaggtgctttgattcctttgctggctcagttaaacgagcatgctaaactgtctatgttgcgcaatgctacgtggacgctttccaatttttgtagaggcaagccacaaccctcttttgatcagactaggcctgcacttccggctcttcagcaacttattcattcaaacgatgaagaagttctgactgatgcttgttgggcactctcatatctttcagatggtaccaatgataaaatccaagctgtgatagaagcaaacgtatgcccaagattggttgagttactcaatcatccttctccttctgtactcatccctgctcttcgcactgttggaaacattgttaccggcgatgatatgcaaactcagtatatcattaatcatcaagcactgccctgtcttctgaatctgttgagcaataatcacaaaaagagcatcaagaaagaagcttgttggactatatcaaacattactgctggcaacaaggaacagattcaaacagtaatcgaagcaaatatcatcggccctctagttcatttgcttcagaatgcagaatttgacatcaagaaagaggctgcatgggctatttcaaacgctacttctggtggaagccatgaccaaattaaatatttagttagtcagggatgtatcaaaccgctgtgtgacctactcatctgtccagaccctcgaattgtgacggtctgtttagaggggcttgagaacatactaaaggttggtgaagctgagaagaatttgggacggtcgggagatgtgaatcttttcgcacaaatgattgatgatgctgaaggattggagaaaatcgagaacctacagagtcacgataacaatgagatctatgagaaagcggtgaagcttctcgagacatattggttggaggaagaggatgacgcaatgccacctggcagtgatgcagcccagcctggtttccagtttggcggtgctgatgtttccgttccctctggtggattcaacttcaactgaaggtaattggatgttgatgttaggggagattaatggtgtgaagacatgtctatgttattctgctgcttgaagtttttattgggtgggatggtgaaatcttgatggataatgtaaagttatatataaatttgggatttatagagttttttgctg

SEQ ID NO: 4878 - DNA, 2075 bp, Tabernaemontana elegans
cccagtagtaaaacgatccgtccaagcgatttctctcccactctcactctctctctctctctctctcttcaagtctctctaaaaaatttcatctgcatcgaatttttttggggcacggcacgcaattgagcagtgatcacagagctgcatatacgaataaagttatttagggtttttaatcggatcaaccggagccatgtcgctgaggccgaacgcgagaaccgaggtccgccggaacagatataaggtggctgtggacgcggaggaaggtcggcggaggagagaggatgggatgatcgagatccggaagagcagaagagaggaaagtttactaaagaaacgccgggaagggcttcaagcgcagcaatttcagaacacagtcaaccttactcaacttgaaaagaagttagaaagccttccggctatggtggctggtgtttggtctaacgatagcagcttacaactcgaagccactacccaatttaggaagctgctttcaatagaacgcaatccgccaattgaggaagtgatacaatctggagttgtccctcgatttgtcgagtttcttgctcgagatgactaccctcaacttcagtttgaagcagcatgggctcttacaaatattgcatctgggacgtctgaaaataccaaggtggtgattgatcatggtgctgtgcccatttttgtaagacttcttagttcgccaagtgatgatgttcgcgaacaggctgtttgggcattaggtaatgttgccggtgactctcccaaatgtcgtgatcttgttctcaactatggagccttgatgccattgcttgcacaattcaatgagcatgccaagttatctatgttgcgtaatgccacgtggacattgtcgaacttctgtagaggcaaaccccagcctcagtttgaacagacaaagccagccctccctactcttgctcgtcttatacattcaaatgatgaagaagttctcacagatgcatgctgggcactttcatatctctctgatggcacaaacgataaaatccaagctgttattgaagctggcgtgtgtcctcgtcttgttgagcttctacttcatccttcaccatctgttctcattcctgccctgcggacagttggtaatattgtcactggtgatgatatccagactcaggttatcattgataacgaagctcttccttgtctgctgaatttattgacccaaaattataaaaaaagcattaaaaaggaagcttgttggacgatttcaaatatcacggcaggaaacagggagcagattcaggctgtgattcaagctggcattattgctccgcttgtccaacttcttcaaaatgctgagttcgagataaaaaaggaagctgcttgggcaatttcaaatgctacatctggtggaactcatgagcagatcaagttcttggtgagtcagggttgtataaaaccattgtgtgacctccttgtttgtcctgacccaaggattgtcactgtctgcctggaagggcttgagaacattttgaaggttggagaagctgaaaagaatctcggaaatactggagatgtgaatgtctttgctcagatgattgatgaagcggaaggtttagaaaagattgaaaacctgcagagtcatgacaacaatgaaatatatgagaaggcagtgaagattctggaaacatattggctagaggaggacgatgagcagctaccttcaggtgatgctccacaatctggattcaactttggagggggtgatctccctgttccatctggaggattcaagtttggttgaagggatactccactgttgaaatatgagttggcttgggttggtaggatgtctttatgctttactcggctacattggtatggcgtcacttatgcttgagattgcaccaaagcctatttggtccgtcgaggtgaccaaataaggaagaagcgggttatatgatatctttagcttggtagatgataccccaatattttagggttattgcgcaagaaggtttgcttgaacgttgtagagtcttttttgaaatcttttggttcattgtaatggtttattattttttgaagtttgt

SEQ ID NO: 4879 - DNA, 1980 bp, Flaveria ramosissima
cagaaagcttttggcccgcctatctctctcccccaaatctccattcctatataacacactcatccttcatcttcaatcgatcgacactggtgtactctattgtataaacaccatccactcactataaaccctaatttctagggtttgttctttctagcgcaatcaaacatgtcgttgaggcctagtgagagaacagatgctcgccggaaccgctacaaggtggcggtggacgccgacgagggtcgccggaggagagaggacaatatggttgagatccgtaagaatcggagggaggagagcttgcagaagaagagacgtgaaggactcgctgcgaatcagtttcctctgccggttcaatctgcttccgctgccgaaaagaagttagaaaacctacccgcaatggtagcgggggtttggtcagatgacaataatatgcagcttgaggctactactcagtttcgtaaactgttatcaatagaacgcagccctcccattgaagaagtaattcaagctggtgttgttcctcgttttgttgagtttcttatgagggaggatttccctcaactacagtttgaggcagcttgggctttgactaatattgcttcggggacatctgaccacacaaaagtggtgattgatcatggtgctgttcctatatttgtgaaacttcttgcatctcctagtgatgatgttcgagagcaggctgtatgggctctaggtaatgttgctggtgattcccctaaatgtcgtgaccttgtacttggacaaggtgctttgattcctttgctggcccaattaaatgagcatgctaagttgtctatgttgcgaaatgccacatggaccctttccaatttttgtagaggcaagccacaaccttcttttgatcagacaagacctgcgcttccagctcttcaacaacttattcattcaaacgatgaagaagttttgactgatgcttgttgggcactttcatatctttcagatggtactaatgataaaatccaagctgttattgaagcaaatgtgtgtcccagattggtagagttactaaatcatccatcgccttcagtactcatccctgctcttcgtacagttggcaacattgttactggtgatgatatgcaaactcagtatatcatcaatcatcaagcactgccctgtcttctgaatctgttgatcaataatcacaaaaagagcattaagaaggaagcttgctggactatatcaaacatcacagctggcaacaaggagcagattcagacagtgatcgatgcaaatatcattgggccgcttgttcatttacttcagaatgcagaatttgacatcaagaaggaggctgcatgggccatctcaaatgctacttctggtggaagtcatgaccagattaagtatcttgttagtcagggatgcatcaaacctttatgtgacttacttgtgtgtccagaccctagaatcgtgaccgtttgtctggagggacttgagaacatattgaaggtgggtgaagcagagaagaatttgggaagatctggaaatataaatctttatgcacaaatgattgatgatgctgaaggattggagaaaattgagaacctacaaagccatgacaacaatgagatttatgagaaagcagttaagcttcttgaaacatattggttggaggaagaggaggaggatgtgatgccgcctggcgaaccagcgcagccgggtttcaattttggtggtggtgatgtttctgttcccaatggtggcttcaacttcaactgattcaaggttggtcttattgaagctgttgtggtttaagtcaaggaagtagtattgcaggcatccatctatttcatgaggttcatttatgtagtgtggttgaagttttatggagtgattgaggtttttttacaatgaatatcactaaaatgttgatgaattatgtaaaagtaatattgtgcttttggagacatttgacctttaaattgggatttatag

SEQ ID NO: 4880 - DNA, 2247 bp, Humulus lupulus
tccccacctcccaccactgcgctatataatcactctgttctcttcgcctttctctctctttaaacttcgaagatcaagccctcttatcactctctctctttgttttctccccaaaaccttcactttctctctctagggtttcgaattccactactttcatcatgtcgttgaggccgagcgcgaggactgaggtccgccggaaccgatataaggtcgccgtcgacgccgaggagggtcgaaggcgccgtgaggacaacatggtggagatcaggaagaatcgcagagaagagagccttcagaagaagcgccgtgagggacttcagcctcagcaattgcagacttccattccaacgttagctgtcgagaagaagctagaacatctaccttccatggtagcgggtgtttggtcagactcagatgatgggaatctgcagcttgagtccactactcagtttaggaagcttctttctattgagcgaagtcctccaatcgaggaagtcatacaatctggtgttgttcctcgttttgttgaatttctgatgagggaggactttccgcagctacagtttgaagcagcttgggctctcacaaatattgcttctgggacttctgagaacacaaaggttgtaattgatcatggagctgtccctatatttgtaaaacttctaggctctccaagtgatgacgtccgtgaacaggctgtttgggccttgggaaatgttgctggtgattccccaagatgtcgtgatctggtacttggtaatggggccctgcatcctttgttggcacagttaaatgagcatgctaagctctctatgcttagaaatgcgacatggactctttcaaatttttgtaggggcaagccacaacctccgtttgatcaggttaagcccgctcttccagctcttgcccgccttatccattcaaatgatgaggaagttttgacagatgcttgttgggcactttcttacctttctgatgggacaaatgataaaattcaagcagttattgaagccggggtgtgcccccgacttgttgaacttttacttcacccatcaccgtctgtgctcattcctgctcttcgcactgttgggaatatagtcattggagatgatttgcaaactcaggtgatcattaatcatcaagctcttccgtgtttgctgactttattgacaaacaattataagaagagtatcaagaaagaagcctgctggactatctcaaacatcacagctggaaacaaggatcagattcagtgtgtagttgaggctggtataattgctccccttgttaatctgcttcaaaatgctgaatttgatattaaaaaagaggctgcctgggccatctcaaatgctacgtctggtggttctcatgaccaaataaaattcctagtaaatcaagggtgtatcaaaccattgtgtgatcttctaatctgccctgatcctaggattgtcacagtgtgtttggaagggcttgaaaacattttgaaggttggagaagccgaaaagaatttgggtaatactggaggtgttaatctttatgctcagctgattgatgatgctgaaggattggagaaaattgagaatctacaaagtcacgacaataccgagatatatgagaaggcagtaaagatcctcgaaacgtattggctcgaggaggaggatgacacaatgccacctggtgactcatctcaatctggattcaactttggagggagtgaggttcctgctgttccttctggtggcttcaacttcagctgaagagtgggtcgaatctcaagaatggctggaccaaagctatagcatggggacttactatacgacaaacatctgccacaaaggattaaagccagggggttactatttttggtgagtcgtttatccccaatggctgttgttgggttatcacatacagcggatgtggagtcttgcattttttctatctctttttattttgtttttagttttgatagaaagtgttgtagctaaaagtgttgcttatgatggttcgttaccaagtcattttggcactttccagagagtcgtctccataattatttgctttgtagtagtatgaggatacccttcctatccgttgtacgttgtgtggtgataaacttaaattttttggggcttcagagtcgttaatgaatttaatcatattgtcaggggaatagtccactggccctgatgtcagaagttgtttttaagaaaaaatccttattatgaagagaaagatttattatct

SEQ ID NO: 4881 - DNA, 2290 bp, Medicago truncatula
attcatacatcaatcaaatcaacatccaatagagcagtatagtctccactgcctctttctcttctccgtcgatcacttccttctaaacgatgtcgtatcgtccaaacgcaaactcaaggaccgaggtccgtcgcaaccgatacaaggtcgccgtcgatgccgaagaaggccgccgtcgccgtgaagacaccatggttgagatccgtaagaatcgtcgtgaagagagtttgctcaaaaagaggcgcgaaggtcttcaacctcagcagattccttccgctcttcactctaacgtcgtcgagaagaagttggaacatttgccaactatggttgctggtgtgtggagtgatgataataacttgcagcttgaatcaacgactcagtttcgaaagctgctatctattgaacgtactccaccgattgaggaggttatacagactggtgttgtttctcgttttgtcgagtttctgatgagggaagactttccgcagttgcagtttgaggcagcttgggctttgacaaacatagcttctggaacatctgaaaacactaaggtggtaattgaccatggggctgtcccaatttttgtgaagctccttgcttcttccagcgacgatgtccgtgagcaggctgtgtgggcattaggaaatgttgctggagattctcccagatgtcgtgatcttgttctcggtcacggggctttggttcctcttttggcacaattgaatgagcatgcgaagctttctatgctgagaaatgctacctggacactttcaaacttctgcaggggcaagccacagcctccttttgatcaggttaaacctgcacttcctgctcttgctggtcttatacattcaaatgatgaagaagtcttgactgatgcctgctgggcactatcatatctttctgatggtacaaacgataaaattcaagctgtaattgaagctggtgtttgtccccgacttgttgagcttctattgcacccatctccttcagtgctaattcctgctcttcgtactgttggaaacattgtcactggagatgatttgcaaactcaggttatcatcaatcatcaggctcttccttgtctatacaatctgttgaccaataattataagaaaagcatcaagaaggaagcttgctggaccatatcaaacattacagctgggaataaacagcagattcaggctgtgatcgaggccaatatatttggtcctctggtgagtctgcttcaaaatgctgagtttgatatcaagaaagaggctgcttgggctatttctaatgctacatctggtggatctcacgaacaaatcaagtacctagtaagtcaagggtgtattaagcccttgtgtgatcttcttatctgtcccgatcctaggattgtgacagtttgtctggaaggccttgaaaacatcttgaaggttggagaagcggataaaaatataggcaataatggtgatgtgaatctatatgcccagatgattgatgatgctgaggggttggagaaaattgagaacctccagagtcatgacaacacagagatttatgaaaaggctgtgaagattcttgagacatactggttggaggaagaagatgagaccatgcctccaggcgatgcttctcaatcaggattcaacttcggtagcgctgaggttccttctgtgccttcgggtggatttaacttcaatcagtagatgttcatgcttcaatggggccgtgtcttatatttagccttttctggagttttgtctggtctatcattaaagtcaccccgtatgatgggacaagctggggttgaatcaatgtgttgtttctgtgtccaacaaggtccaacattggtaaatagagcgttgctggattggcttgggcaatgcctggtttttcatatctcatggtgacagatgtgtggtggcttgattttttggtcaccgtagacaatactagacttctctgtgaagtgataatacataaaatgaatgttcagtatcatgattttttcttggttatatgtaatagtttggagtcagtgagtgagtcacttaagttttagttacgattgtgggtctatttggcaaaatgccagatgctcgttggagtttttacccatcggtacctatgaatttttttggtcgatgaaagtttaccctagagttcagttattcattatgttatccatatatccagtgtccctattttcgtcgatgaaagtttgttttgcaatgtcttaaacaaatagtgtggtgcaattattttgtattatataaagtttcacgcaatttctatccgttccagg

SEQ ID NO: 4882 - DNA, 2416 bp, Medicago truncatula
agttatcataaatgaatggtaattgatttaaaatttaaacttaagaaaaagaaatcacaaattttggtgtctttctctctatttaataatctactagtacaaaacacaaaccctaccgttagtttcattcatacatcaatcaaatcaacatccaatagagcagtatagtctccactgcctctttctcttctccgtcgatcacttccttctaaacgatgtcgtatcgtccaaacgcaaactcaaggaccgaggtccgtcgcaaccgatacaaggtcgccgtcgatgccgaagaaggccgccgtcgccgtgaagacaccatggttgagatccgtaagaatcgtcgtgaagagagtttgctcaaaaagaggcgcgaaggtcttcaacctcagcagattccttccgctcttcactctaacgtcgtcgagaagaagttggaacatttgccaactatggttgctggtgtgtggagtgatgataataacttgcagcttgaatcaacgactcagtttcgaaagctgctatctattgaacgtactccaccgattgaggaggttatacagactggtgttgtttctcgttttgtcgagtttctgatgagggaagactttccgcagttgcagtttgaggcagcttgggctttgacaaacatagcttctggaacatctgaaaacactaaggtggtaattgaccatggggctgtcccaatttttgtgaagctccttgcttcttccagcgacgatgtccgtgagcaggctgtgtgggcattaggaaatgttgctggagattctcccagatgtcgtgatcttgttctcggtcacggggctttggttcctcttttggcacaattgaatgagcatgcgaagctttctatgctgagaaatgctacctggacactttcaaacttctgcaggggcaagccacagcctccttttgatcaggttaaacctgcacttcctgctcttgctggtcttatacattcaaatgatgaagaagtcttgactgatgcctgctgggcactatcatatctttctgatggtacaaacgataaaattcaagctgtaattgaagctggtgtttgtccccgacttgttgagcttctattgcacccatctccttcagtgctaattcctgctcttcgtactgttggaaacattgtcactggagatgatttgcaaactcaggttatcatcaatcatcaggctcttccttgtctatacaatctgttgaccaataattataagaaaagcatcaagaaggaagcttgctggaccatatcaaacattacagctgggaataaacagcagattcaggctgtgatcgaggccaatatatttggtcctctggtgagtctgcttcaaaatgctgagtttgatatcaagaaagaggctgcttgggctatttctaatgctacatctggtggatctcacgaacaaatcaagtacctagtaagtcaagggtgtattaagcccttgtgtgatcttcttatctgtcccgatcctaggattgtgacagtttgtctggaaggccttgaaaacatcttgaaggttggagaagcggataaaaatataggcaataatggtgatgtgaatctatatgcccagatgattgatgatgctgaggggttggagaaaattgagaacctccagagtcatgacaacacagagatttatgaaaaggctgtgaagattcttgagacatactggttggaggaagaagatgagaccatgcctccaggcgatgcttctcaatcaggattcaacttcggtagcgctgaggttccttctgtgccttcgggtggatttaacttcaatcagtagatgttcatgcttcaatggggccgtgtcttatatttagccttttctggagttttgtctggtctatcattaaagtcaccccgtatgatgggacaagctggggttgaatcaatgtgttgtttctgtgtccaacaaggtccaacattggtaaatagagcgttgctggattggcttgggcaatgcctggtttttcatatctcatggtgacagatgtgtggtggcttgattttttggtcaccgtagacaatactagacttctctgtgaagtgataatacataaaatgaatgttcagtatcatgattttttcttggttatatgtaatagtttggagtcagtgagtgagtcacttaagttttagttacgattgtgggtctatttggcaaaatgccagatgctcgttggagtttttacccatcggtacctatgaatttttttggtcgatgaaagtttaccctagagttcagttattcattatgttatccatatatccagtgtccctattttcgtcgatgaaagtttgttttgcaatgtcttaaacaaatagtgtggtgcaattattttgtattatataaagtttcacgcaatttctatccgttccagg

SEQ ID NO: 4883 - DNA, 1753 bp, Lactuca sativa
aaagttttcttttcggcccgccgttctctctccttctctctctccggacggaaaagaccaaaccctcactcgctctttatataccagtgtccgcgctacagtacatacgaaggatctaaatcgtttctgaaactcaggtctagggttttctctttttgctactagttgtaaccatgtcgctgagacctagcgccagaacggaagttcgccggaaccgatacaaggttgcggtcgatgccgaggaaggccgccggaggagagaagacaatatggtcgagatccgtaagaatcggagagaagaaagcttgcagaagaagagacgcgaagcactcactggtagccagttcgccgtgcccgttcagtccgcttccgccgccgaaaagaagttggaaaatcttcctgccatggttgccggagttttctctgatgataacaatatgcagcttgaggccactactcaattccgtaaacttttatcaatagaacgcagccctcccattgaagaagttattcaatctggtgttgttcctcgctttgttgagtttcttgtaagggaggatttcccacaacttcagtttgaggctgcttgggctttgactaatattgcttcggggacatctgaacacacaaaagtggtgattgatcatggcgctgttccaatatttgtgaagcttcttgcatctccaagtgatgatgttagagaacaggctgtatgggctttaggaaatgttgctggtgattcccctaaatgtcgtgaccttgtacttgcacaaggtgctttgattcctctactatcccaattaaacgagcatgctaagttatccatgttgcgaaatgccacatggacactttcaaatttttgcagaggcaaaccacagccttctttcagtcagacaaaacctgcacttccagctttacagcaacttattcattcaaacgatgaagaagttttgacagatgcttgttgggctctttcatatctttcagatggcacaaatgataaaatccaagctgttattgaagcaaatgtatgtccaagattggttgagctactgaatcacccttctccatctgtccttatccctgctcttcgtactgttggtaacattgttacaggagatgatatgcaaactcagtatataatcaatcatcaagctttgccttgtcttctcaacttgttgaccaataaccacaaaaaaagtattaagaaagaagcttgttggactatatcaaacatcactgctggcaacaaggagcagattcagacagtcattgaagcaaatatcattggccctcttattcatctgcttcaaaatgcagaatttgacatcaagaaggaagctgcatgggccatttcaaatgctacttctggtggaagccatgaccaaatcaagtatttggttgctcaaggatgtataaaaccattgtgtgatttactgatatgtccagacccaagaatagtgacagtttgtttggaaggtcttgagaatatattaaaagttggtgaagcagaaaagaatttgggaagatcaggagatgtgaatctttatgcacaaatgattgatgatgcagaaggtttggagaagattgagaatctacagagtcatgataacaatgagatttatgagaaagcagtgaagcttctcgagacgtattggttggaggaagaagatgatgctatgccacctggcgatgccgcccgcactcagcctgctgggcgctttcattttggtggtggtgatgtttcggttcc

SEQ ID NO: 4884 - DNA, 1840 bp, Cirsium arvense
tcaaactctctctctctcgctctatatagacctctgcaattgatccatactgaagtattgtgcaagccttcattcactctatactccatttctagttgttttgcttgctaggaatagcaaccatgtcgttgaggcctagcgcgaggacggaggttcgccggaatcgctacaaggtggcggtcgatgccgaagagggacggcggaggagagaagacaacatggttgagatccgcaagaacaagagagaggagagtttgcagaagaagagacgggaagcactcaccggtagtcagttttcggtgcctgttcaatctgcttccgccgccgaaaaaaagttggaaaatctacctgcaatggttgcaggagtttggtctgatgataacaatatgcagcttgaggccactacccagtttcgtaagctgttatcaatagaacgcagccctcccattgaggaagttattcaatctggtgttgttcctcgttttgttgagttccttgtgagggaggatttcccacaactacagtttgaggcagcttgggcattgactaatattgcttcggggacatctgagcacacaaaagtagtgattgatcatggtgctgtgccaatatttgtaaaacttcttgcatccccaagtgatgatgttcgagagcaggctgtatgggcgctagggaatgttgctggtgattcccctaaatgtcgtgaccttgtactcgggcaaggtgctttgattcctttgctggctcagttaaatgagcatgccaaactatctatgttgcgcaacgctacatggacactttccaatttttgtagaggcaagccgcaaccctcttttgatcagaccagacctgcacttccagctcttcagcaacttattcattcaaacgatgaagaagttctgactgatgcttgttgggcactctcatatctttcagatggtaccaatgataaaatccaagctgtaatagaagcaaatgtatgcccaagactggttgagttactcaatcatccttctccttcagtgctcatccctgctcttcgtacggttggcaacattgttaccggtgatgatatgcaaactcagtatatcattaatcatcaagcacttccgtgtcttctgaacctgttgagcaataatcacaaaaagagcatcaagaaagaagcttgttggactatatccaacatcactgctggcaacaaggagcagattcagactgtgatcgaagcaaatatcatcggccctcttgttcatttgcttcagaatgcagaatttgacatcaagaaagaggctgcatgggctatctcaaacgccacttctggtggaagccatgaccaaattaagtatttagttagtcagggatgtatcaaaccattgtgtgacctacttatctgtccagacccaagaattgtgacggtctgtttagagggacttgagaacatactaaaggtgggtgaagctgaaaagaatttgggacgatcaggagatgtgaatctttttgcacaaatgatcgatgatgctgaaggattggagaaaatagagaatttacagagtcacgataacaatgagatatatgagaaagcagtgaagcttctagaaacatattggttggaggaagaagatgatgtaatgccacctggcgacaacacgacccaatctggtttccaatttggaggtgctgatgtttccgttccttctggtggattcaacttcaactaattttcaaggtaatttgttgttgaagttaaagatagtgtggttgaagttgtttatgggctgggatggtgaaatcttgattgatggattatgtaaagttaatatataaattgggatttatagag

SEQ ID NO: 4885 - DNA, 2409 bp, Citrullus lanatus
cctgtatttcgaaaacaaaccaaggttcggttctacttgtaggattttcaattattgtcgttgctagggtttttctatattccggcgatcccgatcatttttgaattcctttcagcaaattcccacttctgttagggttttgaatccaccctaagttaatccaccaagaagccatgtcgttgaggccgactgcaagaaccgaggttcgacggaaccgttataaggtctccgtcgatgccgaagagggccgacgccggcgagaggataacatggtcgagatcaggaagagtaaacgcgaagagagtcttcagaagaagcgtagggaaggccttcaagcccagcagtttccttctgccgtccacacttccactgtcgagaagaagttagagagccttccgtctatggttgcgggggtctggtctgataatagcagtcttcagctggaggcaactactcagtttcggaaattactttcgattgaacgaagccctcccattgaggaagtgattcaatctggagttgttccgcgttttgtagaatttcttgtgagggaggatttccctcaacttcagtttgaggctgcttgggctctcacaaacattgcatctggaacctcagaacacacaaaggtggttattgatcatggtgcagtgccaatttttgttaagctactcgcttctcctagtgatgatgtccgagagcaggccgtgtgggccttgggaaatgttgctggagattcccctacatgccgtgatcttgttctccgccatggagctttgattccacttctttctcagttgaatgagcatgctaagctttctatgttgagaaatgcaacttggacactttcaaacttctgcaggggcaagccacaacctccatttgaccaggtaaagccagctcttccagctcttgagcgcctagttcactcaaatgatgaagaagttcttacggatgcctgctgggcactctcttatctatccgatggtactaatgataaaattcaagctgtgatcgaggcaggtgtctgcggacggcttgtacagctcctattacatccttcaccatcagtcctcattcctgccctgcgcacagttgggaatatcgtgactggagatgacattcaaactcagtgtataattaatgatggtgcgcttccatgccttctgagcttattgactcacaatcataaaaagagtatcaagaaagaagcttgctggacgatatctaacattactgctggaaacaaggaacaaatccaggctgtcatcgaagctggtttaatacctccacttgtcaatttgcttcaaaatgctgagtttgatataaagaaagaggctgcatgggcaatttcgaatgcaacatccggtggtactcatgagcaaattaagtaccttgtcagtcaagggtgcatcaaaccattgtgtgatcttcttgtatgcccagatccaaggattgttacagtctgtttagaggggttagagaacattttgaaggtcggagaagccgaaaagaatctgggtaccaatggagacgttaatctatatgcacaaatgattgatgatgctgagggtttagaaaagattgaaaatctccagagtcatgacaaccatgagatttacgagaaggctgtcaaaatactcgaaacgtattggttggaggaagaggacgaggcattgcccacaactgatggtggggctcagcctggtttccgctttggtggaaatgaacttccagttccttctggtggattcaacttcagttgaagacttggaaggatatggctgcgcttttcgcagtgatatgaagggatagtacatgtgtcggctcacaagcttatttgtcggggtcgattggattcaattcgggtccaatctggggcatcttaatatcgagtttttagtctggtctggtctcgtccagtttatattgtgttcaaggagatgcttaaagaggtgggcggagttcagttcaacgacaacggccaaaacaatcaatgagaaaaaggtaggtggttttggcacgatgacgttgtgtagcatcagtgttcacaagatatctgcattgtaccatgtaataataatgtgcccaactgggcaattatgggttgcatcataagcatttgatttgtacttagttgggatgggtctggtagggcaggttgttttttttttttttttttttttttttttttttttttttgttttgttctcattttggcatggagtgttatttttttacttctttaccatattttaggtcattcgtcattgttgtttttactggcaaatgcttcggagttgggatttgttttgacttatcgagtgaatatagtatttttattattaactttgttattactgggaaagaaattggtgcttttgtgcttttattattattattattatt

SEQ ID NO: 4886 - DNA, 2533 bp, Glycine max
ggttgttgttgttaacgatgtcgctgaggccgaatgctagaaccgaggttcgccgcaaccgctacaaggtggcggtggacgccgacgagggtcgccggaggagggaggacaacatggtggagatccgcaagagcaagcgcgaagagagcctccagaagaagcgccgcgaaggcctccaagctcagcagcagttccccactcctctccaagccgcctccattgtcgagaaaaagttagagagtcttcctgcgatggttgctggagtgtggtccgatgataacagccagcaactggaagcgaccacgcagtttcggaaactgctttcgattgagcgcagtcctccaattgaggaagttattcaagctggggttgtgcctcgatttgtggagtttcttgttagggaggatttccctcaacttcagtttgaggctgcgtgggctctcacaaacatagcatctggaacttctgagaataccaaggtggtgattgatcatggggcagttccgatatttgtcaagctacttagttcgcccagtgatgatgttcgggagcaggcagtgtgggcattggggaatgttgctggtgactctcctaagtgtcgtgatcttgttctcagccatggtgccctgatcccactgttggcccagttgaatgaacatgcaaaactttcaatgttgagaaacgcgacatggaccctgtcaaacttctgcaggggcaagccacagcctccatttgagcaggtgagggcagcgcttcctgctctagaacgattggttttttccaatgatgaagaagtcttgacagacgcatgttgggcactatcatatctttccgatggaacaaatgacaaaatccaagccgttattgaggctggtgtgtgtcccagactggtgcagctccttctgcacccatccccttcagtgctgattcctgctcttcgcacagtgggaaatattgtgacaggagatgatatgcagactcagactatcatcaatcatggtgcgctcccatgcctcttgagcctgttgacacataatcataaaaaaagtatcaagaaagaagcttgctggaccatttcaaacattacagctggaaacagagatcagatacaggctgttgttgaagctggtttgattgccccccttgtcaatcttcttcaaaatgctgagtttgacattaaaaaagaagctgcttgggcaatctcaaatgctacatctggtggtacccatgagcagatcaagtatctggtgagccagggttgcattaagcctctctgtgatctgcttgtttgcccggacccaagaatcgtcactgtctgtttagaaggacttgagaatattctgaaggttggggaagctgagaagagcatgggtaacagtggagatgtcaacttgtatgcacagatgatagacgaagcagagggattggagaaaattgaaaacctgcagagtcatgacaacaatgaaatatatgaaaaggctgttaaaattcttgagacatattggttggaagacgatgatgagacactacctacaggcgatggtgctcaacctggttttaattttggaaacaatgatgttccagttccatctggtggattcaactttagttgaagactgttgtgtgggtaaatgttgtttcattatttttttaacttcagggtcattaatcaaaatatccacccaatttgtcataaatttcacaatgttctctaaaccaaaattggtttctataattgtaggaacctggttggatggagcagggttgatgctagggttactgtcggagtcgagtctgggtggggtggggagttgggggtttgggtgggtgagtgagttcggtccttgcacctcatggtgtctgtctggttttaagtctggtcttgtgtccgtggctaacggggtgcagggacgggtcagtttaactaccatgtccaaataagaagggtggtggtgggtgggttcaacagcagcataatgaccttgttagaagtttatgttgtgtttaaagtatatatatttgctgggcataactatggggaggttctatgttgcagtagcagagaccatattatgtggcagtggatgggttttcttgaatgcggcttttgagtcctattatttattgagtcgtagttgtattggtaatttatacagagtcggtatttgatttgagtgaatacagtatccagaaaccaattttatggtgtattcaaatgaaagaattagcgctattttttgtgcttacatatatcctttcggctattctgaagctttctccctccaattcatagttgtcaaaagagctctgacgaggagagtcgcaatgtgtatccaaacttcaaagggaagtgtgtccagtgtgtaatcaattggatacagcatgtccattttgtttaaagtccacgaggtttctaatatcttcgactctaatttgagctctacatgatgatgacaaatattcattttttaatgtgtaggattcttttggttattgagaattacagaatgggaatacaaaaaatcttgaacca

SEQ ID NO: 4887 - DNA, 1709 bp, Glycine max
aacgtcgctccaattctagggtttttcctccgttcccaattccgatcactttgatagatcttcgcttattgttagggttagggttgttgtgaacgaggatgtcgctgaggccgaatgctagaaccgaggttcgccgcaaccgctacaaggtggcggtggacgccgacgagggtcgccggcggagggaggacaacatggttgagatccgcaagagcaagcgcgaagagagcctccagaagaagcgccgcgaaggcctccaagctcagcagcagttccccactcctctccaagcctcctccattgtcgagaaaaagttagagagtcttcctgcgatggtagctggagtgtggtcggatgataacagccagcaattggaagcgaccacgcagttccggaaactgctttcgattgagcgcagtcctccgattgaggaagttattcaagctggggttgtgcctcggtttgtggagtttcttgttagggaggattttcctcaactacagtttgaggctgcgtgggctctcacgaacattgcatctggaacttctgagaataccaaggtggtgattgatcatggggcggtgccgatatttgtcaaactacttagttcgcccagtgatgatgttcgggagcaggcagtatgggcgttgggaaatgttgctggtgactccccaaggtgtcgtgatcttgttcttagtcacggtgccctgatcccattgttggcccagttgaatgagcatgcaaaactttccatgttgagaaacgccacatggaccctttcaaacttctgcaggggcaagccacagcctccatttgagcaggtgagggcagcgcttcctgctctagaacgattggttttttccaatgatgaagaagtcttgacagatgcatgctgggcgctatcatatctttccgatggaacaaatgacaaaatccaagccgttattgaggctggtgtttgtcccagactggtgcagctccttctgcacccatccccttcagtgctgattcctgctcttcgcacagttggaaatattgtgacgggagatgatatgcagactcagactatcatcaatcatggtgcgctcccatgcctcttgagcctgttgacacacaatcataaaaaaagtatcaagaaagaagcatgctggaccatatcaaacattacggctggaaacagagatcagatacaggctgttattgaagctggtctgattgccccccttgtcaatcttcttcaaaatgctgaatttgacataaaaaaagaagctgcttgggcaatctcaaatgctacatctggcggtacccatgagcagatcaagtatttggtgagccagggttgcatcaagcctctctgtgatctgcttgtttgccccgacccaagaattgtcactgtctgtttagaaggtcttgagaatattctgaaggttggggaagctgagaagagcttgggtaatactggagatgtcaacttgtatgctcagatgatagacgaagcagagggattagagaaaattgaaaacctgcagagtcatgacaacaatgaaatatatgaaaaggctgttaaaattcttgagacatactggttggaagacgatgatgagacactacctgcaggcgatggtgctcaacccggttttaattttggaaacaatgatcttccggttccatctggtggattcaactttagttgaagactgttgtgtggg

SEQ ID NO: 4888 - DNA, 1873 bp, Helianthus annuus
gaaactgattaccaacaagtccttcactcactacaaaccctactttctagggtttcttcctaccaaccatgtcgctgaggcctagcgagcggaccgaggttcgccggaaccgctacaaggtcgccgtcgacgccgatgaggggcgccggaggagagaagacaatatggttgagatccgtaagaatcgccgagaagaaagtttgcagaagaaacgacgtgaaggacttgttggtaatcagtttccactgcctgttcaatcgtcttctgttgctgaaaagaagttagaaaatctacctgcaatggttgcggggatttattcagatgatatcaatatgcagctagaggctactacccagtttcgtaaactgttatcaatagaacgcagccctcccattgaagaagttattcatgctggtgttgttcttcactttgttcagtttcttatgagggaggaattcccccaactgcagtttgaggcagcttgggctttgactaatatcgcttcagggacatctgaacacacaaaagtggtgattgatcatggtgctgttcctatatttgtgaaacttctcgcatctcctagtgatgatgttcgggagcaggctgtatgggctttaggtaacgttgccggtgattcccctaaatgccgtgaccttgttctcggtcaaggtgctttgcttcctttgctggccctactaaatgagaacgctaaactctctatgctgcgaaatgccacatggacactttcaaatttctgtagaggcaagccacaacctgcatttgaacagacaagacctgcgcttccagctctgcaacagcttattcattcaaccgatgaagaagttttgactgatgcttgttgggcgctttcgtatctttcagatggtacaaatgataaaatccaagctgttatagaagcaaatgtatgtcctagattggtcgagttactaaatcatccatcaccttcagtactcattcctgctcttcgtacagttggcaacattgttaccggtgatgatatgcaaactcagtatatcattgatcatcaagctctgccgtgtcttttgaatctgttgatcaataatcacaaaaagagtattaagaaagaagcgtgttggactatatcaaacatcactgctggcaacaaggagcagattcaaacggtgattgaagcaaatctcgttgcgcctcttgttcagttacttcagcatgcagaatttgacattaaaaaggaagctgcatgggccatctcaaatgctacttctggtggaagccatgaccaaattaagtatcttgttattcagggatgtatcaaacctttatgtgacctacttgtgtgcccagaccctagaattgtgacagtttgtctagaggggcttgagaacattctgaaagtgggtgaagctgagaagaatttgggaaggactgaggacacgaatctttatgcacaaatgattgatgatgctgaaggtttggagaaaattgagaacctacaaagtcatgataacaatgagatctatgagaaagcagtgaagcttctggaaacgtattggttggaggaagaggatgacgtaatgccacctggcgaagttgctcagcccggttttaattttggtggcggtgatgttgttgttcctaatggtggctttaacttcaattgattcaaggtcagtcttgttgaagtagggggagatttatgtagtgttgcaggcaggcatctatctgttttcatgaggttcattattgtagtgtggttgaagtttatggagtgattgaggttttttacaatgaatatcactaaaatgttgatgaattatgtaaaagtaaatggtatttctcttttgggacaacttgaattgggatttatagagtt

SEQ ID NO: 4889 - DNA, 1923 bp, Helianthus annuus
ccatctctctccccaacctccactcctatataacctcccaccatcttcaactgatagataccggtgtattctatacacctacaaaccctactttctagggtttcttcctaccaaccatgtcgctgaggcctagcgagcggaccgaggttcgccggaaccgctacaaggtcgccgtcgacgccgatgaggggcgccggaggagagaagacaatatggttgagatccgtaagaatcgccgagaagaaagtttgcagaagaaacgacgtgaaggacttgttggtaatcagtttccactgcctgttcaatcgtcttctgttgctgaaaagaagttagaaaatctacctgcaatggttgcggggatttattcagatgatatcaatatgcagctagaggctactacccagtttcgtaaactgttatcaatagaacgcagccctcccattgaagaagttattcatgctggtgttgttcttcactttgttcagtttcttatgagggaggaattcccccaactgcagtttgaggcagcttgggctttgactaatatcgcttcagggacatctgaacacacaaaagtggtgattgatcatggtgctgttcctatatttgtgaaacttctcgcatctcctagtgatgatgttcgggagcaggctgtatgggctttaggtaacgttgccggtgattcccctaaatgccgtgaccttgttcttggtcaaggtgctttgcttcctttgctggccctactaaatgagaacgctaaactctctatgctgcgaaatgccacatggacactttcaaatttctgtagaggcaagccacaacctgcatttgaacagacaagacctgcgcttccagctctgcaacagcttattcattcaaccgatgaagaagttttgactgatgcttgttgggcgctttcgtatctttcagatggtacaaatgataaaatccaagctgttatagaagcaaatgtatgtcctagattggtcgagttactaaatcatccatcaccttcagtactcattcctgctcttcgtacagttggcaacattgttaccggtgatgatatgcaaactcagtatatcattgatcatcaagctctgccgtgtcttttgaatctgttgatcaataatcacaaaaagagtattaagaaagaagcgtgttggactatatcaaacatcactgctggcaacaaggagcagattcagactgtgattgaagcaaatctcgttgcgcctcttgttcagttacttcagcatgcagaattcgacattaaaaaggaagctgcatgggccatctcaaatgctacttctggtggaagccatgaccaaattaagtatcttgttattcagggatgtatcaaacctttatgtgacctacttgtgtgtccagaccctagaattgtgacagtttgtctagaggggcttgagaacattctgaaagtgggtgaagctgagaagaatttgggaaggaccgaggacacgaatctttatgcacaaatgattgatgatgctgaaggtttggagaaaattgagaacctacaaagtcatgataacaatgagatctatgagaaagcagtgaagcttctggaaacgtattggttggaggaagaggatgacgtaatgccacctggcgaagttgctcagcccggttttaattttggtggcggtgatgttgttgttcctaatggcggctttaacttcaactgattcaaggtcagtcttgttgaagtagggggagatttatgtagtgttgcaggcatctatctgttttcatgaggttcattattgtagtgtggttgaagtttatggagtgattgaggttttttacaatgaatatcacttgatgaattatgtaaaagtaaatggtatttctcttttgggacaacttgaattgggatttatagagtttaccttcctttgc

SEQ ID NO: 4890 - DNA, 2174 bp, Cucumis melo
caaaacaaaccaaggctcggttcttcttataggatttccaattattgtcgtcgctagggtttttctctataccggcgatcccgatcatttttgaattcctttcaccgaattcccatttctgtgagggtttttgaatccactccaagttaatcgacgaagtagccatgtcgttgaggcctactgctagaaccgaggttcgtcggaaccgttataaggtatccgtcgatgccgaagaaggccgacgccggcgagaggataacatggttgagatcaggaagagtaagcgcgaagagagtcttcagaagaagcgtagggaaggccttcaagcacagcagtttccttctgccgtccacacttccactgtcgagaagaagttagagagccttccgtctatggttgctggggtatggtctgataatagcagtcttcagctcgaggcaacaactcagtttcgaaaattactttcgattgaacgaagccctcccattgaggaagtgattcaatctggagttgttccgcgttttgtagaatttcttgtgagggaggatttccctcaacttcagtttgaggctgcttgggctctcacaaacattgcatctggaacctcagaacacacaaaggtggttattgatcatggtgcagtaccaatttttgttaagctactcgcttctcctagtgacgatgttcgagagcaggctgtttgggctttggggaacgttgctggagattcccctacatgccgtgatcttgttctccgccatggagctttgattccacttctttcccagttgaatgagcatgctaagctttctatgttgagaaatgcaacttggacgctttcaaacttctgcaggggcaagccacaacctccatttgaccaggtaaagccagctcttccagctcttgagcgcttagttcactccaatgatgaagaagttcttacggatgcctgctgggcactctcttatctatctgatggtactaatgacaaaatccaagccgtgatcgaggcaggggtgtgtggacgactcgtacagctgctattacatccttcaccgtcggtcctcattcctgcccttcgcacagttgggaatattgtgactggagatgacattcaaactcagtgtataattaacgatggtgcccttccatgccttctgagcttattgactcacaatcataaaaagagtatcaagaaagaagcttgttggacgatatctaacattactgctggaaacaaggaacagatccaggctgtcatcgaagctggtttaatacctccacttgtcaatttgcttcaaaatgctgagtttgatataaagaaagaggctgcatgggcaatttcgaatgcaacatccggtggaactcatgagcaaattaagtaccttgtcagtcaagggtgcataaaacctttgtgtgatcttcttgtatgcccagatccaaggattgttaccgtctgtttagaggggctggagaacattttgaaggttggagaagccgaaaagaatctgggtaccaatggagatgttaatctatatgcacaaatgattgacgatgctgagggtttagaaaagattgagaatctccagagtcatgacaaccacgagatttatgagaaggctgtcaaaatactcgagacgtattggttggaggaagaggacgaggcattgcccacaactgatggtggtgctcagcctggtttccgctttggtggaaacgaacttccagttccttctggtggattcaactttagttgaaggcttttgaaggatatgtgcggttttggtggtgatactaagggagagtagtacatgtgtcggcgcacaagcttatttgttggggtcaattggattcaattcgggtccaatctggggcatcttaatatcgagtttttagttgggtctggtctcgtccagtttacattgtgttcaaggagatgcttaaaagagggaggagaagagtcaagttcaacgacggccaaaacaatcattcggaaaagtaaaggtaggtcgttttggcaagatgacgtagcatcagtgttcacaaaatatctgcattgcattgtatcatgtaataaaaatgtgctcaactgggcaattatgggtttcatcatataagcatttgatttgtacttagttgggattatgggtctttgctagcgcagggtgttcttt

SEQ ID NO: 4891 - DNA, 2171 bp, Glycine max
agctcctagctagggtttttcgaattcccattcttccttccttccttctgcttttatcgatctccaacgaaaccaaaccatgtcgctcaggccaaatgccagaaccgagattcgccgcaaccgttacaaggtcgccgtcgacgccgacgagggccgccggagaagagaggacaacatggtcgagatccgcaagagcaagcgcgaagagagtttgctcaagaagcgtcgtgaaggcctccaagctcagcaacagtttcccgctcctcttcagaactccaccgtcgacaagaagctggagagtcttcctgccatggttgctggagtttggtcggatgataatagtattcaacttgaagccactacgcaatttcgcaagctgctttcgattgaacggagccctccgattgaggaagttattcaagctggtgttgttccacgttttgttgagtttcttgttagagaggatttccctcaacttcagtttgaggctgcgtgggctctcacaaacattgcatctgggacttctgagaacactaaggtggtaattgatcatggggcagttcctatatttgtcaagctacttagttcacctagtgatgatgttcgggagcaggcagtgtgggctttgggaaatgttgctggtgactcccctaggtgtagagatctagtgctcagccaaggtgccctcgtcccactgttggcccagttgaatgagcatgcaaaactttcaatgctgagaaatgccacatggacattatctaacttttgcaggggtaagccacagcctccgtttgagcaggtgagaccggcacttccagcactcgagcgtttggttttttccaatgatgaagaagttttgacagatgcttgctgggcattatcatatctctctgatggcacaaatgacaaaatccaagcagttattgaggcaggtgtatgtgccagattggtgcagcttctcatacacccatctccctcagtgctgattcctgctcttcgtacagtgggaaatattgtgactggagatgatatgcagactcagtgtattatcaatcatggtgcactcccctgccttttgaacctgttgacaaataatcataaaaaaagcattaagaaagaagcttgttggactatatcaaacattactgctggaaataaagaacagatacagactgttattgaagctggtctggttgcaccccttgtcaatcttcttcaaaatgcggaatttgacattaaaaaggaagctgcttgggcaatctcaaatgctacatctggtggaattcatgagcagatcaagtacttggtgagtcagggttgcataaagcctctttgtgatcttcttgtttgcccagacccaagaattgttactgtctgtttagaaggcctagagaatattctgaaggttggagaagctgagaagagcctaggtaacactggagatgttaacgagtatgcacagatgatagatgatgctgagggattggagaagattgaaaacctacagagtcatgacaacaatgaaatatatgaaaaggctgttaaaattcttgaaacatattggttggaagaagaagatgagacactaccttcaggagatggtgctcaacctggtttcaatttcggaaacaatgagcttccagtcccatctggtggattcaacttcagctgaagatattttcctgagaagggacttgttggacgaagtagggtttatgccgggtgggcgttgggataaagtctggagggtcagttattgcaccttgtgtccttcgtggttcatgaggtgccggggagggtcagtctacgctaccaagtccaagtaagaagggactggtggattcaacagcagcataatgatcttttcagccgtgtttgttgtacttaaaatacataaagctggtggaaggttgtatatgttgcagtggcagggacacgggtatatggcgaggggtttttttctttaatgcggctttgagtgctgttttttatttgagtcctagttttattggtatgatttattgggtcagtatttgatttgggtaaatatatcatttccaaaccaattttatggtctattccaaattccaatcgaagaattagtgctatttttgtgcgtcattttgaagcttttgctacttgattatttcacccgcaacgcattggccact

SEQ ID NO: 4892 - DNA, 2278 bp, Catharanthus roseus
ttcactctctctcaaaatttacatccgcaatcgatttttcgtacattagttgattagtgatcacaaaacatatatatttacgtacactacccgcgctttcgtctatatacgtgtaaaattatctagggtttctaatcgatcgacgagaaccatgtcgttgaggccgaacgcgagaacagaagttcgccggagcaggtataaggtggccgtagatgcggaggaaggacggcggaggagagaggatgggatgatcgagatccggaagaacagaagagaggaaaacttgctaaagaagcgccgggagggtcttcaagcacagcaattccagaattcagtcaacgttactcaacttgaaaaaaagttagaaagccttccggctatggtcgctggtgtttggtctagtgatagcaacttacaactagaagccactacacaattccggaagctgctctcaatagagcgcaatcccccaattgaggaagtgattcaatcaggagttgttcctcgatttgtcgagttccttgctagagatgattacccccaacttcagtttgaggcagcttgggcccttaccaatattgcatctgggacgtctgaaaataccaaggtggtgattgatcacggtgctgtaccgatttttgtaagactgctgagttcgcaaagcgatgatgtccgtgaacaggcggtttgggcgttaggtaatgtggctggtgactctccaaaatgtcgtgaccttgtcctcaaccatggagccttgatgcctttgcttgcgcaattcaatgaacatgccaagctgtctatgttacgaaatgctacgtggacattgtcgaacttctgtaggggcaagccccagcctcagtttgaacagacaaaaccagctctccctactctggctcgtctaattcattcaaatgatgaagaagtactcactgatgcatgctgggcgctttcttatctctctgatggtacgaatgacaaaatccaagctgttattgaagctggtgtttgccctcgtcttgttgagcttctactccatccttcaccatcggttctcattcctgcactgcggacagttggtaatattgtcactggtgatgatatccagactcaggttatcattgacaatgaagctcttccttgtctgctcaacttgttgacacaaaatcataaaaagagcattaaaaaagaagcttgttggaccatttcaaatatcaccgcaggaaacagggagcagattcaggctgtgatccaagctggtattattgccccacttgtccaacttcttcaaaatgctgaatttgagattaaaaaggaggctgcttgggcaatctcaaatgctacatctggtggaactcatgagcagatcaagttcttggtgagccagggttgtattaaacctttgtgtgacctccttgtgtgtcctgacccaaggattgtcactgtctgcttggaagggcttgagaacattctgaaggttggagaagctgaaaagaaccttggtaatactggagatgttaatgtcttcgctcagatgattgatgaagctgaagggttggaaaagattgaaaacctccagagtcatgacaacaatgaaatatatgagaaggcggtgaagattctggaaacatattggttagaggaggatgatgagcagctaccttcaggcgacactccacaatctggattcagctttggcggtggtgagctccctgttccatctggaggattccagtttggttgaaggagtgcttcactgttgaaacatgagtttggttgcactggtctttgtgcgttacttgtcatctatataggtccggcttcacttgtgcttgagctcggcaccaaagcccatttggtgtggccaaataagaaagtgggtcatattgtatctttagcttggtagatgatacccctgtattttagggtccttaccatgcaagaaggttttgcttgaacattttagaatttctttttctttaaatctttatcctttggttcattgtaatggtttcatattattattattattacactattatttttgaagtattgagtatatgagtgattggggaatgccattagaagttgttggcttttccaatcacacttttgtgtcggtttattttataaaataaagtttgataagttataaatgtattttgtgttgtaatagttgatgatacttctgggaagacattcagtggtcttctatagtgaagcgactctttgccttggctcaggagcaggtatttatctgtatcatttttatggacctaaa

SEQ ID NO: 4893 - DNA, 2408 bp, Vinca minor
tctgtcagccagcagagggacaagaatctaccttactgcaacatccaagacgtccaactctctcctctcttcaagtacccgagagaaccttggagaattccttgtccaattttgcaaggatagatattcctagtcctagttcaacgagatccggtttacctccaaggccaaattctgccaggtttatgtcgtctatgcgaagcttgattccccagaagagcacccgggtaaagaacttttcacaagatggcgcagtctttcaaaaacattttcacctaatcaattctcttcttcttcttcgtagattaattgattattagtgatctcaacacagtgtaaatcaatcaaataatttaggatttacggtttgtaatcggatcgacgagaacagacaaccatgtcgctgaggccgaacgctagaacggaggttcgccggagtaggtataaggtcgccgttgatgcggaggaaggtcgccggagaagagaggatggaatggtcgagatccggaagaatagaagagaggaaagcttgctaaagaagcgccgggaaggtcttcaagctcagcaattccagaacacagtcaacgttactcaactcgaaaagaagttagaaagccttccggctatggttgctggtgtttggtctaatgatggaaatttacaactcgaagccactacacaatttcggaagctactttcaatagaacgcaatccgccaattgaggaagtgatacaatccggagttgttcctcgatttgtagagtttcttgctagagatgattaccctcaacttcagtttgaagcagcttgggctcttacaaatattgcatctgggacatctgaaaacaccaaggttgtaatggagcatggtgctgtaccaatttttgtaagactgttaagttcgcaaagtgatgatgttcgtgaacaggcagtttgggcattaggtaatgttgctggcgactctcccaaatgtcgggatcttgtcctcggctatggagctttgatgccattgcttgctcaattcaatgaacatgccaagttgtctatgttgcgaaatgctacatggacattgtcaaacttctgtaggggcaaaccccagcctcagtttgaacagacaaaaccagccctccctactcttgcgcgtcttatacattcaaatgatgaagaagttctcacagatgcttgctgggcgctttcgtatctctctgatggcacgaatgacaaaatccaagcagttattgaagctggtgtttgcccacgtcttgttgagcttttactccatccttcaccatctgttctcattcctgccctgcggacagtaggtaatattgtcactggtgatgatgcccagactcagcttatcattgataatgaagctcttccttgtctgctgaacttgttgacccaaagtcataaaaaaagcattaaaaaggaagcttgttggaccatatcaaatatcacagcaggaaataaggatcagattcaggctgtgattcaagctggtatttttgccccacttgtccaacttcttcaaaatgccgagttcgagattaaaaaagaggctgcttgggcaatttcgaatgccacatctggcggaacagatgagcagatcaagtacttggtgagccagggatgcattaaacctttgtgtgacctccttgtttgccctgacccaaggatagtcactgtctgtttggaagggcttgagaacattctgaaggttggagaagctgagaagaatctgggtactactggagatgttaatgtctttgctcagatgattgatgaagctgaaggtttggaaaagattgaaaatctccagagtcatgataacaatgaaatatatgagaaggcagtgaagattctggaaacatattggttagaggaggacgatgagcagctgccttctggtgatgctccacaacctgcattcaactttggaggtagtgagctccctgttccatctggaggattcaagtttggttgaaggagtccctcactgttgaaacatgggttgggttggacggatcttatgcgttgtctatataggtcttgcttcaccagtgcttgagattacaccaaagcctgtttggtctttcatggtggccgtattgtatgttaccttggtagatgatatccctatgttttaggatttttaccatgcaagaaggtttgcttaaacgctaaagatgttttattatttctttctttttcccgtctctcttttgaagttttgagtagatgattgagaatgctgttggaaattaggcttttccaatcacagtttgtgtcgggttattctacaaacaaaggatgataagatataaatgtatttttgggttattctctgagtcttcctgtatgcagcgactcttatcctctgcaggagttgtgtatgatctgtattt

SEQ ID NO: 4894 - DNA, 2618 bp, Phaseolus coccineus
accatgtccctctaattctcaatcgaaaacctagggtttctccttcattttcaattccgattcctttgatctttgattgttcttagggttaggattgttgttgttgcagtgaagatgtcgttgaggccaaatgctagaaccgaggttcgtcgcaaccgttacaaggtggcggtggacgctgacgagggtcggaggaggagggaggataacatggtggagatccggaagagtaagcgagaagagagcctccagaagaagcgccgtgaaggccttcaaactcagcaacagttccccactcctcttcaaacctccattgtcgagaagaagttagaaagccttcctgcgatggttgctggagtgtggtcggatgataacagccagcagttggaagcgaccacgcagtttcggaagctgctttcgattgagcgcagtcctcctattgaggaagttattcaagctggagttgtgcctcgatttgtggagtttcttgttagagaggatttccctcaacttcagtttgaggctgcatgggctctcacgaacatagcatctggaacttctgagaataccaaggtggtgattgatcatggggcagttccgatatttgtcaagctgcttagttcgcccagtgatgatgttcgggagcaggctgtgtgggcgttaggaaatgttgctggtgactcccccaggtgtcgtgatcttgttcttggccatggggcgttaatcccactgttggcccagttgaacgagcatgcaaaactttcaatgttaagaaatgcaacatggaccctgtcaaacttctgcaggggcaaaccacagcctccatttgagcaggtcagggcagcacttccagctcttgagcgattggtattttccaatgatgaagaggtcttaacagatgcatgctgggcgctatcatatctttctgatggaacaaatgacaaaatccaagctgttattgaggctggtgtatgtggcagactggtgcagctccttctgcacccatccccttcagtgctgattccggcactccgcacagtcggaaatattgtaaccggagatgatttgcagactcagactatcatcaatcatggtgctctcccatgtctgttgagcctgttgacacataatcataagaaaagcatcaagaaagaagcttgctggaccatatcgaacattacagctggaaacagagaacagatacaggctgttattgaagctggtctgattgccccacttgtcaatcttcttcaaaatgctgagtttgacattaaaaaggaagcggcttgggcaatctcaaatgctacatctggtggtacccatgagcagattaagtatttggtgagccagggttgcattaaacctctctgtgatctgcttgtttgtcccgacccaagaattgtcactgtctgtttagaaggtcttgagaacattctgaaggttggggaagctgagaagagcttgggtaacactggagatgttaacttgtatgctcagatgatagatgatgcagaaggattggagaaaatcgaaaacttgcagagtcatgacaacaatgaaatatatgaaaaggctgttaaaattcttgaaacatactggttggaagacgatgatgacacactacctacaggcgatggtgctcaacctggttttaactttggaaacgagcttccagtcccatctggtggattcaactttagttgaagactgttgtgtgggaacctggttggatggagcagggttgatgctagggtaactgttggagtcgagtctggggtggggttgagttgggttggggggcagggggtgagtttggtcagttcggtccatgcacttcatggtgtctggtttaagtctggtcttgtgtccgtggttaatggggtgctgggaagggtcagtttaactaccatgtccaaataagggtggtggtgggttcaacagcagcataatgaccttgttagcagtttatgttgtgttaaaattataaatatacatatatatatgtgctgtgggcataactattggaaggttctatgttgcagtagcagggaccgtattatatggcagtggatgggttttctcgaatgcggcttttgagtcctattttttattgagtcgtgtagttgtattggtaatttattcatacagagtcagtatttgatttgagtggatacacagtattcagaaaccgtggttgtattcaaatgaaagaattagcatatttttgtgcctgcatttctcctttgggctattctgaagccttttctctcgcacaattcacatcaggaatgcatagtgtcaataagaagcgaagcctaaatcgagattgctgcctgaagcactagaactctcattaggaaagctgcaatgtgtatgcccccaatgggaagaatgtgtatcaacaagtgtagtcaatttgtcaaaaagtatgttataacgatttgttatttttgtgaagtatgtctttttgcttaaagtccgtgcgatttcttgacagctcttctttgtgctcttctgatttgagttttaaagaaagatacggatattcagtaagtgttcaatttaaggtttattcggttgtcgagggttccagaatggcaaatactaaactttcataa

SEQ ID NO: 4895 - DNA, 1855 bp, Flaveria ramosissima
gatcgatcgacactagcgtactgtattgtaaaagcaacatccactcactataaaccctaatttctagggtttgttctttctagcacaatcaaacatgtcgttgaggcctagcgagagaacagacgctcgccggaaccgctacaaggttgcggtggacgccgacgagggtcgccggaggagggaggacaatatggttgagatccgtaagaatcggagggaggagagcttgcagaagaagagacgtgagggactcgctgcgagtcagtttcctctgccggttcaatctgcttccgctgccgaaaagaagttagaaaacctacctgcaatggtagcgggggtttggtcagatgacaataatatgcagcttgaggcaactacccagtttcgtaaactgttatcaatagaacgcagccctcccattgaagaagttattcaagctggtgttgttcctcgttttgttgagtttcttatgagggaggattttccccaactacagtttgaggcagcttgggctttgactaatattgcttcggggacatctgaccacacaaaagtggtgattgatcatggtgctgttcctatatttgtgaaacttcttgcatctcctagtgatgatgttcgggagcaggctgtatgggctttaggtaatgttgctggtgattcccctagatgtcgtgaccttgtacttggacaaggtgcattgattcctttgctggcccaactaaatgagcatgctaagttgtctatgttgcgaaatgccacatggaccctttccaatttttgtagaggcaagccacagccttcttttgatcagacaagacctgcgcttccagctcttcaacaacttattcattcaaatgatgaagaagttttgactgatgcttgttgggcgctttcatatctttcagatggtactaatgataaaatccaagctgtaattgaagcaaatgtgtgtcccagattggtagagttactaaatcatccatcgccttcagtactcatcccggctcttcgtacagttggcaacattgttactggtgatgatatgcaaactcagtatatcatcaatcatcaagcattgccctgtcttctgaaactgttgatcaataatcacaaaaagagcattaagaaggaagcttgctggactatatcaaacatcactgctggcaacaaggagcagattcagacagtgatcgatgcaaatatcattgggccgcttgttcatttacttcagaatgcagaatttgacatcaagaaggaggctgcatgggccatctcaaatgctacttctggtggaagtcatgaccagattaagtatcttgttagtcagggatgcatcaaacctttatgtgacttacttgtgtgtccagaccctagaatcgtgacagtttgtctagagggacttgagaacatattgaaagtgggtgaatcagagaagaatttgggaagatctggagatgtaaatctttatgcacagttgattgatgatgctgaaggattggagaaaattgagaacctacaaagccatgataacaatgagatttatgagaaagcagttaagcttcttgaaacatattggttggaagaagaggaggaggatgtgatgccgcctggcgaaacagcgcagccaggtttcaattttggtggtggtgatgtttctgttcccaatggtggcttcaacttcaactgattcaaagttggtcttattgaagcggtggcgttttaagtcaaagtagtagtattgcgggcagccatctatttcatgaggttcatttatgtagtgtggttgaagttttatggagtgattgaggtttttttacaatgaatatcactaaatgttgatgaattatgtaaa

SEQ ID NO: 4896 - DNA, 2392 bp, Citrullus lanatus
gcacgtcgatataaattcatgtgtagggttccccaacgttcactatcgtctctctctctctctctctctctcttccactgtgaaactcaaaactcaaatcaaaaagcttcgtaccaaattctccctctcttcttctccggcgaaccaaatccctcaatccttatcggaacatcgtagatttcctctactaatcggggtttgagttcgtctctttggtattcaaatcatgtcgctcagaccgaacgagagggctgaggttcggcggaaccggtacaaggttgcggtggatgccgatgaaggtcggagaagaagggaggacaacatggtcgagattcggaagaatcgtagagaggaaagcctgcagaagaagaggcgtgagggtcttcaagcccagcaactccaaacttcaactcactcatcggtagttgaaaagaagttggaacatcttccatccatggttgcgggtgtttggtctgatgatggcagtctgcaacttgagtcgactactcagtttaggaaactgctttcaattgagcgtagtcccccaattgaagaagttatacaggcaggagttgttcctcgttttgttgaatttctaatgagagaggattttccacaacttcagtttgaagctgcttgggctcttacaaatattgcttcgggaacatcagaaaacactaaggtggtcatcgatcatggtgctgtgccaatatttgtgaaacttcttggttctccaagtgatgatgtccgggagcaggctgtttgggcattaggtaatgttgctggggattcttcaagatgtcgtgatctggttctaggtcatggagctttgcttcctttattagcacagttgaacgagcaagctaagctctctatgctgagaaatgctacctggacgctatcaaatttttgcaggggcaagccacagcctgcttttgatctggtcaaaccagcacttccagctcttgcacgtcttattcattcaaatgatgaagaagttttgactgatgcttgctgggcactctcatacctttctgatggcacaaacgacaaaatccaagctgttattgaggcaggtgtttgccctcgtctcgtcgagctcttaatgcatcctgctccttcagtgctcattcctgcccttcgaactgttggaaacatcgtcactggcgatgatttgcaaactcaggttatcatccaacataatgccctgccttgcctgctaaatttgttgactaataatcataagaagagcatcaagaaagaggcttgctggactatatctaatataacagccgggaacaaggcacagattcaggccgttatagatgccaatatagttgctccccttgttcatttgctccaaaatgctgaatttgatattaagaaagaggctgcatgggcaatctcaaatgccacatctggaggctctcacgatcagatcaagtacctagtaagtcaagggtgtatcaaacctctgtgcgatcttctaatttgccctgatcctaggattgtcacggtttgtttggaaggacttgaaaatatcttgaaggtaggagaagctgaaaagaacacaagtgatacaggaggcgttaatctttatgctcaattgatcgatgatgctgaggggctagagaaaattgagaacctacagagtcatgacaacactgaaatttatgagaaggcagtgaagatccttgagacctactggttggaagaggaagatgagactatgccaccaggtactgcttcgcaagctggattcagttttggtggcgatcggcctgtcgtaccatctgggggattcaactttggctaaaaaggctttcccgtggggttatatcgacaacatctccagtcacatcgggtcaggtcaggcgtgttatgtcgttgtttggctatgcttatcccagtcgcagttgttatttagagtgttggtggaatgggttggatgctttttacatgagttggggattgactggtgatgagacagtggaatatatatactatatcaattggtaatatagtttccacagatctaagaaatcggagcgatttcgtttggcaaactctgattttttattgtttttttcttagttggtctacttgtcataaacatggagtctaagcattgttttttcccccatttacactattacgctcttatcattttttgttcatagtttttccagagagtaacttttagatttatagcagataccattttggctagctggcgtctatatgttgttattttaaacaacacatgcaagaaattttggtactattctctttgatttctctttctgctacatcgtgacttgaaaacctaaatatttcaaccttgctgcttttttatttgacaatgttgatacatgacacaaaactgagaagg

SEQ ID NO: 4897 - DNA, 2318 bp, Prunus persica
ctcagttcctctctctctctctctctctctctctctctctctctctgtggaatactcagaaaagtccatttcttagggtttttaactgctctccttctccgtctacgaccggttggtcccaatcagagcacgatcagatttttgggttgttcccagtgagacgcagtcaaagcatacgacatgtcgctgaggccgagcgccagaaccgaggtccgccggaaccggtacaaagtggcggtggacgcagaggaaggtcgtcgtaggagagaggacaacatggtggagatccgaaaaagcaagcgcgaagagagtttgctgaagaagcgtcgcgaaggcctccaatcccagcaattcgcacccgctcttcagccctcaaatgtcgagaagaagttggagagtctgccttcgatggtttctggggtttggtctgacaacaataatttgcaactggaggccactacacagtttcgaaagctgctttctattgaacgaagccctccaattgaggaagtcattcaatctggggtggttcctcgctttgttgagttcctcatgagggaggatttcccacaacttcagtttgaggctgcttgggctcttacaaacatagcgtcaggaacctcagagaacaccaaggtggtgatcgaacatggggcagtcccaatattcgtaaagcttcttgcttctccaagtgatgatgttagggagcaggctgtgtgggcattgggaaatgttgctggtgattcccctagatgccgtgatcttgtcctcggcaacggagctttgatgccattgctggctcagttgaatgagcatgcaaagctttcgatgctgagaaatgcaacatggacactgtctaacttttgcaggggcaagccacagcctccatttgaccaggtgaggccagcacttccagcgcttgagtgtttagttcattccaatgatgaagaagtcttgacagatgcctgctgggcactgtcgtatctctccgatggtacaaatgacaaaattcaagccgtgattgaggcaggcgtctgcacccgacttgtgcagctccttttacatccatctccttcggttctcattcctgcacttcgtactgttggtaatattgtgacaggagatgatcttcagactcagtgtattatcaacaatggtgcactcccatgccttctgagtctattgactcataatcataaaaagagcatcaagaaagaagcatgctggacaatctcaaatattacagctggaaacagggaacagatacagtctgtaattgacgctagtttgattggccctctggtcaatttgctccaaaatgctgagtttgacataaagaaagaagctgcatgggcaatctcaaatgctacttctggcggcactcctgagcaaatcaagtaccttgttggcgaaggctgtataaaaccattgtgcgatcttcttgtatgccctgatccaagaattgtcaccgtctgtttagaaggtttggagaacattctgaaagttggggaagctgaaaagaatgctggtaacactggagaagttaacttgtatgcccagttgattgatgatgctgagggcctagaaaagattgaaaatctacagagtcatgacaacactgagatctatgagaaggcagttaaaattcttgagacatattgggtggaggaagatgatgagacattaccatcaggagatggttcccagccaggcttccactttggagggaacgaacttcaagttccatctggtggattcaactttagctgaaggagcatttacttgaatgcagcagaagttcctggtgattttgttgggtcaagtcggggtcaagttggggtcaagttgaagtgggtcggggcatcccgtgtgtctggtttcagtctggtctggtgtccattgtgatcagaggtgccaaggtgggtcaatgtattctaatatgaccaaataagaagagatgggtgggttcaattgtggcacatgaagtttggtcggcagggatcattatcactgcctcgtaccatgaaatactatggaagtgtcctagaggctctttgttgcatcgaaggcccttaaatgaatgtgctggtgagggtttcttgaatgcagcatggagttcgattttttttttctttctataatttggagtcatagtttgtacgggtatttttctaaagagtcgggatttgttttgccttgtggagtgaatatagattttatgaacgttcattttctggtgtattgcaaggaaaagattagtgttttggtaattaccttgtgattattgtattatattttttttagtacgaatttctttc

SEQ ID NO: 4898 - DNA, 2738 bp, Sequoia sempervirens
agcgccaggaggctagggtttttttgatttttcgctctctgcgttttatcaagggtttgaaattcctgattttttagcagttagggtttctagggtttgaaggttgttcttccggagccgagtggggttttacagtttgtttcagccatgtcgctgaggcccgtttcgaggactgaggtccgtaggaagaattataaggtggccgttgatgccgatgaagcgcgccggaagcgtgaggataatatggtggagatcaggaagaataagagggaagaaagcttgctaaaaaagagaagagaaggtatgcaagcgcagcagtttgctccagctgtacagtcgtcggccgttgagaagaagttggagagccttcctgctatggtagctggagtatggtctgatgatcctagtttgcagcttgaagcaacaactcaattccggaagctactatcaattgagcgtagtcctccaattgaggaagttatagaagcgggtgttgtcccacgttttgtagagtttctgacaaggcaggactttccccaacttcagtttgaggcagcatgggcattgacaaatatagcttcaggcacatctgatcatactcgagtagtcattgaccatggagctgtaccaatttttgtacaactccttagttctccaagtgatgatgttcgggagcaggctgtctgggcattgggtaatgtggctggtgactccccaaagtgcagagatctagttctttctcatggtgctctcatgccacttcttgctcaattgaatgaacatgctaagctttcaatgttgagaaatgcaacatggactttgtctaatttctgccgaggcaaaccacaaccagcgtttgaacaaacaaagcctgctctacctgcacttgagcggcttattcattcgaacgatgaagaagttttaacagatgcttgctgggctctgtcttatctctctgatgggacaaatgataaaattcaagctgtgattgaggctggtgtctgtcgtaggcttgttgagctcctgctccatccctctccatctgtccttattccagctctccgaacagtgggcaatattgtaactggtgatgatatgcagactcagtacataatcaacaatcaagcacttccttgcctgctagctctcctaacccataatcacaagaagagcatcaagaaggaagcttgctggaccatttcaaacataaccgcaggcaacaaagaacagattcaggctgtgatcgatgcaaacatcattcctccacttgttcagctccttcaaactgctgagtttgatattaagaaagaagcagcatgggccatatcaaatgcaacttctggtggtacacatgaacagatcaagtatttggtgaatcaaggatgcattaagcctctgtgtgaccttttagtctgtccagatccaaggattattactgtttgtcttgaaggactagagaatattttgaaagttggagaagctgagaaggatcttggtaatacaggaggtgtgaatctatatgcccagtatatcgatgatgctgaaggacttgagaagattgagaacttgcaaagccatgataacaatgagatttatgagaaagcagtaaaaatattagaaacatactggctggaagatgaagaagatgatcaagctttacctgctggaagtgatgctgctcagccaacattcaattttggtgccaatcaaccaacagtgccatctggtggattcaactttggttgaaaagggatttgagctgatgcaacttggggggctatgctatgggtgttaagagactgtttccaatatctcttatctatatgttggagtccgtcattgcaaggaaaaatgcttggtttttggatggtgctggtgacaggctatttctgttgggatgtcagtctgacaatgctaaccaaatcatgcagacatgagctcctcggaattaatgggtcagcatttgttggtttggtagtacagttttcatgctgtattatggtctttgtccatatgctatgttaaagttgcaataattagataaatggactgtctgacgagccacctcatgtcctttatagctctgtaacagagctttttgttgtccgtgtcatgtgccatgcctcttggcatttggacaattacttggacaggtctcaagggtcatactaacactggttatgcatgcattgtattcattgcatcaagaaagtgagtcgtcatgttatgtatatgacacttaccggtcagtcttgtggccacagaaaaatggcctaccactaatcttgggtttcaggacaatcctgaatccctaaaatgcatgcctatagtgcatcctcactctaggaattcgccttgagttttcttggaccataaactttttaagttgaagtccacttttccactaacctccatctctcttctccctgaatgtgtcaatctgtgcatttgcagttgccccatcatcttcttggagtcagtttaaagggattttctattttttatctttattttcgtagtttacagttcctgtcgccagttctcatcctatttgggttgctatacgccttttttggacagttctatgcacttgaatgtatatcagtttccaaagagttttggggactattttgtcaattgttgattatctatttgtaatgaattgaaagtttactagtaatgatcctatatttaaagacattgggtatttgtttgaaaatattatataaaacgaggcc

SEQ ID NO: 4899 - DNA, 2408 bp, Chelidonium majus
ccccgactccccacactcatcagaaacaaccccctcctctctctctctctactttctctctctagatttttaactgtgattctagggtttcgttgatcgagcaaacatgtctctccgacctaacgcgagaactgaagttcgacggaaccgatacaaggtggccgttgatgctgatgaaggtaggagaagaagagaagataatatggttgagatccgaaagaataaaagagaagaaagcttacagaagaagaggagagaaggtatgcaagcacagcaatttccatctgcgattcagggcaccgccgttgagaaaaagctagaaagtttaccttctatggttgctggtgtttggtcggaggaaagagagttacagcttgaagctactactcagttcaggaaactactttcaatcgaacgtagccctccaatcgaggaagttatccaatcaggtgttgttccacgatttgtggagtttctcatgagagaagattacccacagctccagtttgaggcagcttgggcacttacaaatattgcttccggaacatcggagaacaccaaggttgtaattgatcatggggcagtccctatctttgttaaacttcttgcttctcaaagtgacgatgttcgtgaacaggctgtatgggcgcttggaaatgttgctggtgattccccaagatgtcgtgatttagttctcggacatggagccttgcttccattgcttgctcaattgaatgagcatgctaagctttctatgctgagaaatgccacctggactctgtcaaacttctgtaggggcaaacctcaacctccatttgagcagacaaggccagcacttccagctcttgaacgtcttattcattcaaccgatgaggaagtcctgacagatgcttgctgggcactttcttatttgtctgatggtacaaatgataagatccaagctgttattgaagcaggtgtctgccctcgcctagttgaactcctgttgcacccgtcaccttcagtgctcattcctgctcttcgcacggttggaaatattgtgactggagatgatgttcagactcagattattatcaaccatcaagcacttccttgccttctgaacctactgacaaacaatcacaagaagagcatcaagaaggaagcttgctggaccatttcaaacattacagctgggaacaaggatcagatacaggctgtaattgcagctgatatcataggccctctaatcaatctgcttcaaactgctgaatttgatatcaagaaagaagctgcatgggcaatctcaaatgctacttctggtggcactcatgagcaaatcaaatacttggtggcccagggttgtatcaagccattgtgtgatctccttgtctgcccagacccaagaattgttactgtttgtttagaaggtctggagaatattttgaaggttggtgaagctgagaagaacttggggaatagtggtgatgtcaacatttatgcacagttgattgacgatgctgagggtttagagaagatcgaaaatctgcagagtcatgacaataccgagatctatgagaaggcagtcaagattctcgagacttattggttggaagaggatgatgagccattgccccctggtgatgctgctgcacaacctgggttccgctttggaggcaacgaacttccagttccttctggtggattcaacttcagctgaaggtatcgatctcttgatttcagtgggagtagtatgaagtccaggtcaggtataacaagcttatatttggaggtcgagtcgagggcatctcgttggtggtgtgtcatcaggtccgtctgtccagtctaaggtggtgggtgaaggacagctgaagtctgtgggggtcatatagtggtggttgaataatagtagccgggtaggggttcctaacgaggagacatcttttagccaaaggcatgtatacaatatttgggaattgtctggtctggtgcttttattctctctacaggcaaaatgagttggaaggaagggaaatggaatctcctattatgtagtaaggaggctccagaaaggtgataattgagtccaggttcttttattctttctttttatttgtttttagttttagtagagagttgtatgagtagtcggtcggtctaggtttagcagtctgttgtaagttgtctttgttgtttccgtcaaaacctctttgcctggttgtacagcgaggaggaggaagaaagaaagaacagagagaaagggtaagtggtttgtctcttttattggtccgtcagttggtcggttcttgtttcattattattcttgatttgcattgcttttgattcgaaaggggggaattgagtcccttgatcccccttctagagagaaaatatttgtttgttttgtcatgtcaaagatactcaacaaa

SEQ ID NO: 4900 - DNA, 2289 bp, Prunus persica
caaaccactacgaagtcccaactaaacaatccaccctctctctctctctctctctctctctctctctcgtgctctaaaaccctatcgccctccatctgtctgcctctctcttagggtttcagattcttattttcattgaaccgatacgatgtcgttgaggccgaacgcgagggcggaggtccgccgtaacaggtataaggtggccgtggacgcggaggagggtcgtcggcggagggaggacaacatggtggagatcaggaagaatcgcagagaagaaagcctccagaagaaacgtcgcgagggccttcaacctccgcaattgtcctctaatcttcactcctccggcctagagaagaagctagagcatctaccatctatggttgctggtgtttggagtgatgagagcagtctgcagcttgaggcaactactcaatttaggaagttgctttcaattgaacgtagccctccgattgaggaagtcatacaatcgggtgttgttcctcgctttgttgagtttctaatgagggaggattttccacaacttcagtttgaggcagcttgggctctgacaaacattgcttctgggacatctgagaacactaaggtggtgattgatcatggagctgttccaatatttgtgaaactgcttagttctccaagtgatgatgtccgtgagcaggctgtctgggcattgggaaatgttgctggtgattcccctagatgccgtgatcttgtactcggcaatggggctttgattccattactttcacagctgaatgagcatgcaaagctctctatgctgagaaacgctacttggacactctcaaacttttgcaggggcaaaccacagcctccatttgaccaggttaagcctgccctgccagctcttgcacgtttgattcattcaaatgatgaagaagtattgaccgatgcctgctgggctctgtcttatctttctgatggtacaaatgacaaaatccaagctgttattgaatctggagtatgccccaggcttgttgagcttttacttcatccatctccttcagtactcattcctgccctccgcacagttggaaatattgttactggagatgatatgcaaactcaggttatcatccaacatcaagctcttccttgcctgctgacccttttgactaataattataaaaagagcatcaagaaggaagcttgctggactatttcaaatatcacagccggaaacaaggatcagattaaggctgtaattgatgctggtataatcggtcctcttgttagtctgcttcaaggtgctgagtttgatataaagaaagaggctgcttgggcaatctcgaatgctacatctggtggttctcatgagcagataaagatcctagtagatcaagggtgtatcaagccattgtgtgatcttcttatctgccccgatcctagaattgttacggtttgcttagaaggcctggagaacatattgaaggttggagaagctgagaagaacttgggcactactggaggtgtaaatctctatgctcaggcgattgatgatgcagaagggttagagaaaattgagaatctacagagtcatgacaacactgagatttatgagaaagcagtaaagattcttgagacatattgggtggaggatgaagatgaaacaatgccaccaggcgatgcttctcaaactgggttcaactttggagggaatggcatgccaactgtcccgtccggcggattcaacttcagctagagaaatcctcctcattacacagtgaagtccttgagtatggcaaggcaataatccagtcaagtcaggtcaggtcaggtcaggcgtctttatatgttcgggtcctgtttgtagggttttttgttgggtggctggctcaggtgtttgctggtttaaactggttctggctaccatgggttgattatatgatggacatctatctgcaacaaagattgaaagaaaaaagaaaaaaccggagttagtttttcgaagagtagtcgggctatcctatgaagcaagatgctaagagtttttgttattttgttttccatttgtttagttgtgtcatataagtgggtattggtcggtcacatgtcctacagttgttcacaagtgttttggaactcccaaacttgcattataattttccttcattccaacctagtgcaaggatttctattcctgtcgagattgtatgttatgtgttgttgagtcgtttccctttttgggctccagatttgttgttgggtcaaatatattgccaaatggtatacctttttattggttatata

SEQ ID NO: 4901 - DNA, 3002 bp, Cephalotaxus harringtonia
cgcatttctgcgggtttattttcagtacaaaaaccgggcgttttctctccattttgttatcaatcttcgtgggctctttccttttttgagagcaggttcgaatcgcaggagattagggcttttttcctcggcgatttttagggttttaaactcctgttgtatttcagcagattagggttcgtagggtttgaagctcctttttccagccatgtcgttgaggccggtctcgaggactgaggtccgcaggaagaactataaggtggccgtggatgccgatgaagcgcgccggaaacgtgaagataatatggtggagatcagaaaaaataagagggaagaaagtctgctgaagaagaggagagagggcatgcaagcgcagcagtttgctcctgcggtgcagtcatcggccgttgagaaaaagttggagagccttccagccatggttgccggagtatggtctgatgatcatgctttgcagcttgaagcaacaactcaattccggaagctactatcaattgagcgcagtcctcccattgaggaagtaattgaagcaggcgttgttccacgatttgtggagttcctgatgaggcaggactttccacagcttcagtttgaggcagcatgggcattgacaaatatagcttcgggaacatctgagcatactcgagtagtcattgaccatggagcagtaccaatttttgtacaactcctcagttctccaagtgacgatgttcgggagcaggctgtctgggcattgggtaatgtggctggtgactcccccaagtgcagagatctagttcttactcatggtgctctcatgccacttcttgctcaattgaatgagcatgctaagctttcaatgttgagaaacgcaacatggactttatctaatttctgccgaggcaaaccacaaccagcatttgagcaaacaaagccagcccttcctgcacttgagcggcttattcattcaaatgatgaagaagtcttgacagatgcttgttgggctctgtcttatctttctgatgggacaaatgataaaattcaagctgtgatcgaggctggtgtctgtcgcaggcttgttgagctcctactccatccctctccatctgttcttattccagctctccgaacagtgggcaatattgtaactggtgatgatgtacagactcagtacatcatcaacaaccaagcactcccttgtctcttagctctcttgacccataatcacaagaagagtatcaagaaggaagcatgctggactatctcaaacatcaccgcaggcaacaaagaacagattcaggctgtgatcgatgcaaatatcattcctccacttgtgcagctccttcagactgccgagtttgatatcaagaaagaagcagcatgggctatatcaaatgcaacttctgggggtacacatgaacagatcaagtatctggtgaatcaaggatgcattaagcctctgtgtgaccttttagtctgtccagacccaagaattattacagtttgtcttgaaggactggagaacattttgaaggttggagaagctgagaaggacctcggtaacactggtggtgtgaatctatatgcccaatatattgatgatgctgaaggacttgagaagattgagaacctgcagagtcatgataacaacgaaatttatgagaaagcagtaaaaattctggaaacttactggttagaagatgaagaagatgatcaagcattacctgctggcggcgatgtttctcagccaacattcaattttggggcaaatcaaccagcggtgccatctggtggattcaactttggttgaggagggatttgagctgttgcaagttgggggggggctatactatgggtgtttcaaatgactgtttccaagatcttttatctatgctgtagtccgccattgcaaggaaaatgcttggtttgtggatggtgctggtgacaggctatttctgttggtatgtcaggctgacaatactaactaaatcatgcacacatgagctcctcgaaattaatgggtcagccttatttggcttggtagtacagttttcatgctgtattatatggtctttgtccataagttacagtaaagttgcaataattagataaatggactgtctgatgagccatcttctgtccttcatagctctatacgagagcttattgctgtcgagtcaagtgccatgcctcttttggtatttggacaatcattttgacgggtctcaagggtcatactaatctggttttgcttgcattgcattcttctttgcatcgggaaagtgagttgtcagttttgacacatcatgcttacaagtcagtctgtggccagtgggaaaatggcctatcactaaccttgggttgcaggacaatcctaaatccctatgtatgcatgtctagcatgcatcttgatattctctaggaatttttacctggagtctcttttggactatcaacttgtaagttgatgtccactgacccccatctctcttcctccctttttatgtgtcagtctgcatttgcaattgttttatcttctggaagcctgttcaaatgggattccctacttatttgctactttctcagtgtcgcctctgtgcatttgtaattgttccatcttgtggaagcctcttcaaagggatttcctacttatttgctactctctctgtgtctcctctccctgttgccagttgtcattctataaaggttgctatacacctttttttggacagttctatgtagttgcatgtatatttgtccccaaagaattttggagattattttgccaattgttagtattctactggtaatgaattgaaagttttattggtgatggttggatattttgagaagatattgggatggtgatactgggaattgttttgataatattagatatatgatgagatatcatgataatttgtccttctacagaactctttagttgctacaattaaatgtttcgcttagtgcttattcagatgatttagtatggtggatgcgat

SEQ ID NO: 4902 - DNA, 1692 bp, Medicago truncatula
tctcaatcgaaaattagggtttttaattttcagttcccaaatcgcattttcaccttcgattggtgttgccacctagccctacttcgaaacgatgtcgctcagacccaatgcaagaacagaggttcgtcgcaaccgttacaaagttgccgtcgatgccgatgaaggtcgccggagaagagaggataacatggtcgagatccgtaaaagtaagcgtgaagaaagtctcttgaagaaacgtcgtgaaggtcttcaaaatcaaccgcagtttactcctcttcaatcttcctccattgtcgagaaaaagttggagagtcttcctgcaatggttgctggtgtttggtcagatgataataatcaacaacttgaagcaactacgcaatttcggaagcttctttccatagagcgaagccctccgattgaggaagttattcaatctggtgttgttccccgctttgttcagtttctagttcgggaggattttccccaacttcagtttgaggctgcttgggctcttacaaacatagcatccggaacttctgagaatactaaggtggtaattgatcatggggcagtgccgatatttgtgaagctacttagttctccaagtgatgatgttcgggagcaggctgtgtgggcattgggaaatgttgctggtgattcacctaggtgccgcgatcttgttcttagccatggtgccctgatcccgctgttaacccagttgaatgagcaggcaaagctttcaatgctgagaaatgccacatggactctgtcaaacttttgcaggggcaagccacaacctccatttgatcaggtgaggccagcacttccggctcttgagcgtttggttttttcaaatgatgaagaagtcctgacagatgcatgctgggcactctcttatctttctgatggaacaaatgacaaaatccaagcggtgattgaggcaggtgtatgtggcagactagtgcagctccttctgcacccatctccttcagtgctgatccctgcacttcgcacggtgggaaatattgttacgggagatgatgcacagactcaggctattattggtcatggttcactcccatgtcttttgagcctgttgacccataatcacaagaaaagtattaagaaagaagcttgctggactatatcaaacattacagctggaaacaaagagcagatacaggctgttattgaagccggactgattgctcctctggtcaatcttcttcaaaatgccgaatttgacattaaaaaagaagctgcatgggcactctccaatgctacatctggcggtacccatgagcaaatcaagtacttggtgagccagggttgcattaagcctctgtgtgatcttcttgtttgccccgatccaagaattgttaccgtctgtttagaaggtcttgagaatattctgaagattggagaagcagagaaaagctttggtaacgcgggagatgtcaacttgtatgctcagatgatagatgaggcggagggattggaaaagattgagaacctgcagagtcatgacaacaatgaaatttacgagaaggctgttaaaattctcgagacatattggttggaagatgaagacgagacactaccaccaggcgatggttctcaacctggttttaattttggaggcaatgaccttccggtcccatctggtggatttaacttcggttaaagacttct

SEQ ID NO: 4903 - DNA, 2263 bp, Medicago truncatula
tctctctctctctcttaattctcaatcgaaaattagggtttttaattttcagttcccaaatcgcattttcaccttcgattggtgttgccacctagccctacttcgaaacgatgtcgctcagacccaatgcaagaacagaggttcgtcgcaaccgttacaaagttgccgtcgatgccgatgaaggtcgccggagaagagaggataacatggtcgagatccgtaaaagtaagcgtgaagaaagtctcttgaagaaacgtcgtgaaggtcttcaaaatcaaccgcagtttactcctcttcaatcttcctccattgtcgagaaaaagttggagagtcttcctgcaatggttgctggtgtttggtcagatgataataatcaacaacttgaagcaactacgcaatttcggaagcttctttccatagagcgaagccctccgattgaggaagttattcaatctggtgttgttccccgctttgttcagtttctagttcgggaggattttccccaacttcagtttgaggctgcttgggctcttacaaacatagcatccggaacttctgagaatactaaggtggtaattgatcatggggcagtgccgatatttgtgaagctacttagttctccaagtgatgatgttcgggagcaggctgtgtgggcattgggaaatgttgctggtgattcacctaggtgccgcgatcttgttcttagccatggtgccctgatcccgctgttaacccagttgaatgagcaggcaaagctttcaatgctgagaaatgccacatggactctgtcaaacttttgcaggggcaagccacaacctccatttgatcaggtgaggccagcacttccggctcttgagcgtttggttttttcaaatgatgaagaagtcctgacagatgcatgctgggcactctcttatctttctgatggaacaaatgacaaaatccaagcggtgattgaggcaggtgtatgtggcagactagtgcagctccttctgcacccatctccttcagtgctgatccctgcacttcgcacggtgggaaatattgttacgggagatgatgcacagactcaggctattattggtcatggttcactcccatgtcttttgagcctgttgacccataatcacaagaaaagtattaagaaagaagcttgctggactatatcaaacattacagctggaaacaaagagcagatacaggctgttattgaagccggactgattgctcctctggtcaatcttcttcaaaatgccgaatttgacattaaaaaagaagctgcatgggcactctccaatgctacatctggcggtacccatgagcaaatcaagtacttggtgagccagggttgcattaagcctctgtgtgatcttcttgtttgccccgatccaagaattgttaccgtctgtttagaaggtcttgagaatattctgaagattggagaagcagagaaaagctttggtaacgcgggagatgtcaacttgtatgctcagatgatagatgaggcggagggattggaaaagattgagaacctgcagagtcatgacaacaatgaaatttacgagaaggctgttaaaattctcgagacatattggttggaagatgaagacgagacactaccaccaggcgatggttctcaacctggttttaattttggaggcaatgaccttccggtcccatctggtggatttaacttcggttaaagacttcttgagtagtgggtaaatatgcctcagttgtctttactttttccctagggggttataatcatagtttacatccaagtccaacttaattattggtatgttgtctaaacaaactgctttccaataattgtaggaaggaactgtgttggatgcagcagggtactgttggcgttgagtccgggtggggtgggggagggggggcgtcggtctttgtacttcatggtgtctggtgtcagtctggtctagtgtctgtaatgaagtactggggtgggtcagtctaaactgccatgtccaaataagaaggggggtggtgggttcagctagctgcatactttgagcatcacaagaaatatatttgctggggagaaagtatgttgcagtagcaagtacccgttttgtgtggcaattggggagggttttcttttaaatggctttgagagtcctattttttatcgagtcgtagtttgtattggtaatttataccgagtctattttattttgattgaatacagtgtctgagaaacaaattttatggtgtattcttgcacttacatatt

SEQ ID NO: 4904 - DNA, 1848 bp, Trifolium pratense
ggcacgaggtcattcatcaatcaaatcaatagagcagtgcagtgttcactgcgtgcttcttcctctttctcgttctcattcacttctcatcaatacgatgtcgtatcgcccaaacgcaaactccaggaccgaggtccgtcgcaatcgatacaaagtcgctgtcgatgctgaagaaggtcgccgacgccgtgaggacaccatggttgagatccgtaagaatcgtagagaagaaagtttgatgaaaaagagacgcgaaggtcttccacctcagcagattccttcttctcttcactccaccgtcgtagagaagaagttggaaaatttaccatccatggttgctagtgcttggagcgatgataataacttgcagcttgaggcaacaactcagtttcgaaagctgctttctattgaacgtactccaccgatcgaggaggttatacagactggtgtagtttctcgttttgttgagtttctgatgagggaggattttccacagttgcagtttgaggcagcttgggctttgacaaatatcgcttctggaacgtctgaaaacactaaggtggtaattgaccatggggctgtcccaatttttgtgaagctccttgcttcttctagtgatgatgttcgtgaacaggcagtgtgggctttaggaaatgttgctggggattctcccagatgccgtgatcttgttctcggtcatggagccttggttcctcttttggcacaattgaatgaacatgccaagctttctatgctgaggaatgctacctggacactttctaacttctgcaggggcaagccacagcctccttttgatcaggttaaacctgcacttcctgcccttgctggtcttattcattcaaatgatgaagaagtcttaactgatgcctgctgggccctttcatatctttctgatggtacaaatgataaaattcaagctgtaattgaagctggtgtttgtcctcgactggttgagcttctactgcacccatctccttcagtgctaattcctgctcttcgtactgttggaaacattgtcactggagatgatcagcaaactcaggttatcatcaatcatcagtctcttccttgcctattcaatctgctgaccaataattataaaaaaagcatcaagaaggaagcttgttggaccatatcaaacattacagctgggaataaacagcagattcaggctgtgattgagggcaatatattcggtcctttggtgaacctgcttcaaaatgctgaatttgatattaagaaagaggctgcttgggctatctcaaatgctacatctggtggatctcacgaacaaatcaagtacctagtaagtcaggggtgtattaagcccttgtgtgatcttcttatctgtcccgatcctaggattgtgacagtttgtctggaaggcctggaaaacatcttgaaggttggagaagctgataagaatataggcaatactggtgacgtgaacctatatgcccaaatgattgatgatgctgagggtttggagaaaattgagaacctccagagtcatgataacacagagatttatgaaaaggctgtgaagattcttgagacatactggttggaggaagaagatgagactatgcctccaggggaagccgcacaatcaggattcaactttggtggcgcagaggttccttctgtgccttctggaggattcaacttcaatcagtagatgttcatgctttaacggggacatgtcttctatatttagccttttctggtttgtctacaatttttttggatgaaattattagtagtaatttgcatgcctgtattctcaagatttgtttggagtttattaagaattttgttaactgcagg

SEQ ID NO: 4905 - DNA, 2069 bp, Ambrosia trifida
cccatctctctttagtcatcccacaaacctccagtcctatataacctcctccatcttcaactgatcactaccagtgtatatcatatacacacaccatcactctcttaaaaaccctaatatctagggtttgtttattatcaccaccatgtcgctgagacctagcgacagaaccgaccttcgccggaaccggtacaaggtcgccgtcgacgccgatgaagggcggcggaggagagaagacaacatggttgagatccgtaagaatcgaagagaagagagcttgcagaagaagcgacgtgaaggactcgctgctaatcagtttcctgttcctgttcagtccgcttccgttggtgaaaagaagttagaaaatctacctgcaatggttgcggggctttactcagatgatagcagtatgcagctagaggctactacccagtttcgtaaactgttatcaatagaacgcagccctcccattgaagaagttattaaaactggcgttgttccccgctttgttcagtttcttatgagggaggaatacgcccaactacagtttgagtcagcttgggctttgactaatatcgcttctgggacatctgaacacacaaaagtggtgattgatcatggtgctgttcctatatttgtgaaacttcttgcatcttctagtgatgatgttcgggaacaggctgtatgggctctgggtaatgttgctggtgattcccctaaatgccgtgaccttgtacttgctgaaggtgctttgcagtctttgctgttactgttaaatgcgaatgctaagctgtctatgttacgaaatgccacatggacactttcaaatttctgtaggggcaagccacaacctgcatttgaacagacaaaacctgcgcttccagctcttcaacaacttattcattcaaatgatgaagaagttttgactgatgcttgttgggcgctttcgtatctttcagacggtacaaatgataaaatccaagctgtaatagaatcgaatgtatgtcccagattggtcgagttactaaatcacccatcacctacagtactcattcctgctcttcgtacagttggcaacattgtcaccggtgatgatatgcaaactcagtatatcattgaccatcaagctctgccatgtctgttgaatctgttgaccaataatcacaaaaagagcattaagaaggaagcttgttggactatatcaaacatcactgctggcaacaaggagcagattcagacggtgattgcagcaaatctcatcgggccccttgttcaattacttcagagtgcagaattcgacataaaaaaggaggctgcatgggccatctcaaatgctacttctggtggaagccatgatcaaattaagtaccttgttagtcagggatgtattaaacctttatgcgacctacttgtgtgtccagaccctagaattgtaacagtttgtctagaggggcttgagaacattctgaaagtgggtgaatctgagaagaatttgggaaggtccggggacacaaatctatatgcacaaatgattgatgatgctgaaggattggagaaaattgagaacctacaaagtcatgataacaatgagatctatgagaaggcagttaagcttcttgaaacatattgggtggaggaagaggacgacgatgtaatgccacctggcgaaattgcacagcccggttttaattttggtggtggtgatgttgctgttcctaatggtggctttaacttcaactaattcaaggtcggtcttgttgaagtcggggaggttaacttagtgttgcaggcatttatccgttttcatggggttcgttattgtagtgtggttgaagtttatggagtgattcagagtttttttttacaatgaatttcacttaaatgttgatgaatcatgtaaaagtaatatggtattttctctttttggacagttgaattgggatttatagaatttcccttcttttgcaactatctacccttttatttgtttttctttcatcttttttgttatctgctctgaaatttcaaagaatatatattacatattaacattttttataaaaaagaag

SEQ ID NO: 4906 - DNA, 2351 bp, Cucumis melo
ccaatttctccctctcttcttctccggcgaaccaaatccttaatcctcatcggagcatcgtagatttcctctactaatcgggaaggggtttgagttcaaatcatgtcgcttagacccaacgagagggctgaggttcggcggaaccggtacaaggttgcggtggatgctgatgaaggtcggagaagaagggaggataatatggttgagattcggaagaatcgaagagaggagagtctgcagaagaaaaggcgtgagggtcttcaagcccagcaactccaaacttccactcactcatcggcagtagaaaagaagttggaacatcttccttccatggttgcgggtgtttggtctgatgatggtagtctgcaacttgaatccactactcagtttaggaaacttctttcgattgagcgtagtcccccaattgaagaagttatacaggcaggagttgttcctcgttttgttgaatttctaatgagagaggattttccacaacttcagtttgaagctgcttgggctcttacaaacattgcttcgggaacatcagaaaacactaaggtggtcatcgatcatggtgctgtgccaatatttgttaagcttcttggttctccaagtgatgatgtccgggagcaggctgtatgggcattaggaaatgttgctggggactcctcaagatgtcgtgatttggttttaggtcatggagcattgcttcctttattagcacagttgaacgagcaagctaagctttctatgctgagaaatgctacctggacactatcaaatttctgcaggggcaagccacaacctgcttttgatctggtcaaaccagcacttccagctcttgctcgtcttatacattcaaatgatgaagaagttttgactgatgcttgctgggcactttcatacctttctgatggtacaaacgacaaaattcaagctgttattgaggcaggtgtttgccctcgtctcgtcgagctcttaatgcatcctgctccttctgtgcttattcctgcccttcgaactgttggaaacattgttactggtgatgatttgcaaactcaggttattatccaacataatgccctaccttgcctgctaaatttattgactaataatcataagaagagcatcaagaaagaagcttgctggactatatctaatataacggctgggaacaaggcgcaaattcaggctgttatagatgccaatatagttgctccccttgttcatctgctccaaaatgccgaatttgatattaagaaagaggctgcatgggcaatctcaaatgccacatctggaggctctcatgatcagataaagtacctagtaaatcaagggtgtatcaaacctctgtgcgatcttctaatttgccctgatcctaggattgtcacggtttgtttagaagggctcgaaaatatcttgaaggtaggagaagctgaaaagaacacaactgatacaggaggagttaatctttatgctcaattgattgatgatgctgaggggctagagaaaattgagaatctacagagtcatgacaacactgaaatttatgagaaggcagtgaagatcctcgagacttactggttggaagaggaagacgagactatgccaccgggtactgctccccaaggaggattcaattttggtggcgatcgacctgtcgtaccatccgggggattcaactttggctgagaaggcttttttcgaggctatttcgaccacatctccagtcacatcgggtcaggtcaggcgtgttatgtcgttgtttgcctttgcttatcccagtctcagttatattttagcgtgttggttgactgggttgaatgctttttacatgagtttgggattgactggtgatgagacagtggaatatatatatactatatcaattggtaatatagtttccacagatctgagaaatcagagcgatttcgtttgggcaaactgtgattttttattgttttttcttagttggtctacttgtcagaaacatggagtctaagcattgtttgttccctccctttttacgtcattacgcttctatattttttttgttcatagttttttccatagagcaacttttagatttatagcagataccattttggctagctggcttctatatgttgttacttttaaacaacacatgcaaggaagtttggtactattctcattgatgattactcttttttgttacatgccttgaaaaaatcttgatatttcactcttaaccaaaagtccactgcctttttctttaacaatgttgtattgatacattacacaaatctgagagaaggctttttgggaaaaagaataggttgaaccttgaattggatcaaaaaaaaaaaaaa

SEQ ID NO: 4907 - DNA, 2239 bp, Cajanus cajan
cccatcggttggatccataacccgcatcgagcgcgaaggtttagatccaatccatccgagatccaatataaggccgtatatccaaatcccatttccaccatctagggtttttctttttccgattcattctttcactcccaaccatgtcgctcaggccaaatgccagaaccgaggttcgccgaaaccgctacaaggtcgccgtcgacgccgacgagggccgccggagaagagaggacaatttggtcgagatccgcaagagcaagcgcgaagagagcttgctcaagaagcgtcgcgaaggcctccaacagttccccgctcctcttcagaattccaccgtcgacaagaagttagagagtcttcctgctatggtcactggagtttggtcggatgataatagtctgcaactcgaggccacaacgcaatttcgaaagctgctttccatcgaacggagtcctccgattgaggaagttattcaagcaggtgttgttccacgttttgttgagtttcttgttagggaggatttccctcaacttcagtttgaggctgcatgggctctcacaaacattgcatccgggacatcggagaacactaaggtggtcattgatcatggggcagttcctatatttgtcaagctacttagttctcctagtgatgatgttcgggagcaggcagtatgggctttgggaaatgttgctggtgattcccctaggtgtagagatctagtgctcagcaatggtgccctcatcccactgttggcccagttgaatgagcatgcaaaactctcaatgctgagaaatgccacatggacattatctaacttctgtaggggtaagccacagcccccatttgagcaggtgagaccagcacttccggcacttgagcgtttggttttttccaacgatgaagaagttttgacagatgcttgttgggcactatcatatctctctgatggcacaaatgacaaaatccaagcagttattgaggcaggcgtatgtggcagattggtgcagctcctcatacacccatctccctcagtgctgattcccgctcttcgtacagtgggaaatattgtgactggagatgacatgcagactcagagtatcatcaaccatggtgcactcccttgccttttgaacctgttgacacataatcacaaaaaaagcatcaagaaagaagcttgatggactatataaaacattaatgatggaaataaggaacaaatacaggctgttattgaagcagctctgattgccccccttgtcaatcttcttcaaaatgccgagtttgacattaaaaaggaagctgcttgggcaatctcaaatgctacatcgggtggaactcatgatcagatcaagtacttggttggccagggttgcataaagcctctctgtgatctgcttgtttgcccggacccaaggattgtcactgtctgtttagaaggtctagagaatattctcaaggttggagaagctgagaagagcctaggtaatactggagatgtcaacttgtatgcacagatgatagatgatgcggagggattggagaagattgaaaacctgcagagtcatgacaacaatgaaatatacgaaaaggctgttaaaattctagaaacatactggttggaagacgaggatgagacattaccttcaggagatggtgctcaagctggtttcaattttgggagcaacgagcttccagttccatctgggggattcaactttagctgaagaccttttcctgagaagggagttgttggatgaagtaggggtttatgccggatggctgttgggataaagtctggaagggtcagtcattgcaccttgtttctgcttacagtctggtctggtctagtgtccgtcgtggtcaatgagttgctggggtcagcttacgcttaccaagtccaagtaataagggactggtggattgaattgcagcataatgacctttttttcagctgtgtttgttgtataaaaattatatataatgctggtgagtggtgagaaatatctggaaggttatatgttgcagtggcagggacatgggctatatggcgaggggtttttcttctatgcggctttcagtgctgtttttatcgagtcctagttgtattggcaagatttatttggtcaatgtttgatttggttgggtaaatatattattccgaaacatttttcatggtctattcctaattccaatcgaagaattagtgctatttttttgcatgattattatttcactt

SEQ ID NO: 4908 - DNA, 2049 bp, Amsonia hubrichtii
agatgtcgttgagaccgagtgagaggacggaggttcgtcggaaccggtacaaggtggcggtggatgctgaggaaggaaggcggaggagggaggaccacatggtggagatccgcaagaacaagcgtgaggagaaccttctcaagaagcgacgtgagggcctccaaatgtcacaaccatttcccaccaccgtccctgctaataatatcgagaaaaagttagagagccttccatctatggttgctggggtttggtcaaacgatagtaatttgcagctggaggcaactactcagttccgtaaactgctctcaatagagcgaagccctcctatcgaggaagttatacaatctggagttgttcctcgctttgttgaatttcttatgaggcaggatttccctcagctccagttcgaggctgcttgggctctaacaaatattgcttctggaacctcggagaataccaaggtggtgattgatcaaggagctgtacccatatttgttaagcttctgggatctcctagtgatgatgttcgcgagcaggctgtttgggctttgggaaatgttgctggtgattccccgaggtgtcgcgaccttgtcctcagccacggagctctaattcctttgttggctcagttgaatgagcatgccaagctgtcaatgctgagaaatgccacttggaccctgtccaacttctgcagggggaaaccacaacctccatttgagcaggtaaggcctgcacttccagcacttcaacgtcttgttcattcaaatgatgaagaagtgttaactgatgcatgctgggctctctcgtacctctctgatggtacaaacgacaaaattcaagctgtgattgaggcaggtgtttgtcaccgacttgttgagcttctcctacatccatctccttccgtgctcatccctgcacttcggaccgttggaaacattgtgacaggagatgatcttcaaacccagtgtattattgaccagggagctcttacttgcttgttgagcctcttgactcataatcacaaaaagagcatcaagaaagaagcctgttggacaatttctaacatcactgctggaaataaggagcagatacaggctgtaatcgatgctcaactaattggccccctagtcaatctgcttcaaactgctgaatttgatataaagaaagaggctgcctgggctatttcaaatgctacttctggcgggactcatgatcaaattaagtacttggtttctcagggctgcataaagcctttgtgtgatctccttgtgtgtcctgatccaaggatcgtcactgtctgtttagaagggctagaaaatatattgaaggttggggaagtagagaagggcctcggcaacactggagacgtcaattattatgcccaattaattgatgaagctgagggcttggaaaagattgagaacttgcaaagtcatgacaacaatgagatttatgaaaaagcagttaaaatactggagacatattggttggaggaagaggatgaaacattacctgccggtaatggtgcccaaccaggatttaattttggaggaaatgatgtccaacttccgtctggtggatttaaatttggctaaagggccttcagatggtggatgtaacctcagatttcgaacatggtgtgtgttggcgtcaagtcaaagtcaagtcaaggtcaaggtcaaggtcaagtcagagcacctctctgagttcagttatggtatggtccagagtctgtcgtgtgaaagaggtgccgaggcaggtcactaaatactacaatggggaaataagaaagggtgcaagctcagtggtcgatggtaaattggggcttggttctttcccgagtctggtgaatggttttggggaaattgaagggattataggtcttattgaaatgaggtcgcagaaaagcaagtcttttgtatgtctttcatgccttgtaattgcagtccttagtctccaaagagttgtcaatatgtttttgtcacttgcttaattaaatatgtagtattcataatatttatttgcatattgtattctgcaaaaggaaga

SEQ ID NO: 4909 - DNA, 2589 bp, Eucalyptus grandis
caataatcactctcgctcaaaccctcttccctccttccttccttccttcctctacgctgttgtcggttcgcttttggccttgcaatcggtcgaagattccgtcgccgtcccgctcgattttccggtcgccgatagggtttccgatccctcggggcgcctcctcgccgacgatcctccgcccgtccctccgtccgtccctcccgcccgccgggggtttttccccttcgagccatgtcgctgcggcccaacgcgaggacggaggtccgccggaaccgctacaaggtggcggtcgacgccgacgaggggcggcggcggcgggaggacaacatggtggagatccggaagagccgccgggaggagagcctgctgaagaagcgacgcgaggggctccaggcgccgcaggcctcgccctcgctccactcctccgccgtcgagaagaagttggaaaatctacctagcatggtggctgctgtattgagcaatgataaatctttgcaagttgacgcaaccacgcagtttagaaagctgctttcaatagaacgcagcccgcctattgaggaggtgattcaatcaggtgtcgttcctcgctttgtcgagtttctcatgaaggaggacttccctcaacttcagttcgaagcagcttgggcactgaccaacattgcttctggtacatctgagaatactaaggtggtaattgatcatggagctgttcctatattcgtgaaacttcttcgttctcctagtgatgatgtgcgtgagcaggctgtttgggctctaggaaatgttgccggtgattctcccaaatgccgcgacctggtacttttaaatggtgccttgcttccattgctggcacaattgaatgagcatgcaaagctttctatgctgaggaatgccacctggacgctttcgaacttctgtagagggaagccccagccactttttgagcaggttaagcctgcacttccagcccttgcacatcttatccattcaactgatgaagaggttttgacggatgcttgttgggctctatcatacctttctgatggcacaaatgataaaattcaagccgtgattgaagctggtgtatgtcctcgtcttgtggaactactgcttcacccatctccatctgtgttgattcctgccctccgcacggttggaaatatcgtcactggagatgatctgcaaacccagtgtgtcattgagcatcaagcactcccctgccttctgaacctgttgactggtaattataagaagagcatcaagaaagaagcttgctggacaatctcgaatattacagctggtaataaggaacagatacaggctgtcgttgaggctgatattattggtccaatggtacaactacttcaaaatgctgaattcgatataaagaaggaggctgcatgggcaatctcaaatgccacatctggcggttctcatgaacaaatcaagttcctagtaaatcaaggatgtgtcaagcctttatgtgatcttctcatctgccctgatccaaggattgtgacagtttgtctagagggtttggagaatatcttgaaggtaggagaagctgagaaaaatcttggcaacactggtgatgtaaatgtctatgctcagatggttgaagatgtggagggcttggagaaaatcgagagcttacagtctcatgacaacaatgagatttatgagaaggcagtaaagattctcgaagcatactggttggaagaagatgacgatgcgatgccaccaggtgatgcccctcaaccagatatgcaatttggagggaataatctgcctcccatgccatccggtggatttaagtttggttagaggtaggtcctctttcggcataaaggtgattccttcatccacctctctttcgatatccatcggaattttgttggtgccgtagctgcctttcccttgacctcagattcttgggctttatggcaggattaaagttgggtcctggtcggttacgcgtcgagtctgggtcatggttgagtcaagtctgggtcgtggttgagtcgagtcttaggggcaagatcaagtaggtgcttgaactagcctcaggttccgagtctctggaagcaggtgagagaagttggatattgcgctccttattgaatggttcatttcggatatagtaactcatgaggttattggggggcagcaagtcatccctgacgagctctatcatacataaagcgccactggagtgcctgtttatgtggccatcgcaggaaaggtttcaatgtcacacatgcttagggtcctccacctatctggtcctgtgctgcatgtcgatacccgttgcgttctgtcggaacaatgagttccttgattctttttcttttataagattgtttcagtcgggtctttaattagcagcttgaggttgccttgcaatttcttctgcgggttctcaatgtcattatgttgatgcatagtgtttttatcaaacgaatggttctcaagccttcgaagatttcattttttttaccctctttatatgatcatcttcttgcatgattcctgtcaaacaatgtaaaataacgaaatcgacatcttctaatctttgctactcaacttggt

SEQ ID NO: 4910 - DNA, 2273 bp, Trigonella foenum-graecum
tcattcattctttcattcaccaatcaacccaatagagcagtgtgtagtatcaactgcatcacttcctctctcaccgatcactccctaaacgatgtcgtatcgtccaaacgcaaactccaggaccgaggtccgtcgcaaccgttacaaggtcgccgtcgatgccgaagaaggccgccgacgccgtgaagataccatggttgagatccgtaagaatcgtcgcgaagagagtttgttgaaaaagagacgcgaaggtcttcaacctcagcagattccttccgctcttcactctaacgttgttgagaagaagttggaacatttaccaactatggttgctggtgtgtggagtgacgataataacttgcagcttgaatcaacgactcagtttcgaaagctgctttccattgaacgtactccaccaattgaggaggttatacagactggtgtagtttctcgttttgttgagtttctgatgagggaagactttccgcagttgcagtttgaggcagcttgggctttgacaaatatagcttctggaacgtctgaaaacactaaggtggtaattgaccacggggctgtcccaatttttgtgaagctccttgcttcttctagtgatgatgtccgtgaacaggcagtgtgggcattaggaaatgttgctggagattctcccagatgtcgtgatcttgttctcggtcacggggctttgattcctctgttgggacaattgaatgaacatgccaagctttctatgctgagaaatgctacctggacactttcaaacttctgcaggggcaagccacagcctccttttgatcaggttaaaccagcacttcctgctcttgccggtcttatccattcaaatgatgaagaagtcttgactgatgcctgctgggcactatcatatctttcggatggtaccaatgataaaattcaagctgtaattgaagctggtgtttgtccccgacttgttgagcttctattgcacccatctccttcagtgctaattcccgctcttcgtactgttggaaacattgttaccggagatgatgtgcaaactcaggttatcatcaatcatcaggctcttccttgcctatatagtctgttgaccaataattataaaaaaagcatcaagaaggaagcttgttggaccatatcaaacattacagctgggaataaacagcagattcagtctgtgattgaggccaatatattcggtcctttggtgaacctacttcaaaatgctgagtttgatatcaagaaagaggctgcttgggctatctcaaatgctacatctggtggatctcacgaacaaatcaagtacctagtaaatcaagggtgtattaagcccttgtgtgatcttcttatctgtcctgatcctaggattgtgacagtttgcctggaaggccttgaaaacatcttgaaggttggagaagctgataaaaatataggcaatactggtgacgtgaatcaatacgcccaaatgattgatgatgctgaggggttggagaaaattgagaacctccagagtcatgacaacacagagatttatgaaaaggctgtgaagattcttgagacatactggttggaggaagaagatgagactatgcctccaggcgatgcttctcaatcaggattcaactttggtagcgctgaggttccttctgtgccttcgggtggtttcaacttcaatcagtagatgttcatccttcaatggggccatgtcttatatttagctgttcctggagttttgtctggtctatgattaaagtcctccagtatgattgggacaagctggggtcgaatcaatatgtttctgtgtccaacaaggtccaacattggtaaatagagcgttgctggattggcttgggcaatgcttggtttttcatatctcatggttacagatgtgtggtggcttgatttattggtcaccgtagaaaatactagacttgtctctgaagtgataattacataaaatgaatgttcagtgtcatgattttttcttcgttatatgtagtagtttggagtcaattaagttttagttacaattgtgggtctttttggcaaaatgccagatgctcgttggagtttttacccgtccgcacctatgaattttttggtcgatgaagtttacactagaatccagtaattcattatgttatcgatatctggtgtccctattttagttgatgaaagtttgttttgcaatgtctcaaaacacgaatgaaatagtgtggtgaaatcatcattttgtattatatagtttcactcatggcttt

SEQ ID NO: 4911 - DNA, 1690 bp, Cucumis sativus
ccatgtcgttaaggcctactgctagaaccgaggttcgtcggaaccgttataaggtatccgtcgatgccgaagaaggccgacgccggcgagaggataacatggttgagatcaggaagagtaagcgcgaagagagtcttcagaagaagcgtagggaaggccttcaagcacagcagtttccttctgccgtacacacttcaactgtcgagaagaagttagagagccttccgtctatggttgctggggtatggtctgataatagcagtcttcagctcgaggcaacaactcagtttcggaaattactttcgattgaacgaagccctcccattgaggaagtgattcaatctggagttgttccgcgttttgtagaatttctcgtgagggaggatttccctcaacttcagtttgaggctgcttgggctctcacaaacattgcatctggaacttcagaacacacaaaggtggttattgatcatggtgcagtaccaatttttgttaagctactcgcttctcctagtgacgatgttcgagagcaggctgtttgggctttggggaatgttgctggagattcccctacatgccgtgatcttgttcttcgtcatggagctttgattccacttctttcccagttgaatgagcatgctaagctttctatgttgagaaatgcaacttggacgctttcaaacttctgcaggggcaagccacaacctccatttgaccaggtaaagccagctcttccagctcttgagcgcttagtgcactccaatgatgaagaagttcttacggatgcctgctgggcactctcttatctatctgatggtactaatgacaaaatccaagccgtgatcgaggcaggggtgtgtggacgacttgtacagctgctattacatccttcaccgtccgtcctcattcctgcccttcgcacagttgggaatattgtgactggagatgacattcaaactcagtggatagttaatgatggtgccctttcatgccttctgggcatattcactcaaaatcataaaaagagtatcaagaaagaagcttgttggactatatctaacattactgctggaaacaaggaacagatccaggccgtcatcgaagctcgtttaatacctccacttgtcaatttgcttcaaaatgctgagtttgatataaagaaagaggctgcatgggcaatttcaaatgcaacatccggtggaactcatgagcaaattaagtaccttgtcagtcaagggtgcatcaaacctttgtgtgatcttcttgtatgcccagatccaaggattgtcaccgtctgtttagaggggctggagaacattttgaaggtcggagaagctgaaaagaatctgggtaccaatggagacgttaatctatatgcacaaatgattgacgatgctgagggtttagaaaagattgaaaatctccagagtcatgacaaccacgagatttatgagaaggctgtcaaaatacttgagacgtattggttggaggaggaggacgaggcattgcccgcaactgatggtggtgctcagcctggtttccgctttggtggaaacgaacttccagttccttctggtggattcaactttagttgaaggcttatatggtatgttagtggttttggtggtgatactaagggagagtagtacatgtgtcggctcacaagcttatttgttggagtccaatctgg

SEQ ID NO: 4912 - DNA, 2238 bp, Eucalyptus grandis
ccatgtcgctgcggcccaacgcgaggacggaggtccgccggaaccgctacaaggtggcggtcgacgccgacgaggggcggcggcggcgggaggacaacatggtggagatccggaagagccgccgggaggagagcctgctgaagaagcgacgcgaggggctccaggcgccgcaggcctcgccctcgctccactcctccgccgtcgagaagaagttggaaaatctacctagcatggtggctgctgtattgagcaatgataaatctttgcaagttgacgcaaccacgcagtttagaaagctgctttcaatagaacgcagcccgcctattgaggaggtgattcaatcaggtgtcgttcctcgctttgtcgagtttctcatgaaggaggacttccctcaacttcagttcgaagcagcttgggcactgaccaacattgcttctggtacatctgagaatactaaggtggtaattgatcatggagctgttcctatattcgtgaaacttcttcgttctcctagtgatgatgtgcgtgagcaggctgtttgggctctaggaaatgttgccggtgattctcccaaatgccgcgacctggtacttttaaatggtgccttgcttccattgctggcacaattgaatgagcatgcaaagctttctatgctgaggaatgccacctggacgctttcgaacttctgtagagggaagccccagccactttttgagcaggttaagcctgcacttccagcccttgcacatcttatccattcaactgatgaagaggttttgacggatgcttgttgggctctatcatacctttctgatggcacaaatgataaaattcaagccgtgattgaagctggtgtatgtcctcgtcttgtggaactactgcttcacccatctccatctgtgttgattcctgccctccgcacggttggaaatatcgtcactggagatgatctgcaaacccagtgtgtcattgagcatcaagcactcccctgccttctgaacctgttgactggtaattataagaagagcatcaagaaagaagcttgctggacaatctcgaatattacagctggtaataaggaacagatacaggctgtcgttgaggctgatattattggtccaatggtacaactacttcaaaatgctgaattcgatataaagaaggaggctgcatgggcaatctcaaatgccacatctggcggttctcatgaacaaatcaagttcctagtaaatcaaggatgtgtcaagcctttatgtgatcttctcatctgccctgatccaaggattgtgacagtttgtctagagggtttggagaatatcttgaaggtaggagaagctgagaaaaatcttggcaacactggtgatgtaaatgtctatgctcagatggttgaagatgtggagggcttggagaaaatcgagagcttacagtctcatgacaacaatgagatttatgagaaggcagtaaagattctcgaagcatactggttggaagaagatgacgatgcgatgccaccaggtgatgcccctcaaccagatatgcaatttggagggaataatctgcctcccatgccatccggtggatttaagtttggttagaggattaaagttgggtcctggtcggttacgcgtcgagtctgggtcatggttgagtcaagtctgggtcgtggttgagtcgagtcttaggggcaagatcaagtaggtgcttgaactagcctcaggttccgagtctctggaagcaggtgagagaagttggatattgcgctccttattgaatggttcatttcggatatagtaactcatgaggttattggggggcagcaagtcatccctgacgagctctatcatacataaagcgccactggagtgcctgtttatgtggccatcgcaggaaaggtttcaatgtcacacatgcttagggtcctccacctatctggtcctgtgctgcatgtcgatacccgttgcgttctgtcggagcaatgagttccttgattctttttcttttataagattgattcagtcgggtctttaattagcagcttgaggttgccttgcaatttcttctgcgggttctcaatgtcattatgttgatgcatagtgtttttatcaaacgaatggttctcaagccttcgaagatttcattttttttaccctctttatatgatcatcttcttgcatgattcctgtcaaacaatgtaaaatacgaaatcgacatcttctaatctttgctactcaacttggt

SEQ ID NO: 4913 - DNA, 2046 bp, Cicer arietinum
aagttccttaattctcaaatcgtcaattagggtttttcatttcccaaatcacattcgattggtgccacctagccctatccaaaacgatgtcgctcagacctaatgctagaaccgaagttcgccgcaaccgttacaaggttgccgtcgacgccgacgaaggtcgccggagaagagaagacaacatggtggagatccgtaaaagtaagcgcgaagagagtctcttgaagaagcgacgtgaaggtcttcaagctcaaccgcagttccctacttctgttcagtcttcctccattgtcgagagaaagttagagtctctgcctgcaatgattgccggagtttggtcggatgataatagccaacaacttgaagcaactacgcaatttcggaagctgctttcgattgaacgaagccctccgattgaggaagtaattcaatctggtgttgttcctcgttttgttgaatttctagttagggaggattttccccaacttcagtttgaggctgcttgggctctcacaaacatagcatctggaacttctgagaacaccaaggtggtaattgatcatggggcagtaccaatatttgtcaagctactaagttcacctagtgatgatgttcgggagcaggctgtgtgggcattggggaatgttgctggtgactcccctaggtgccgtgatcttgttctcagccatggtgccctgatcccactgttatcccagttgaatgagcatgcaaagctttcaatgctgagaaatgccacgtggactctgtcaaacttttgcaggggcaagccacagcctccatttgagcaggtaaggccagcacttcctgctcttgagcgtttggttttttccaatgatgaagaagtcctgacagatgcatgctgggcactctcatacctttctgatggaacaaatgataaaatccaagctgttattgaggcaggtgtatgtggaagactggtgcagctccttctgcacccatctccatcagtgctgattcctgcacttcgtacagtgggaaatattgtaactggagacgatctgcagactcaggctattatcaatcatggttcactcccatgccttttgagcttgttgacccataatcataaaaaaagcattaagaaagaagcttgctggactatatcaaacattacagccggaaataaggagcagatacaggctgtaattgaagctggtctgattgctccccttgtcaatcttcttcaaaatgccgagtttgacattaaaaaagaagctgcctgggcaatctcaaatgccacatctggtggtacccatgagcaaatcaagtacttggtgagccagggttgcattaagcctctatgtgatttgcttgtttgcccggatccgagaattgttactgtctgtttagaaggtcttgagaatattctgaaggttggagaagcggagaaaagctttggtaacactggagatgtcaacttgtatgctcagatgatagatgatgctgaggggttagaaaaaattgaaaacttacagagtcatgacaacaatgaaatatatgagaaggctgttaaaattcttgagacatattggttggaagatgaagatgagacactccctgcaggcgatggttctcaacctggttttaattttggaagcagtgaccttccagttccatccgggggattcaacttcagttgaagacttcggttcagtgtggagcagggtgatacatgggtgacagttggagttgagtcctggtagaattgggggggtcggttggtcattgtacttcatggtgtcgggtgtcagtaatgtctagtgtcagtaatgaagtgctggggtgggtcagtcttaactgccatgtccaaataagaaggggctggtgggttcacttagctgcataatgtgagcattgtatctatcttgtataagaaaatatatttgctgggaagaaagtatgttgcagtagcaaggacccgttttgtgtggcaatgggggagggttttctttgacgaggctttgagtcctattttttattgagtcgtagttgtattggttattt

SEQ ID NO: 4914 - DNA, 2495 bp, Gossypium raimondii
tcttaaaatcgatcaaaaatctaatcaaaaccttcaaaaagatttttctgttcctctgggatattcagtgaagaaggaaaatagtgttttgtattccgattctcttttaaattatagttttgttcctgaaaatcggagaagatgtcattgagaccaaactcgaggacggaggttcgaaggaacaggtacaaggtggcggtggacgctgaggaagggaggcggaggagagaggataacatggtggagattaggaagaatcgccgtgaagagagtttgcagaagaagcggcgtgaagggcttcaagcgcagccaatgcctgcttctcttcactcctctgccgttgagaaaaagttggaaaatttgccagccatggttgctggtgtctgggctgatgatagtaatatgcagctcgaggcaaccacacagtttaggaagttgctttcaattgaacgcagcccacctattgaccaagtgatacaagcaggagttgttcctcgcttcattgaattccttgcgagggatgatttcccacagcttcagtttgaggcagcttgggccctaactaatattgcttctgggacatctgagaacacaaaggtggtaattgatcatggggctgttcctatatttgtgaaattgcttgcttcaccaagtgatgatgttcgtgagcaggctgtctgggcactgggaaatgttgctggagattctcctagatgtcgtgaccttgttcttagtcatggtgctttgcttcctttgttggcacagttaaatgagcatgctaaactttctatgctgaggaatgcaacatggactctctcaaacttttgtcggggaaagccccagcctccctttgatctggttaaacctgcacttcctgcattgacacaccttattcattcaaatgatgaagaagtcttaactgatgcatgttgggcgctctcatatctttctgatggtacaaatgacaaaatccaagctgttatagaagcaggtgtttgtgggcgtctggtggagctattgatgcacccatgtccttcagtgctaataccagctcttcgcacagttggaaatattgtcacaggtgatgatggtcaaacccagtgtattatcaatcatcaagcgttgccatgccttttaaacctcttgacaaataatttcaaaaagagcatcaagaaggaagcttgttggacaatctcaaatatcacagccggaaataaggagcagatacaggctgtaattgaagctaatattatatctccactggttcatctgcttcaaaatgctgaatttgatatcaagaaagaagcggcatgggccatctcaaatgccacatctggtggtactcatgatcagatcaaattccttgttagtcaaggttgtataaagccattgtgtgatcttcttaactgccctgatccaaggattgttacagtctgtttagaagggcttgaaaacattttgaaggtaggagaagctgataagaacctgggcactaccggaggagtgaatctctatgcacaaatgattgatgatgctgagggtctggagaagatcgagaatttacagtcccacgataacactgagatttatgaaaaggctgtgaaagttctcgagacatattggttggaggaggaggatgagacaatgccgccaggtgatgcctctcaaacagggtttcattttggcgggggtgagcttcctgttccttcagggggattcagtttcagttagaggtatgtagtgctgctgtttgcatgcatttgtttttgtgttggtgcactagtgggagcgtgttatgtcgtttgagatgggactgcatatctgactaccatttgtatgcttttgagctataaaagctgttagtattccaggagttatctggtccagtattgaactccttacggagatgatgggacaatagttttttggggggggggggggtgttccagttgaggcatctagtctttgggttgtgtccacagtcgggtatggtcgaaggtacagtgtgaatggtagcgggctggctgtgggttaacagcacagccaggttcatattatgcatgaagggggaatggagacagaatagagcttggacagtatattgaggaacccagactgagtctatatttaatggtcgtaaaacaaatatattgtgtctttgcaattgcaaaagcttggtttgatgattttggcatatgcccagaacaattatgattcacaggggaatatccttttgcatccatgtaaatccgaacgactccatttagattgttttatatgttgctttgaagtggaaatagacatataattgttggtttgatatttcttttcattttagctttattgaaaaaaaatgttattttccggaacggctccaatcaagcttgatatgggttgtgagaagtggaatttacttttaaatatgagcttgcttttaggctaaaattaagtcggtttatttaactagttttaaatgaaagtttgtttattctggg

SEQ ID NO: 4915 - DNA, 3097 bp, Gossypium raimondii
gtttaaacaagaatcttatgcattattattcaaagtatctactttatttgcagagtataaaattaagatatattggcaattttaaattattttaccaaatgtttgaaaaataaaccatccatggatactgtattaatatgaaagaaaaaaaaagtctcaattatttcaaatttcctctttatcatttatttccattttctcaacccccccaaaaaatattaaaatataccgtgagctggaatccataacggcataggtacgttagggttcctcgatttcaaattcaaaatcagtggcagcattgttattaacaccatatcaaagcctgaattccgcaacagaaatagtaaataatttcgaaaaagataggaaaagaaaagaagtcccctataaacactaccactcgcctaaccctcgcctggcccctcctctcccgatccattcgaataaggctccaaaaaccctcttcttttttattttttgtccatctctcaatcttccaaaaaccgcgtcactctcttcccctctgtcattcctcaaacaacccatcgatcatttcacctacaaattaatcggcgattcgattagattgaaaagaagaagcgaatatgtctctcagaccgagcgccaggactgaggttcgaaggaaccgatacaaggtggcggttgatgcggaggaaggtcgccggaggagagaagacaacatggtcgagatccgaaaaaacaagagagaagagaaccttcttaaaaaacgccgcgaaggacttctcgctcaacagcaacaaccgcagcaacaacaactgctctcttcaaccgctggttccgagaaaaagttagaaagtcttccggctatggttgcgggtgtttggtcagatgacagaaatatgcagcttgaggcaaccacccaattccgaaagctgctatcaatagaacgtagtcctccaatcaatgaagttgtacaatcaggtgttgttcctcggtttgtggagttcctgaatagagatgacttcccacagcttcagtttgaggcagcttgggctcttacaaatattgcttcagggacatcagataacaccagggtcgtaattgatcatggagctgtccctatatttgttaagctcttaggttctcccactgatgatgttcgcgaacaggctgtttgggcactaggaaatgttgctggagactcacctaaatgccgtgacctggtccttggccatggggcattggtgccactcttggcacaattcaacgagcatgcaaagctctccatgttgcgaaatgctacctggactttgtcaaacttttgcaggggcaagccacagccttcatttgagcagacaaagccagctttgccagctcttgagcgtcttatccattcaaatgatgaggaagtccttacagatgcatgttgggctctgtcatatctctcagatggtactaatgacaaaattcaagctgttattgaggcaggagtctgcccccgactggttgagctcttgatgcacccatccccaacagtactcattcctgctcttcgcacagttggaaatattgttacaggggatgatatgcagactcaatgtattataggccaccaagcccttccgtgccttttgaacctgctgacgaatacctacaagaagagtatcaagaaggaagcttgctggaccatttcaaatatcactgctggaaatgtagatcagatacaggctgtaattgaagctggcattattgctcctctagtccatctacttcaaaatgctgagtttgagatcaagaaagaagctgcttgggcaatttcaaatgctacgtctggtggcacccatgaacaaataaagtttttggtaagccaaggttgcattaagccattgtgtgatcttctaaactgtcccgacccaagaattgtcactgtttgtttagaaggtcttgaaaacattctgaaggttggtgaagctgagaaaaatctgggtcatactggagatgtcaatctctatgctcagttaattgatgatgctgagggattggagaagattgaaaacctccaaagtcatgacaacaatgaaatctatgagaaggcagtgaagattcttgaaacatattgggtagaagatgaggatgaggcattacccactggtgatgcttcgcaacctgggttccagtttggtggcaatcaacttcctgttccttctggtggattcaatttcagttgaaggtatgcacttaaatatctgattaccttttgcacggaaggtaactgagtctgttaggaaaaatgatcctttaaattgcagtattgattgctctttaggtctggagttgccctctctcctctctcatttgcaaatattttgttcatgtaactggaaactaggatgtaatggccatatgtatgaagtgaatatggattatatcatgacaacactatttgtctgatctattctagtaaaatgagctttccttgtaacaaccctagattgaatcatttggtgctgtcagatgctcttctgctataagcaatccagatagacggcaaattcagataccaataatttggtattttcttgttttggaatttgtagaacacttggtggggtggaatggagctgaaaggtcggtattttcttgttttcttttttatggaattcacatatattcgaagtcatgccacagtatgttcttaagaagtcgtcaaataaagacagggtgtacgatacggtaaagagtctggaagccatacaaaatactttaaaattttgcaatgcggtagctattctttttcagcatcctaactctcagatgcaaagggggagagatgcagcccagtattcagacttctggtttttcctcttgttttgaaaggatgtatttgcttcctttattaaaaggtccttttttttttttattcgattttagttatagtttggacatcatttatttggtctttctgttaagaaatatacagctatcaggaaaattttttcttttccggtagtgtattattgtcagaaactgtattggagttataaaatgtctgctaaacatgtctagttgtggtccttctaaatagaatttgattttttcccgaaatacgtaa

SEQ ID NO: 4916 - DNA, 1782 bp, Cichorium intybus
atccaaattcgtcttctaatcaaatcgatcgctcctactttttcacttcaggtgatgtatatccacttctattatttattcatcaattgattttgcgtatgtatttgtaatcatagggcttcgattttgagttgagctatatcgatcacccataatcatgtctctgaggccaagcgccaggactgaggttcgccggaaccggtacaaggtggccgtagatgcggatgaaggaaggcggaggagggaggacaatatggttgagatccgcaagaacaagagagaggagaacttgcttaagaagcgtcaagtagtgccgtcgtcgcagccgttgtctactggtgttcctatccaaaccgccacaatcgagaaaaagttagagagtcttccttcaatggttgctggagtatattcgaatgataacactatgcagctagaggcaaccactcagtttcggaaattgctctctatagaaaggagtccaccaattgaagaagttatacaatctggggttgtgcctcggtttgtggagtttctaatgagggaggattttccacagcttcagtttgaggctgcttgggcactcacaaacattgcttctggtacttctgagaatactaaggttgtaattgatcatggggcggttccaatttttgtcaagcttcttgcttctccaagtgatgatgttcgcgagcaggctgtttgggcattgggaaatgttgctggagattcacctagatgccgtgatcttgttctaggccaaggtgccttgattccattgttggctcagttgaatgaacatgctaaactttctatgctcagaaatgccacgtggacattatcaaacttctgtcgaggaaaaccacaacctccatttgagctgacaaaacctgcacttcctgcattggaaagacttgttcattcaaatgatgaagaagtgttgacagatgcatgctgggctctctcatatctgtctgatggtacaaatgacaaaattcaagctgtaattgaggctggtgtctgtcaacgtcttgttgagctgctcttacatccttctccttcagtactcattcctgcacttcgaactgttgggaatattgtgacaggcgatgatctccaaactcagtgtattattgagcatggtgcacttccatacctgctgaacttactgacacataaccataaaaagagcatcaagaaagaagcctgttggactatctcaaacatcactgctggaaacaaagaacagatacaggctgtaattgaagcaggattaattgcccccttggtgaatctacttcagacagctgaatttgatattaagaaagaagctgcttgggcaatatcaaatgccacttctggtggtaataatgaacagatcaagtacttggtgagccagggatgtatcaaacccctatgcgatctccttgcatgcccggacccacgaatcgtgaccgtttgtttagaaggacttgagaacattctcaaagtaggtgaagtcgagaagaattcgggtcaaagtggagatgttaatttatatgctcaattgatagatgaagcagaaggtctagaaaagattgaaaatttacaaagtcatgacaacaatgaaatttatgaaaaagcggttaagattcttgagacgtattggttggaagaggaagatgaggtggtaggagatgctgcacaaccacaacccggttttaattttggaggaaataatgttcaacttccatctggcggattcaatttcaacaattgaaggtaattaaggaaagatattatttg

SEQ ID NO: 4917 - DNA, 2275 bp, Gossypium hirsutum
cgaataaggctccaaaaaccctcattcttttttattttttgtccatctctcaatcttccaaaaaccgcgtcactctcttcccctctgtcattcctcaaacaacccatcgatcatttcacctacaaattaatcggcgattcgattagattgaaaagaagaagcgaatatgtctctcagaccgagcgccaggactgaggttcgaaggaaccgatacaaggtggcggttgatgcggaggaaggtcgccggaggagagaagacaacatggtcgagatccgaaaaaacaagagagaagagaaccttcttaaaaaacgccgcgaaggacttttcgctcaacagcaacaaccgcagcaacaacaactgctctcttcaaccgctggttccgagaaaaagttagaaagtcttccggctatggttgcgggtgtttggtcagatgacagaaatatgcagcttgaggcaaccacccaattccgaaagctgctatcaatagaacgtagtcctccaatcaatgaagttgtacaatcaggtgttgttcctcggtttgtggagttacttaatagagatgacttcccacagcttcagtttgaggcagcttgggctcttacaaatattgcttcagggacatcagataacaccagggtcgtaattgatcatggagctgtccctatatttgttaagctcttaggttctcccactgatgatgttcgcgaacaggctgtttgggcactaggaaatgttgctggagactcacctaaatgccgtgacctggtccttggccatggggcattggtgccactcttggcacaattcaatgagcatgcaaagctctccatgttgcgaaatgctacctggactttgtcaaacttttgcaggggcaagccacagccttcatttgagcagacaaagccagctttgccagctcttgagcgtcttatccattcaaatgatgaggaagtccttacagatgcatgttgggctctgtcatatctctcagatggtactaatgacaaaattcaagctgttattgaggcaggagtctgcccccgactggttgagctcttgatgcacccatccccaacagtactcattcctgctcttcgcacagttggaaatattgttacaggggatgatatgcagactcaatgtattataggccaccaagcccttccgtgccttttgaacctgctgacgaatacctacaagaagagtatcaagaaggaagcttgctggaccatttcaaatatcactgctggaaatgtagatcagatacaggctgtaattgaagctggcattattgctcctctagtccatctacttcaaaatgctgagtttgagatcaagaaagaagctgcttgggcaatttcaaatgctacgtctggtggcacccatgaacaaataaagtttttggtaagccaaggttgcattaagccattgtgtgatcttctaaactgtcccgacccaagaattgtcactgtttgtttagaaggtcttgaaaacattctgaaggttggtgaagctgagaaaaatctgggtcatactggagatgtcaatctctatgctcagttaattgatgatgctgagggattggagaagattgaaaacctccaaagtcatgacaacaatgaaatctatgagaaggcagtgaagatacttgaaacatattgggtagaagatgaggatgaggcattacccactggtgatgcttcgcaacctgggttccagtttggtggcaatcaacttcctgttccttctggtggattcaatttcagttgaagaacgcttggtggggtggaatggagctgaaaggtcggtattttcttgtttttttttatggaattcacatatattcgaagtcatgccacagtatgttcttaagaagtcgtcaaataaagacagggtgtacgatacggtaaagagtctggaagccatacaaaatactttaaaattttgcaatgcggtagctattctttttcagcatcctaactctcagatgcaaagggggagagatgcagcccagtattcagacttctggtttttcctcttgttttgaaaggatgtatttgcttcctttattaaaaggtcctttttttttttcgattttagttatagtttggacatcatttatttggtctttctgttaagaaatatacagctataaggaaaattttttcttttccggtagtgtattattgtcagaaactgtattggagttataaaatgtctgctaaacatgtctagttgtggtccttctaaatagaatttgatttattcccgaaa

SEQ ID NO: 4918 - DNA, 1610 bp, Lotus japonicus
atcgaaacgatgtcgctcaggcccaatgctaggaccgagattcgccgcaaccgctacaaggttgccgtcgacgccgacgaaggtcgccggaggagggaggacaacatggttgagatccggaagagtaagcgcgaagagagcctccagaagaagcgccgtgagggtctccaagctcagcagcagttcgccactcctcttcagtcttcctccattgtcgagaaaaagttagagagtcttccggcgatggttgctggggtttggtcggatgataatagccagcagctggaagcaactactcaatttcggaagctgctatccattgagcgtagccctccgattgaggaagttatccaatctggtgttgtgccgcgttttgttgagtttctcgttagggaggatttccctcaacttcagtttgaggctgcgtgggctctcaccaacattgcgtccgggacttcggagaacactaaggtggtaattgatcatggggcagtaccgatatttgtcaagctgcttagttcgcctagtgatgatgttcgcgagcaggcggtgtgggcgttgggaaatgttgctggtgattctcctaggtgtcgagatctagtgctcagccatggtgccctgatcccattgttgtcccagctgaatgagcatgccaaactttcaatgctgagaaacgccacgtggaccttgtcaaacttctgcaggggcaagcctcagcctccatttgaacaggtgaggccagcgcttccagctcttgagcgtttggttttttccaatgatgaagaggtcctgactgacgcatgctgggcgctatcttatctttccgatggaacaaacgacaaaatccaagcagttattgaggcaggtgtatgtagcagattggttcagcttcttctgcacccgtctccttccgtgctgattcctgcacttcgcacagtgggaaatattgttactggagacgatatgcagactcaggctattatcaatcatggttcactcccgtgccttttgagcctgttgacgcaaaatcataaaaaaagtatcaagaaagaagcttgctggactatatcaaacattacagctggaaacaaagagcagatacagtctgttattgaagcgggtctgattgctccccttgttaatcttcttcaaaatgctgagtttgacattaaaaaggaagctgcttgggcaatttcgaatgctacatctggcggtacccatgagcagatcaagtacttggtgagccagggttgcatcaagcctctctgtgatctgcttgtttgtcccgacccaagaatcgttactgtctgtttagaaggtcttgagaacattctgaaggttggggaggctgacaagaacttgggtaactctggagatgtcaacttgtatgctcagttgatagatgaagctgagggattggaaaagattgaaaacctgcagagccatgacaacaatgaaatatatgagaaggctgttaaaatcctcgagacatattggttggaagatgaagatgagactttgcctccaggtgaaggtgctcaacctgggtttaattttggaaccaacgagcttccagtcccatccggtggattcaacttcagttgaagact

SEQ ID NO: 4919 - DNA, 2106 bp, Capsicum annuum
tgtaaagcaattttagcaagatgtctctgaggccaagtgctagaacggaggttcgtaggaaccgatacaaggttgccgtcgacgccgaagaaggccgccgccgccgagaggacaatatggttgagattcggaagagcaagagagaagagagcttgcttaagaagcgtcgtgaaggtcttcaagcccaacaacaacagttcccttccaatcttcaaacttccaccgttgaaaagaagttggcaagtcttccatcaatggttgctggtgtttggtcaactgataacaatttgcaactggaggcgaacacccaattccgtaaattgctttctattgaaaggagtcctcctattgaggaagttatacaatctggtgttgtgcctcgatttgttgagtttctattgagggaagattttccgcagctccagtttgaagctgcttgggcgctcacaaacatcgcttctggcacctcggagaataccagagtggtgattgaccatggtgctgtgccaatttttgtaaagcttttgggttctccaagcgatgatgttcgtgagcaggctgtgtgggcactgggaaatgttgctggtgactctcctaggtgccgtgatcttgttcttagtaatggggcgttgattcctttgctggctcagttgaatgagcatgccaagctttcaatgctgagaaatgccacttggactttgtcaaacttttgtagaggcaaaccacaacctccatttgagcaggtgagaccagcactctcagctcttcagcggcttgttcattcaactgatgaagaggtgctaacagatgcatgttgggcactttcttacctttccgatggtacaaatgacaaaattcaagctgtcattgaagcgggtgtctgtccacggctggttgagctcctcgtgcatccgtctccttcagtactcatccctgccctccgtacagtaggaaatattgttacaggagatgacctccagactcagtgcattattgaacatggtgcccttccttgcctgctgagcttgttaacacacaatcacaagaagagcatcaagaaagaggcctgctggactatatcaaatattactgctgggaacaaggaacagatacaggctgtaattgcggctggattaattagtcctctggtcaatttgcttcagagtgcagaatttgatataaaaaaagaggctgcctgggctatttcaaatgctacttccggtgggactcatgagcagatcaagttcttggtgagtcagaactgcataaagcctctgtgtgatttgcttgtgtgccccgacccaaggattgtcaccgtctgtctagaaggattagaaaacatattgaaggttggggaagcagaaaaagccaacactggaggcattaattactatgctcagctgaccgatgatgctgagggattggaaaagattgaaaaccttcagagtcatgataacaatgaaatatatgagaaggctgttaaaatactggagacatactggttggaggaggaggatgaaacattgccggcaggtgatggaacacaaaacgagttcaattttggtggaaatgatattcagcttccatctggtggattccagtttggttgaaacctattacatatccattcaccaatttctcccttaacaggctgtgtatggtggatgagaagtgcagtttgaaagatgacatgttggtgctggtgtcatatcaagtcgagtcagatcaccctccctgagtctggtcagttcgggtcaagagtcagtcgtggttgaggaggtgccgaaagggagtcttccaaatgacggtcgtaaataagactgcgtgaagagtcttaagaggtaaaagcagtggcatcttgggaatttcatacacgattcctgtgcatgcttgtagtgtttggtgataagtattgagagttggtattatcagtcatttcagagtgcggagtcctttttcccattagcacatgagatgtatcttcagtctatctgaaagagtcggtccatattactttcgagttgccgagtgaatgtgtatacttttgagtcatttcttataaaatattgctattggacaaaaactcattcacaatccccccaaaat

SEQ ID NO: 4920 - DNA, 2325 bp, Populus trichocarpa
aaaaaaaaaaagaatttttttttccagtacactcttctccttctacgatccccaaattgaaaaaagaaaataaaaatttagggttttcaaattaccatcaatcaaccatgtctttgagaccaagcacgagaaccgatgttcgccggaaccgatacaaagtcgccgtcgacgccgatgaaggtcggcggagaagagaggacaatatggttgagatccgaaagaacaagcgtgaagagagtttacaaaagaagcgacgcgaaggtctcctggcacaacagttccctgccgctgttctctcttcttctaatatggaaaagaagttagagagtttgccttcgatggtgtctggtgtttggtctgatgatagtaatttgcagctggaagcaactactcagtttcgaaaactactttccattgagaggagccctcccatagaggaagttatacaagctggggttgttccaagatttgtcgagcttcttgttagggaggatttccctcagcttcagtttgaggctgcttgggctctcacaaatattgcctctggaacttcagagaacacaaaggtggtaattgatcatggtgcagttccgatatttgtcaagcttctaggttctcccagtgatgatgttagggagcaggctgtgtgggcattgggaaatgttgctggtgactcccctaagtgccgtgatcttgtgctcagccatggagcgttgattcctctcctggcacagttgaatgagcacgcaaagctttcaatgctgaggaatgctacatggacactgtcaaacttctgcaggggcaagccacagcctctgtttgagaaggtgagaccagcccttcctgcacttgaacgtcttgttcattcaactgatgaagaagtcctaactgatgcttgttgggcactctcttatctttctgatggtacaaatgacaaaatccaagctgttattgaggcaggggtctgtcctcgacttgtggagctcctcctccatccttctccttcagtgcttgttcccgcccttcgtacagttggaaatattgtgactggggatgatatgcagacccagtgcataattaatactggtgcacttccatgcctcctaagcctgttgactcataaccataaaaagagcatcaagaaagaagcttgctggactatctcaaacattaccgcaggaaacaaggaacagattcaggcagttattgaggctggtttaattggcccgcttgttaatttacttcaaaatgcggagtttgacataaagaaagaagccgcttgggcagtttctaatgctacttctggtggtactcatgagcaaattaagtttttggtcagtcagggatgtattaaaccattgtgtgatcttcttgtatgccctgatccgaggattgtaacagtatgtctagaaggattagagaatattctgaaggttggggaagctgaaaagaatttggggaacagtggagatgttaatttctatgcccagatgatagatgatgctgagggactagaaaagattgaaaatctacagagtcatgacaacaatgagatctatgagaaggcagtcaagattctcgagacgtattggttggaagaagatgatgaggctttgccttcaggtgatggtgcccagcaaggatttcactttggtgagaacaatgttcaagttccatctggtggattcaacttttagctgaaggatctgtagtttggaatggtgaacccaattcatgatttgggtgacaaatattttgaggtcaagttgggtcccgtcgcagcaccttgtgtctgtttacagtctgctctagagtctggtcaaagaggtgcatagcaacaggtcagtctatactacagcgtccaataagagcagggttgggaaggtacagtagcaacaatgttacctggtcagccatgcttgatatttttgccttcaactatggagcagcatggagagtgttacgaagtccattgttgcatgagcaagcgtccctgatcactgaatgggtgcgcgatggtgggggttttctttcacgaggattgaagtccttttttatgctcgagtcatattgtacttatattttttatagtctatttgtttctttgagtgggtgaatatggtattttgataaaacctcattttccttgtgtatttgaaggaaaaaatgaattagcagttttttttttttgtgatcttatcatggctatattttgattcaaatggcactttatttttcttttcatttctaggttataaaacgggtacatctatgctcgctaacgttttagtaaattttctagctatttacctgttctaggcttca

SEQ ID NO: 4921 - DNA, 2316 bp, Gossypium hirsutum
aaatctaatcaaaaccctcaaaaagatttttctgttcctctgggatattcagtgaagaaggaaaatagtgttttgtattccgattctcttttaaattatagttttgttcctgaaaatcggagaagatgtcattgagaccaaactcgaggacggaggttcgaaggaacaggtacaaggtggcggtggacgctgaggaagggaggcggaggagagaggataacatggtggagattaggaagaatcgccgtgaagagagtttgcagaagaagcggcgtgaagggcttcaagcgcagccaatgcctgcttctcttcactcctctgccgttgagaaaaagttggaaaatttgccagccatggttgctggtgtctgggctgatgatagtaatatgcagctcgaggcaaccacacagtttaggaagttgctttcaatagaacgcagcccacctattgaccaagtgatacaagcaggagttgttcctcgcttcattgaattccttgcgagggatgatttcccacagcttcagtttgaggcagcttgggccctaactaatattgcttctgggacatctgagaacacaaaggtggtaattgatcatggggctgttcctatatttgtgaaattgcttgcttcaccaagtgatgatgttcgtgagcaggctgtctgggcactgggaaatgttgctggagattctcctagatgtcgtgaccttgttcttagtcatggtgctttgcttcctttgttggcacagttaaatgagcatgctaaactttctatgctgaggaatgcaacatggactctctcaaacttttgtcggggaaagccccagcctccctttgatctggttaaacctgcacttcctgcattgacacaccttattcattcaaatgatgaagaagtcttaactgatgcatgttgggcgctctcatatctttctgatggtacaaatgacaaaatccaagctgttatagaagcaggtgtttgtgggcgtctggtggagctattgatgcacccatgtccttcagtgctaataccagctcttcgcacagttggaaatattgtcacaggtgatgatggtcaaacccagtgtattatcaatcatcaagcgttgccatgccttttaaacctcttgacaaataatttcaaaaagagcatcaagaaggaagcttgttggacaatctcaaatatcacagccggaaataaggagcagatacaggctgtaattgaagctaatattatatctccactggttcatctgcttcaaaatgctgaatttgatatcaagaaagaagcggcatgggccatctcaaatgccacatctggtggtactcatgatcagatcaaattccttgttagtcaaggttgtataaagccattgtgtgatcttcttaactgccctgatccaaggattgttacagtctgtttagaagggcttgaaaacattttgaaggtaggagaagctgataagaacctgggcactaccggaggagtgaatctctatgcacaaatgattgatgatgctgagggtctggagaagatcgagaatttacagtcccacgataacactgagatttatgaaaaggctgtgaaagttctcgagacatattggttggaggaggaggatgagacaatgccgccaggtgatgcctctcaaacagggtttcattttggcgggggtgagcttcctgttccttcagggggattcagtttcagttagaggtatgtagtgctgctgtttgcatgcatttgtttttgtgttggtgcactagtgggagcgtgttatgtcgtttgagatgggactgcatatctgactaccatttgtatgcttttgagctataaaagctgttagtattccaggagttatctggtccagtattgaactccttacggagatgatgggacaatagttttggggagggggtgttccagttgaggcatctagtctttgggttgtgtccacagtcgggtatggtcgaaggtacagtgtgaatggtagcgggctggctgtgggttaacagcacagccaggttcatattatgcatgaagggggaatggagacagaatagagcttggacagtatattgaggaacccagactgagtctatatttaatggtcgtaaaacaaatatattgtgtctttgcaattgcaaaagcttggtttgatgattttggcatatgcccagaacaattatgattcacaggggaatatccttttgcatccatgtaaatccgaacgactccatttagattgttttatatgttgctttgaagtggaaatagacatatataattgttggtttgatatttcttttcatttt

SEQ ID NO: 4922 - DNA, 2209 bp, Cucumis sativus
gaaaaaaaaaaggaaaaagaaaacttcgtaccaatttctccctctcttcttctccggcgaaccaaatcccttaatcctcatcggagtatcgtagatttcctttactaatcggggagaggggggtttgagttcgtctctttggtattcaaatcatgtcgcttagacccaacgagagggctgaggttcggcggaaccggtacaaggttgcggtggatgctgatgaaggtcggagaagaagggaggataatatggttgagattcggaagaatcgtagagaggagagtctgcagaagaagaggcgtgagggtcttcaagcccagcaactccaaacttccactcactcatcggtagtagaaaagaagttggaatatcttccttccatggttgcgggtatttggtctgatgatggtagtctgcaacttgaatcgactactcagtttaggaaacttctttcgattgagcgtagtcccccaattgaagaagttatacaggcaggagttgttcctcgttttgttgaatttctgatgagagaggattttccacaacttcagtttgaagctgcttgggctcttacaaatattgcttcgggaacatcagaaaacactaaggtggtcatcgatcatggggctgtgccaatatttgtgaagcttcttggttctccaagtgatgatgtccgggagcaggctgtatgggcattaggaaatgttgctggggactcttcaagatgtcgtgatttggttttaggtcatggagcattggttcctttattagcacagttgaacgagcaagctaagctttctatgctgagaaatgctacttggacattatcaaatttttgcaggggcaagccacaacctgcttttgatctggtcaaaccagcacttccagctcttgctcgtcttatacattcgaatgatgaagaagttttgactgatgcttgctgggcactttcatacctttctgatggtacaaacgacaaaattcaagctgttattgaggcaggtgtttgccctcgtctcgtcgagctcttaatgcatcctgctccttctgttcttattcctgcccttcgaactgtgggaaacattgttactggtgatgatttgcaaactcaggttattatccaacataatgccctaccttgcctgctaaatttattgacaaacaatcacaagaagagcatcaagaaagaagcttgctggactatatctaatattacggctgggaacaaggcacagattcaggccgttatagatgccaatatagttgctccccttgttcatctgctccaaaatgccgaatttgatattaagaaagaggctgcatgggcaatctcaaatgccacatctggaggctctcatgatcagataaagtatctagtaaatcaaggttgtatcaaacctctgtgcgatcttctaatttgccctgatcctaggatcgtcacagtttgtttagaagggctcgaaaatatcttgaaggtaggagaagctgaaaagaacacaactaatacaggaggtgttaatctatatgctcaattgattgacgatgctgaggggctagagaaaattgagaatctacagagtcatgacaacaccgaaatttatgaaaaggcagtgaagatcctcgagacctactggttggaagaggaagatgagactatgccaccaggtactgatccccaagctggattcaattttggtggcgatcgacctgtcgtaccatctgggggattcaactttggctgagaaggctttccccgaggctatttcgacaacatctccagtcacatcgggtcaggtcaggcgtgttatgttgttgtttgcctttgcttatcccagtctcagttatattttagcgtgttggttgactgggttgaatgctttttatatgagtttgggattgactggtgatgagacagtggaatatatatatactatatcaatcggtaatatagtttccacagatctgagaaatcggagcgatttcatttgggcaaactgtgattttttattgttttttcttagttggtctacttgtcagaaacatggagtctaagcattgttttttccctccctttttacatcattacgctcttatatttttttgttcatagttttttccgtagagcaacttttagaattatagcagataccattttggctagctggcttctatatgttgttacttttaaacaacacatgcaaggaagttt

SEQ ID NO: 4923 - DNA, 2678 bp, Taxus baccata
taggttcgaatcccagaagattagggtttttctctgtgcgagtttttagggtttgaatcatctgctatattttgagcagattagggtttgtagggtttgaagctccttattttgggcgttggattgtggattgtttggattgtttcagccatgtctctcaggccggtttcgaggactgaggtccgcaggaagaactacaaggtggctgtggatgccgatgaagcgcgcaggaagcgtgaagacaatatggtggagatcagaaaaataagagggaagaaagcctgttgaagaagaggagagagggtatgcaagcgcagcagttcgctcccgccgtgcagtcatcggccgttgaaaaaagttggagagccttccagccatggttgctggagtgtggtcagacgatcctgcattgcagcttgaagcaacaactcaattccggaagctgctttcaattgagcgcagtcctcccatagaggaagttattgaagcaggtgtggttccacgatttgtggagtttcttacaaggcaggactttccacagcttcagtttgaggcagcatgggcattgacaaatatagcttcggggacatctgagcatactagagtagtcattgaccatggagcagttccaatttttgtacaactccttagttctccaagtgacgatgttcgggagcaggctgtctgggcgttgggtaatgtggctggtgactcccccaagtgcagagatctagttcttactcacggtgctcttatgccacttctagctcaattgaatgagcatgccaagctttcaatgttgagaaatgcaacatggactctatctaatttttgccgaggcaaaccacaaccagcgtttgagcaaacaaagccagcactccctgcacttgagcggcttattcattcaaatgatgaagaggttttgacagatgcttgctgggctctgtcttatctctctgatggcacaaatgataaaattcaagctgtaattgaggctggtgtctgtcgtaggcttgttgagcttctgctccatccctctccatctgtacttattccagctctcagaacagtgggcaatattgtaactggtgatgatgtacagactcagtatatcatcaacaaccaagcactcccttgcctcttagctctcttgacccataatcacaagaagagtattaagaaggaagcatgctggaccatctcaaacatcactgcaggcaacaaagaacagattcaggcagtgatcgatgcaaacatcattcctccccttgtccagctccttcaaactgccgaatttgatattaagaaagaagcagcatgggctatatcaaatgcaacttctgggggtacacatgaacagattaagtatctggtgaatcaaggatgcatcaagcccctgtgtgatcttttagtctgtccagacccaagaattattactgtttgtcttgaaggtctggagaacattttgaaagttggggaagccgagaaggaccttggtaacacttctggtgtgaatctatatgcccagtatattgatgatgctgaaggactggagaagattgagaacttgcagagtcatgataacaatgaaatttatgagaaggcagtgaaaattttggaaacttactggttggaagatgaagaagatgatcaagcattgcctgcaagtggagatgctcgcccccccagcattcaatttcggtacaaatcaaccatcagtgccatctggtggattccagtttggttgaggaggtatttgagctgttgcaagttggggggctatgttatgagtgtcttgaatgactttccaagattgtgtatctgtgctgtagtccgtcattgcaaggataatgcttggtttctggatggtgctggtgacaggccaattgttggtatgtcagtctgacaatactaaccaaatcatgcagacatgagctcctcgaaactaatgagtcagcctcatttggcttggtagtacagtgttcatgctgtattatatggactgtccgagccaccttctgccctttagagctctgtatcagagcttactgctgtcttgagtcatgtgccatgccttctggtttttgcacaatccctttaacaggtctcaacggtcatactaattcttgttatgtatgcattgtactcttcattgcatcaagaaagttgtcatatctggtattgtgacacaagtcagtctcatggtctgggaaaatggcctacactactaaccttgggttgcaggacaatcctaaatcccaaaagcatgcatgtctatcatgcatgctcatattctccaggaattttgcctggagttttttttggatcatcgatttctaagttgatgatcactgacccccatctctctcatcctcttataatgtgtcaatctgtgcatcattttccattgctccatcttcttctggaaaccccgtttgaagggatttcttacttatttgttactttgtcagtgtgtcctctacatcccgttgccagtggtcattctattaaggttgctatacatcttttttggacagttctatgtacttgcatgtatatttgtttccaaataatttttggagactattttgccaattgtcagtagttactggtaatgaattgaaagattactgttcacaatggtatatttaaaaaagatatctggaattgggatatgg

SEQ ID NO: 4924 - DNA, 2482 bp, Catharanthus roseus
ttttcataccccaagattattgcgctccaggttttgattgattaactgtgtgggaaaagtaccaaaagactaaggaaagatgtcgctgagaccgaatgagaggacagaggttcgtaggaaccgatacaaggtagcggttgatgcagaggaaggaagacgtaggagggaggaccaaatggtggagatccgcaagagtaagcgtgaggaaaaccttctcaagaagcgacgtgaaggcctccaaatgtcgcaaccttttccgacgaccctccctgctagtaatgtcgagaagaagttagagagtcttccttctatggttgctggggtttggtcaaatgatagtaacttgcagctggaagcaaccactcagttccgtaaactgctctcaatcgagcgaagcccccctattgaggaagtcatacaatctggagttgttcctcgctttgttgagtttcttatgagggaggatgtccctaatcttcagtttgaggcagcttgggctcttacaaacattgcttctggaacctcggagaatactaaggtggtgattgatcatggagctgtacccatatttgttaagctcctgcaatctccaagtgatgatgttcgcgagcaggctgtatgggcattgggaaatgttgctggtgactctccaaggtgccgtgacctggtcctcagccatggagctttaattcccttgctgtctcagttgaatgaacatgccaagctgccaatgctgagaaatgccacttggacactctccaacttctgccgtgggaaaccacagcctccatttgagcaggtgaggccagcacttccagcacttcaacgtcttgttcattcaaatgatggagaagtgttaactgatgcatgctgggctctctcctacctctctgatggtacaaatgataaaattcaagcagtgattgaggcaggtgtctgtgaccgacttgttgagcttctcctacatccatctccttccgtgctcattcctgcacttcgcacagttggaaacattgtcacaggagatgatgttcaaacccagtgtatcattgaccagggagctcttacttgcttgctcagcctcctgactcataatcacaaaaagagcattaaaaaagaggcttgctggacaatttctaacatcactgctggaaataaggagcagatacaggctgtgattgatgctcaactaattggccctcttgtcaatctgcttcaaactgctgaatttgatataaagaaagaggctgcttgggctatttcaaatgctacttctggtggaacccatgatcaaattaagtacttggtttctcagggctgtataaagcctttgtgtgatcttcttgtatgccctgatccaaggattgttactgtctgtttagaggggctagaaaacatattgaaggttggggaagcagaaaagaaccttggcaacactggagatgtcaattactttgcccaattgattgacgaagcggagggcttggaaaagattgagaacctacaaagccatgacaacaatgaaatttatgaaaaggcagttaaaatactggagacatattggttggaggaagaagatgctgtattacctcctggtgacggagcccaaccagggtttaattttggaggaaatgatgtccaacttccttctggaggatttaaatttggctagaggcctatcaatggtggctgtaacctcagtttggggacatggtgtgttggcgtcaagtcaagtcaaagtccggtctggtcaggtcgggtcaaagtcaaggtcaagtcagagcacctcgggagtttggttatggtgtattgtccagagtctgtcatgtgaagaggtgcaaaggcaggttactgagtactacaatggggaataagaaagggtgcaagctcagagattgatggtaacaggggcttggttctttccgggatatggtttgggggaaattgaaggggacgatagtctggtgcaaatgagtctgcagaaatcaggagtcttttatgtctttcatgctttgtaattgcagtctttagtcttcaaaaggagttgtccatatggttttgtcacttgcttaagtgtgagagatatttagtattcatgacatttatttgcatacaatattctgcaaaaggatgaaagcatggaaacaacctttgtttttctatggaatggtcttatttttctaatacacatttgatttctaatttctcccttcttgattgtctgtcttgtgagggtggtggtgtaaactttacctagctaccaaatcgcgatccagatatttcttactaaagagaacactgacttgttctacgttacctggtaattgcttagtttatattgtttagaagtatagtgtggggtatgtagtatacgtaagtcttacgttaagttaaaactttaacgtccgtaagtagtcgtactagttacggtacttacgtaattacggtcggtaccgggtttaggttaacgttaacggttacc

SEQ ID NO: 4925 - DNA, 2018 bp, Eschscholzia californica
ctttctctctctacctccattaacagtgtttctagggtttatttgattgaacaaacaacatcatgtctcttagacctaacgctagaactgaggttagacggaacagatacaaagttgccgtcgatgccgatgaaggaagaagaagaagagaagataatatggttgagattcgaaagaataaaagagaagaaagtttacagaagaagagaagagaaggtatgcaaccacaacaattttcgtcttccattcaaggaaacaacgtcgttgagaaaaagcttgagagtcttccttcaatggttgctggggtttggtcagacgaaaaagagttgcaactggaggcaactacacagttccgaaaactactttctattgaacgtagtcctccaatcgaggaagttattcaatctggtgttgttcctcgttttgtggagtttcttatgagagaggattacccacagcttcagtttgaggcggcttgggcacttacaaacattgcttctggcacatctgagaatacaaaagttgtgattgatcacggggcagtccctatctttgtcaagcttcttggttctccaagtgatgatgttcgtgaacaggccgtatgggcgcttggaaatgttgctggtgattctccgaaatgccgtgattacgttcttgagcaaggagctcttatgccattgcttgcacagttgaatgaacatgccaaactttctatgttgaggaatgcaacctggactctatcaaacttctgcaggggcaaacctcagcctctttttgagcagacaaagcctgcacttccagctcttcagggtcttatacactcaaatgacgaggaagttctcactgatgcttgctgggcactgtcatacttgtctgatggtaccaacgacaagattcaagctgttattgaatcaggcgtttgccctcggctagttgagcttttactacatccatctccttctgttctcatacctgcccttcgcacagtcggcaatattgtcactggagatgatatccagacgcagtttatcatcaaccatcaagcattaccttgtcttttgaacctattaacgaacaatcacaagaagagcatcaagaaggaagcttgctggaccatttcaaacatcactgctggaaacaaggatcaaatacagactgtaatcgctgctggtatcataggccctctgatccatctacttcaaactgctgaatttgatatcaagaaagaagctgcgtgggcaatctcaaatgctacctctggtggtgctcatgagcaaatcaagtatatggtggatcaaggttgtataaaacctctttgtgatctcctaatctgccctgatccaagaatcgttacggtttgtttagaaggtcttgagaacatcttgaaggtcggagaagccgaaaagaatttagggaacagtgaaggtgttaacatatatgcacaattgattgatgatgctgaagggttagagaagatcgaaaaccttcagagtcatgataacactgagatctacgagaaagccgtgaagattctcgaaacttattggttggaagaagacgatgagcaattacctcctggtgatgatgcttcagcccaatctgggttccaatttggagggaaccaaccaccagttccttctggtggattcaacttcagttgaaggattttatagtcggagtggaatgaagtatatgtccgaaacgtcaaagaacatggcgaaatggagtgtgagagtctgagttgggtactaggtcagggggttcaagagggtcaagtctaatggcgtcgtggggtctcttccagtgttggtggtttgcaaaagaaatataattatgattgagcattttgtcttgggctgttcttttgctcttttgagaggcaatatgaacttgtggttgggaatgataatggatcttttttttgtgtcttttaagtgggtctagggttaggtcttcttcttttattgaccgggaattgtgtgttgaagtagtagagttgtccaacattaaaggaatta

SEQ ID NO: 4926 - DNA, 2368 bp, Euonymus alatus
ggccggggtctcgtggaattcgaaacgcatgtcaagaaattcttcaacactcccaagccccaggtgctctttttagggttacgaattcatcaaatcaacggagcgatcagcttttccaaccgcgattctctcgttttggtttatcagcgaataatataagcggagatgtcgctgaggccgaacgctaggaccgaggtgaggcggaaccgctacaaggtggcggtggatgtggaagagggcaggaggaggcgcgaggacaacatggttgagatccgcaagaatcgacgggaggagagtttgcagaagaagcgacgtgaggggctccagacgcagcagatacccgcatccatcaactcttcagctgtcgaaaagaagttggaaaatctaccagccatggttgctggagtttggtcagatgataagaacctacagcttgaggccaccacccagttcagaaaactgctatcgattgaacgcagccctccaattgtggaagttattcaagctggtgttgttccacggtttgttgagtttcttatgagggaggactacccacagcttcagtttgaggctgcctgggttcttaccaatattgcctctgggacatcagaaaataccaaggttgtcattgaccatggtgctgtcccaatctttgtgaaacttcttgcttctcctagtgatgatgttcgtgagcaggctgtgtgggcactgggaaatattgctggtgattctccgagatgtcgtgatttagtccttgggcatggagctttgcttccattattgtcacagcttaatgagcacgccaaactttcaatgctgagaaatgctacctggactttgtcaaacttttgccgtggcaaacctcagccaccctttgatcaggttaagcctgcacttccagctctagcacgtcttattcattcaaatgatgaagaagtcttgacagatgcatgttgggcactttcttatctatctgatggtacgaatgacaaaattcaagctgttattgaagcaggggtgtgccccaggcttgttgagcttttaacgcacccatctccttctgtgcttgttcctgcccttcgtacggttggaaacattgttactggtgatgatttgcagactcagtgcatcatcaaccatcaagcattgccttgcctcctgacgctattgaccaataactacaaaaagagcataaaaaaggaagcttgttggactatctcaaatatcacagctggtaacaaagagcaaattcagtctgtaattgaggctgttattattggtccacttgttcatctgcttcaaaatgctgagtttgacatcaagaaagaggccgcgtgggcaatatcgaatgcaacatctgggggtacacgtgaccagatcaagttacttgtaagccaaggttgcataaagcccttgtgtgaccttctcatctgccctgatccaagaattgtcaccgtctgtttagaaggtcttgagaacatcttgaaggcgggagaagctgacaagaatttgggtgatactggaggtgttaatttatatgctcaactgattgatgatgctgagggcttagagaagattgagaaccttcagtctcatgacaatactgagatatatgagaagtcagtaaagattcttgagacatattggttggaagaggaggatgaaactatgccacatggtgatgctcctcaaggttttcagtttggaggtggtgaagttcccacagtaccttctggtggattcaacttcagctaaagaaatcgtagctggtctctatctaccatatattgtggtggagtatggtcgggtgttgtttggaatcgagtacagttggacattgttggagtgaaggtcaggggtcttgtcatcgtttcttggtcctttgtggtccagtgtccttgtatggtcgtgagggttgcttgatgccgatgggcttgggtttagcacatggctaaaaaatttcggagaggtgcaggtggattggctgttatgacgagcatcggcccattttcacaataagctgagaaatgatagttcttttctcatcaagcggttgttccaggaggttggccgcctcttgtgaagatgctgatgagtctttattcccttgtgtctcagttgtcctggttgtcatggtagtgtctttgtatgcattgtcttttctcgcagggtgatttttggcactccctaaatgattatttatatcgttcttattcttacttatgataagttttattctttagaatatagggtgtgttttattgtcatgatttcttgttttctcaagtctttttttgagtctgtatcctacaatatgtaatggttctgatattgcagaagttccatgcgaaataagatacctttgctg

SEQ ID NO: 4927 - DNA, 2872 bp, Pinus pinaster
cctctcagtcaccgatttccattgagtaatcggtcgtctttcgtagggagaacttcagacgattttcgggcgttttcggggtatattaggatttttttcagtagcggccatgtctctcagacccatgtcgcggactgaggtccgaaagaagacgtacaaggtggccgttgatgcagatgaggcccgaaggaagcgagaggataatatggttgaaatcagaaagagtaagagagaggagagccttcagaagaagagaagggagggtatgcaagcgcagcaatttgcacccaccgtgcaatcgtctgccgttgaaaagaagttggagagtcttcctgctatggttgcaggagtatggtccgatgaaccaaacctgcaacttgaagcaacaacccaattccgaaagttgctttcaattgagcgtagtcctcctatagaggaagttattgatgcaggtgttgttcctcgctttgttgaattcctgacgaggcatgattttccacagctgcagtttgaagctgcatgggctttgacaaacatagcttcaggaacatcagagcatacacgagttgtgattgaccgtggagctgtgccaatatttgtacaactgctaagttcaccaagtgatgatgttcgtgagcaggctgtttgggcattgggaaatgtggctggtgactcgcctaaatgcagagatctagttctcagccatggtgccctgatgccactccttgctcaactgaatgagcacgcaaagctttctatgttgagaaatgccacctggaccttgtctaatttctgtcgaggcaagccacaacctgcatttgaccagacaaagccagctctaccagcacttgagcgtctgattcattcgaatgatgaagaagtcttaacagatgcttgctgggctctgtcctatctgtctgatggaacaaatgataaaattcaagctgtgatcgaggctggtgtctgtcgaagattggttgagcttctgcttcatccatctccatctgttcttatccctgctctccggactgttggcaatattgtaactggagatgatgtacagactcagtacattatcaacaatcaggcacttccctgcctcttggcactgttgacccataatcataagaaaagtatcaagaaggaagcatgctggacgatctcaaacataactgcaggaaacaaagatcaaatacaggctgttatcgatgcaaacatcattcctcctcttgtacagttgctgcaaactgctgagtttgatatcaagaaggaagcagcatgggctatatctaatgctacttctggtggtacacatgatcaaatcaaatatcttgtgaatcaaggatgcatcaagcctctatgtgatcttctagtctgtccagacccaagaattgtaactgtttgtcttgaagggctagagaatattttgaaagttggggaagcagagaaggacctggggaacactggaggagtaaatctctatgcacagtatattgacgatgctgaaggacttgagaagattgagaacctgcaaagtcatgacaataatgaaatttatgagaaggcagtaaagattcttgaaacttactggctggaagatgatgaagatgaccagacgttacctgccactggagatgctgcacaaccaacgttcaattttggtgcaaatcaaccaactgttccttctggtggattcacctttggttgaaaaggaatttcagctattgcaacccgggggcgatgctgtgggtgtttcaaagaaaatattccaaggccttattactacactgtagtcagtcagtcgtatgcaagcaaatgcatggtttttggatgttactggtggcaggttacttctgttggtatgtcattatgacagtactaacaaaatcgtgcagatataagctcctcattttgaatgggttggccttaattggcttggtggtacagtttccatgctgtactagtaaggtggtctttgtccataagtcataaaattgcatagttagataaatggactcttatccgatgagccttctgacctttaaagctcaatgcttgagcctattgatatgttgccaagttgaatgccaacttttgggtgtttagacgaagcagtttgatgggtcatgaaggctcatggtaatactaattgtctggttctacttgcatgtgtcctccatttcatcaaagagtctgtcccatatcggtcttgtggctagtaaatggccttactaacatactgttctgggataatcctggaactgtgagaagtgcatgtaatcatgtgctctcttcttctcctctggcattttacccagagtttgcattggatttttcacgttcaagtgagtcctgatccctctcttcccttctctttcttgtgacaaactttggatgacccagagttttgttcggatttccactttcaagtgagtcctatgaccctttttttccctctctttctcgtgctaacatgtggacgggaatagagaaaattctctcttggaagtctgataggatttcctcctcatacgggtacattctgtgtctcagacccctcctgttgccagtggtcattctattttggtagttgaaacttttattaaatcattttatgcactcgcaatatttgtctccggacttggagactgttttgctatgtaatttttagaattctattgttaatgaatttagaggccttctatcaacgttttatatgtttggataaaataagcttgagttttgagatcatgttgggatcgttttataaaatgtctatgcatctgaatggctatacttggtcctcaacattctaatgtgtttcacaaacggtctgcagatatttgacaatggatttcggttgatgttgacg

SEQ ID NO: 4928 - DNA, 2234 bp, Fragaria vesca
ctctcagtccctcccattccaaacactccaaaatctctctccctctctctagggttttctcttcacaccgatcacagttttcagaatacgacatgtcgctcaggccgaacgccaggaccgaggtccgccggaacaggtacaaggtggcggtggacgccgaggagggccgtcgccggagagaggacaacatggtcgagatccggaagagcaagagggaagagagcttgttgaagaagcgccgcgaaggtcttcaggcgcagcaattcccggcgtctgtgcagccggcgaacctcgagaagaggttggagagtctaccgtcgatggtcgccggagtttggtcaaccgatagtgctctgcagctggagtctaccacgcagtttcggaagctactttctatagaacgaagccctccgattgaggaggttattcaagctggtgtggttccccgattcgttgagtttctagtcagggaggattatccgcaacttcagtttgaggctgcttgggctctcacaaacatagcatctggaacatcagacaacaccaaggtggtgattgaacacggggcagtcccaatattcgtgaagcttcttgcttctccgagtgatgatgttagagagcaggctgtttgggcattgggaaacgttgctggtgattctcctagatgtcgtgacctagtcctcagcagtggagccctgatgccgttgctggcccagttgaatgagcatgcaaagctttcaatgctaagaaatgccacctggacactgtccaacttttgcaggggcaagccacagcctcagtttgatcaggtgaagccagctcttccggctcttgagcgtttagttcattccaatgatgaagaagtcttgacagatgcttgctgggcactctcgtatctctctgatggtacaaatgacaaaattcaagctgtaatcgaggcaggtgtatgcccgcgacttgtgcagcttctcttacatccatcgcctgcggttcttattcctgcacttcgcactgttggtaatattgtgacaggagatgaccttcagactcagtgtataatcaccaatggtgcacttccatgccttctgagcctcttgacacacaatcataagaagagcattaagaaagaagcttgctggactatctcaaacatcacagctggaaacagggaacagatacagcacgtaatagaagctggtttgattggccctcttgtcaatttgctccaaactgctgagtttgagatcaagaaagaggctgcttgggcaatttcaaatgctacttctggtggcactcatgagcaaatcaaggtcttggtgactgaaggctgtataaaaccattaagtgatcttcttgtatgccctgatccaaggatagtgaccgtctgcttagaagggttggaaaacattttgaaggtgggcgaagcggaaaagaatttgggtaacagtggaaccaacctgtatgcacagctgattgatgaggctgatggtctggaaaagattgaaaatctgcagactcacgacaacaacgagatttatgagaaggctgttaaaattcttgagacatattggttagaggacgaagatgagacattgccagctggagatgctgctcagccaggcttcaactttggaggcaatgggcctcaagttccaaccggtggattcaattttagctgaaggaactttcaattggacggaggagcagaagtttcctgatatgggttaagttggggtcaagttcaggtcgagtcggggtggtcggggcatctcgtgtgtctggtttcagtttggtctggtgtccattgtggtcaagaggtgccaaggtgggtcggtctgtttactctattacgagtctatgaccaaataagaagagatgggtcggtttgataatggcagggcgttgggttggcagggatgattatcactgcatcctaacgcgaagtactatggaagtgtcggtagtggctcgatgttggcatatacagggcccctaaacgcatgtgctagtgagggtggtttctcaaatgcagcatcgagctcaatctttttattacgagtcgtagtctgtatgagtattttttccagagtcgggatttgttttgccttgtcgagtgaatatagatttgttaaaatcattttcgggtgtattccaaggagaaaggtctagctgtattttggtaattaccttgtgaaatattaatatttcagcctagttaaagtctattttgaata

SEQ ID NO: 4929 - DNA, 2292 bp, Glycine max
tggcattttcgcaaatacacgccgatccaggtccacttccgcttctgtcccaattcaataaaccctcttctctcttttcaaactcccaattcccaaacaataagacccccaaaccctcattctctccattgccatcacaaaccctacgcttcgacgatgtcgtatcgaccttccgccaacgccaggaccgaggttcgtcggaaccgctacaaggtcgccgtggacgccgatgaaggtcgccgtcgccgagaggataccatggtggagatccgaaagagccgtagggaagagagtttgcagaagaagagacgcgagggtctccaatcgcagcagattccttcgtcacttcactctactgtaatagagaagaagttggaacaccttccagccatggttacaggtgttttcaccgatgacaataacatgcagttagaggccacaactcaatttcggaagttgctttcaattgaacgtagcccaccaattgaggaggttattcaagctggtgtagttccacgctttgttgatttcttgatgagggaagattttccacagctgcagtttgaggcagcttgggctttgacaaatatagcttctggaacatctgaaaacactaaggtgataattgatcatggtgctgtcccaatttttgtaaagctacttggttctcccagtgatgatgtccgtgaacaggctgtttgggcattaggaaatgttgctggagattcacctagatgccgtgatcttgttctcggtcatggagctttgcttcctctattggcacaattgaatgagcatgccaagctttctatgctaagaaatgctacctggacactatcgaatttctgcagggggaaaccacagcctgcttttgatcaggttaaacctgcacttcctgctcttgccagtcttatccagtcaaatgatgaagaagtcctgactgatgcttgttgggcactttcatatctttctgatggtacaaatgacaaaattcaaggtgtaattgaagctggtgtttgtagccggcttgttgaccttcttttgcacccttccccttcagtgcttattcctgctcttcgtactgttggaaatattgttacaggagatgatttgcagacacaggtcatcattaaccatcaagctctcccacgtcttctgaatatcttgactaataattataaaaaaagcataaagaaggaagcatgctggaccatatcaaacatcacagctgggaacaaaaagcagattcaggatgtaattgaggctagtataattgctcctttagtccatttgcttcaaaatgctgagtttgatatcaagaaagaggctgcttgggcaatctcaaatgctacttcaggtggatctcatgaacaaatcaagttcctggtaagtcaagggtgtattaggcccttgtgtgatcttctcatatgtcctgatcctaggattgtgacagtttgtttggaagggcttgaaaacatcttgaaggtaggagaagctgagaaaaatgttagcaatactgatggtgtgaatctatatgctcaaatgattgatgatgctgaggggttggagaaaattgaaaacctccagagtcatgataacactgagatttatgaaaaggcagtgaagattcttgagacatactggatggaggaagacgacgagactatgcctccaggggatgcttctcaatcagggttcaactttggtggcactcaaccacctgcggtgccttctggtggattcgactttaattagaaggagttttgactggtctatcagtaaagtcctccagtttgacagtccaacagtttggggtcaagtcaatgtcctttgattgcccttggctcctacaaggttcagccttggtaaatagggggttgctggaccagcgtgggtttttgaaatggctggttttacatacaccatggggacagatgggttgtggcttgatttcttagccacacaagagttatatatactagagtttgctttctgccaagtgatcattccgaatgatttggctttatagagttgttgtgatcattctggatgttttgacgaaataccaaatgctgctatcttttgcttcatattaatagttacaagatggaatttttctttcaccctttccttgtaagttcttttgaagtttaccgtaaagttctattcattatgttctttaggtctcgttcaggttcgtaatgtaatgtttactaatctggtttaggaaagaagtcttacactttgttctcaggcattatatttggttacagtgtgggattttctcttcca

SEQ ID NO: 4930 - DNA, 2347 bp, Glycine max
caaaaaaaccagtggcatttccgcaaatgcacgccgatccgggtccacttctgcttctgtccccaattcaataaaccctcacttttcaaactcccaaacaatacaacccccaaaccctcttcactttcattcactccgttgccatctcaaacccgaatccaaatccaaatccaacacgatgtcgtatcgaccttccgccaacgccaggaccgaggttcggcggaaccgctacaaggtcgccgtggacgccgatgaaggtcgccggcgccgagaggataccatggtggagatccgaaagaaccgtagggaagagagtttgctgaagaagagacgcgagggtctccaatcccagcagattccttcgtcacttcactctactgtaattgagaagaagttggaacaccttccagccatggttactggtgttttcaccgatgacaataacatgcagtttgaggccacaactcagtttcggaagttgctttcgattgaacgtagcccacctatcgaggaggttattcaagctggtgtagttccacgctttgttgagttcttgatgagggaagattttccacagctgcagtttgaggcagcttgggctttgacaaatatagcttctggaacttctgaaaacaccaaggtggtaattgatcatggtgctgtcccaatttttgtaaagctccttggttcacccaatgatgatgtccgtgaacaggctgtttgggcattaggaaatgttgccggagattcacccagatgccgtgatcttgttctcggtgatggagctttgcttcctctactggcacaattgaatgagcatgccaagctttctatgctaagaaatgctacctggacactatcgaatttctgcagggggaaaccacagcctgcttttgatcaggtaaagcctgcacttcctgctcttgccagtcttatccagtcaactgatgaagaagtattgactgacgcttgttgggcactttcatatctttctgacggtacaaatgacaaaattcaaggtgtaattgaagctggtgtttgtagccggcttgttgagcttctattgcacccttccccttcagtgcttattcctgctcttcgtaccgttggaaatattgttactggagatgatttgcagacagaggttatcatcaaccatcaagctctttcacgtcttctgaatctcttgactaataattataaaaaaagcataaagaaggaagcatgctggaccatatcaaacatcacagctgggaacaaaaagcagattcaggatgtaattgaggctagtataattgctcctttagtccatttgcttcaaaatgctgagtttgatatcaagaaagaggctgcttgggcaatctcaaatgctacttcgggtggatctcatgaacaaatcaagttcctggtaagtcaagggtgtattaagcccttgtgtgatcttctcatatgtcctgatcctaggattgtgacagtttgtttggaagggcttgaaaacatcttgaaggtaggtgaagctgagaaaaatgttagcaatactgatggtgtgaatctatatgctcaaatgattgatgatgctgaggggttggagaaaatcgagaacctccagagtcatgataacactgagatttatgaaaaggcagtgaaaattcttgagacatactggatggaggaagacgatgagactatgccgccaggggatgcttctcaatcagggttcaactttggtggcgctcaacctcctgctgtgccttctggtggattcaacttcaattagaaggagctttggctggtctatcagtaaagtgactaaagtcctccagtttgacagtccaacagttgggggtcaagtcaatgtccttgggtcctacaaggtccagccttggtaaatagagggtggctggaccggcttgggtttttgaaatggctggttttacgtacatcacggggacagatgggttgtggcttgattttcttggccacataaagagttatatttatatatactagagtttgctttctgccaagtgatcattccgagtgatttggcttttataaaattgttgttgagttttgtgattttttctgtcatagattggaatcaggaagtaccatttgtgattctggatgttttgggcgaaataccaaatgctactatctttgcttcatattaatagttacaaggtggaatttttcttttacccttcctttgtaagttttttgaagtttaccgtgaagttctattcattatgttcttcaggtgaggtcaggttcgtagtgtaatgttttactaatctggtctgggaagaagtcttacacagaagatagtatgcaactatgtcttttg

SEQ ID NO: 4931 - DNA, 2572 bp, Phaseolus coccineus
attcaaactcgcatagaaaacccaaaattctctctttactttcccatatccagttatcccaaaccctaccgttaggttccccaattcaacactcccaggaacggtgcgctgcttcttagttcgtacagtttccgtcgattatctctgaaacgatgtcgtatcgcccaagcgggaactccaggaccgatgtccgccggaaccggtacaaggtggcggtggacgccgaggaaggtcggagacggcgagaagacaccatggtggagatccggaagaaccgcagagaggagagtttgcagaagaagaggcgcgaagggctccagcctcaacagattcctgcttccgttcactctactttggtagagaagaagttggaacaccttccatcaatggttgctggtgtttggactgaggacaataacctgcaactcgaggcaacgactcagtttaggaagctgctttcgattgaacgaagtcctccgattgaggaggttattcagaccggtgtagtttctcggtttgtcgaatttctgatgagggaagactttccgcagttgcagtttgaggctgcttgggctttgacaaatatagcttctggaacctctgaaaacaccaaggtggtgattgaccatggggctgtcccaattttcgtgaagctacttgcttctcccagtgatgatgtccgtgaacaggcggtgtgggcattaggaaatgttgctggggattctcctagatgtcgggaccttgttctcggtcatggggcattgattcctttgttagcacaattgaacgaacaggccaagctttctatgcttagaaatgctacttggacactttcaaacttctgcaggggcaagccacagcctccttttgatcaggttaaacctgcactgcctgctcttgcacgtcttatccattcaaatgatgaagaagtcttgactgatgcatgttgggcactgtcatatctttctgatggtacaaatgataaaatccaagctgtaattgaagctggtgtttgtccccgacttgttgagcttctgatgcatccatccccttcagtactaattcctgctcttcgaactgttggaaatattgtcactggagatgatatgcaaactcaggttatcatcaatcatcaggctcttgcttgccttctgaatctgttgaccaataattacaaaaaaagcattaagaaggaagcttgttggactatatcaaatattacagctgggaataaacagcagattcagtctgtgattgaggctaatttaattactcctctggtcaacttacttcaaaatgccgagtttgatatcaagaaagaggctgcttgggctatctcaaatgctacatccggtggttcccatgaacaaatcaagttcctagtaagtcaagggtgtattaaacccttgtgtgatcttctcatctgtcccgaccccaggattgtgacagtttgcctggaaggccttgaaaacatcttgaaggtgggagaagctgataaaagtattggcaacactggtgatgtgaatctatatgcccaaatcattgatgacgctgaggggctggagaaaattgagaacctccagagtcatgacaatacagagatttatgaaaaggcggtgaagattcttgagacatattggttggaggaggatgacgagactatgcctcctggggatgcttctcagtcagggttcaactttggtaacaatgacgctcctgctgtgccttccggtggatttaactttaattagaagatgctcatgctctactgggggagttttggttggtctatcagtgtaatgtcctccattatgacgggacagcagttgggggacaagtcaacaaagtcttgtcattgtcattgtcattgggtcttacaaggttcagcaagtaaatacatggttgctggaccggattaggtttttgcagtgcctggtgtttcatatctcattgtgtaaaatgctttgtggctatatttttttgccaccgtagagtcttctttctgccaagtgatcattccatagaatcaatgaatgctcagtctcgtatttttttttatcttgatatatatgtcatagattgcagttgaagttacgattggttttttggcaaatgccaaatgctaaatagttacaaggaacgttggagtctttcttttatccccttcctttgtaagctttattggctgaagtttaccccatcgtagttccattattatcaggttatgtaggtcctggttaattatttagtacttcagctttggactttgtttccaaaagaaaatatgctgcaattattgtgtaatctcaacattatatttatactcgggactattagtctatacttctaatccgtttcaggctagttatgtgcattcactccacgtgttcaaaagtggaaagacagaatgtcctatgctattagttcagctagggcaaagggtcttttgatagtctaaacggcttctactttagtaagaatctagatgcagaggatgtaaaatgagaaaataaccttcaaagaagttctaagttcattttctctagtattaaatgaatcatttatattttac

SEQ ID NO: 4932 - DNA, 2839 bp, Pinus taeda
tttccattgagtaagcggtcgtctttcgtagggagaacttcagacgattttcaggcgttttcggggtatattaggtttttttttagtagcagccatgtctctcagacccatgtcgcggactgaggtccgaaagaagacgtacaaggtggccgttgatgcagatgaggcacgaaggaagcgagaggataatatggtcgaaatcagaaagagtaagagagaggagagccttcagaagaagagaagggagggtatgcaagcgcagcaatttgcacccaccgtgcaatcgtctgccgttgaaaagaagttggagagtcttcctgctatggttgcaggagtatggtctgatgaaccaaacctgcaacttgaagcaacaacccaattccgaaagttgctttcaattgagcgtagtcctcctatagaggaagttattgatgcaggtgttgttcctcgctttgttgaattcctgacgaggcatgattttccacagctgcagtttgaagctgcatgggctttgacaaacatagcttcaggaacatcagagcatacacgagttgtgattgaccgtggagctgtgccaatatttgtacagctgctaagttcaccaagtgatgatgttcgtgagcaggctgtttgggcattgggaaatgtggctggtgactcgcctaaatgcagagatctagttctcagccatggtgccctgatgccactccttgctcaactgaatgagcacgctaagctttctatgttgagaaatgctacttggaccttgtctaatttctgtcgaggcaagccacaacctgcatttgaccagacaaagccagctctaccagcacttgagcgtctgattcattcgaatgatgaagaagtcttaacagatgcttgctgggctctgtcctatctgtctgatggaacaaatgataaaattcaagctgtgattgaggctggcgtctgtcgaagattggttgagcttttgcttcatccatctccatctgttcttatccctgctctccggactgtgggcaatattgtaactggagatgacgtacagactcagtacattatcaacaatcaggcacttccctgcctcttggcactgttgacccataatcacaagaaaagtatcaagaaggaagcatgctggaccatctcaaacataactgcaggaaacaaagatcaaatacaggctgttatcgatgcaaacatcattcctcctcttgtacagttgctgcaaactgctgagtttgatatcaagaaagaagcagcatgggctatatctaatgctacttctggtggtacacatgatcaaatcaagtatcttgtgaatcaaggatgcatcaagcctctatgtgatcttctagtctgtccagacccaagaattgtaactgtttgtcttgaagggctagagaatattttgaaagttggggaagcagagaaggacctggggaacactggaggtgtaaatctctatgcacagtatattgacgatgctgaaggacttgagaagattgagaacctgcaaagtcatgacaataatgaaatttatgagaaggcagtaaagattcttgaaacttattggctggaagatgatgaagatgaccagacgttacctgccactggagatgctgcacaaccaacattcaattttggtgcaaatcaaccaacagttccttctggtggattcacctttggttgaaaaggaatttcagctattgcaacccgggggcgatgctgtgggtgtttcaaagaaaatattccaaggccttattactacactgtagtcagtcgtatgcaagcaaatgcatggtttttggatgttactggtggcaggttacttctgttggtatgtcattatgacagtactaacaaaatcgtgcagatataagctcctcattttgaatgggttggccttagttggcttggtggtacagtctccatgctgtactagtaaggtggtctttgtccataagtcataaaattgcatggttagataaatggactcttatccgatgagccttctgacctttaacgctcaatgcttgagcttattgatatgttgccaagttgaatgccaacttctgggtgtttagacgaagcagtttgatgcgtcatcaaggctcatggtaatactaattgcctggttctacttgcatgtgtcctccatttcatcaaagagtctttttcatcaaagagtctgtcccatatcggtcttgtggctagtaaatggccttactaacatacttttctgggataatcctggaactgtgagaagtgcatgtaatcatgtgctctcttcttctcctctggcattttacccagagtttgcattggatttttcacgttcaagtgagtcctgatccctctctccccttctctttcttttgacaaactttggatgacccagagttttgttcggatttccactttcaagtgagtcctatgacccttttttctccctctctttctcgtgctaaactgtagacgagaatagagaaaattgtctcttggaagtctgataggatttcctcctcatacggtacattctgtgtctcagacccctcctgttgccagtggtcattctattttggtagttgaaacttttattaaatcattttatgcactcgcaatatttgtctccggacttggagactgttttgctatgtaattttttagaattctattgttaatgaatttagaggccttctatcaacgtttttatatgtttggataaaataagctcgagttttgagatcatgttgggattgttttataaaatatgtctatgcatctgaatggcaatacttggtcctcaacattctaatgtgtttcacaaacggtctgc

SEQ ID NO: 4933 - DNA, 2947 bp, Podocarpus macrophillus
tctctattggctgtgaagtccgtgttcgaatccgagcgaggtcgaaagaagttttgtgcgtacactagggtttgtagggtttgaaaggtttctgcaacgacattctttggttgtctagggtttctgcgaccatgtcgttgaggccgatttcccgcacagaggtgcggaagaagagctacaaggtagccgttgacgcagatgaggcgagaagaaagagagaagataatatggtggaaatccgcaagaataagagggaggagagtcttctcaagaagagaagggagggaatgcaggcgcagcagttcactccacaggtgcagtcgtctgccgtcgagaaaaagttggaaagccttcctgctatggtgggtggagtatggtccgatgatccttctttgcagcttgaagcaacaacacaatttcggaagcttctgtcgattgagcgcagtcctcccatagaggaggttattgaagcaggggtggttcctcggtttgtggagttccttacaaggcaggacttcccacagcttcagtttgaagcagcttgggcgttgacaaatatagcttcaggaacttccgaccatactcgagttgtgattgaccatggtgctgtgccaatatttgttcaacttcttagttctccaagtgatgatgtgcgggaacaggctgtctgggccttgggaaatgtagctggtgactctcccaagtgcagagatcttgttctttctcatggtgctctcatgccacttcttgctcaattgaatgagcatgctaagctttcaatgttgagaaatgccacatggactctctctaatttctgccgaggcaaaccacaaccagcatttgagcaaacaaagccagctcttccggcacttgagcgacttattcattcaaacgatgaagaagttctgacagatgcctgctgggcactttcttatctctctgatgggacaaatgataaaattcaagctgtgattgaggctggtgtttgccgtagacttgttgagctcctgctccatccttctccatctgttctgatacctgctcttcgaactgtgggaaatattgtaactggtgatgatgtgcaaactcagtacatcatcaacaaccaagcacttccttgtctcctagctctcttgacccataatcacaagaagagtatcaagaaggaagcatgctggactatttctaatataactgcaggcaacaaagatcagatacaggctgtgatcgatgcaaatatcattcccccacttgtacagctgcttcaaactgcggagtttgacatcaagaaagaagcagcatgggctatatcaaatgcaacatctggaggaacacatgaacagataaagtatcttgtgaatcaaggatgcattaagcctttatgtgaccttttggtatgcccagatcctcgcattattactgtttgcctcgaaggacttgagaatattttgaaagttggagaagctgagaaagaccttggtaattctggaggtgtgaatctgtatgctcagtatattgatgatgctgaagggcttgagaagattgagaacttgcagagtcatgataacaatgaaatttatgagaaggcagtaaaaattcttgaaacatactggttggaagatgaagaggatgatcaggcactacctgctggtggcgatgtcgctcagccagcattcaattttggctcaaatcagccatcagtgccatctggtggattcaactttggttgaggaggaatttgaaccatcgtgtccagtggggggtgggggtatgcaagttgcgaattgaacttcaaggttgtttatctgtgctgtagtccgtcatgcaaggaaaatgcttggtttttggatgatactggtgacaggctatttctgttggtaatgtcagttggacaatactaacttgatcatgcaggcatgagctcctcggtctaagggtcagccttgttatggcatagtagtacagattgcatgctgtattattgtctttgtccataagtaccagtgaagaagcaatggttggatgaatggactgcctacggagctaccttctgtcttcttatagctccatgctggatggagctaattgtccgagtcaggttccatgcctctatgggcatgtgtgctttgttgcatcaagaaaatgaacagtcatgtttgatgtgatatgtggaagtcagtcttgcagccagtgggattggcttaccattaaccttggatgttgggataatcccgattcctcagaatgcatatttatcatgcattctcatagtctcttggggattttgcctatgaggctttttttggactgtcacttcaaagttgacggtcatcagttctgttttctttgtcctccttgtttatgtgtcttatctggccatgtcccttttcttagtgtcttgatatgtatgcatttgtgttaaaatgttttatttaatctgcttccgtcttattgagtttaactgacgacttctctccgttttaatgtgtcaatctgtcccatcatgcataattgttcatttaccgacaattagttctgttgcttcctggagtgtgtcaaaacggagtacttctcttcgttttaatgtgtcaatctgtcccctctgtcctgcattagttgttcatttactgagttagttctgttgcttcgtggagtatgttaaagggatttttcttctcttattttgtcagtcagtctccctcctgttgccagttgtcattctatcaattgttatttggtatgaatcttttttggacagttctatatatactttgcatgtattactggtaattgttttaagtattcattactggtaatgaattgaaagacttccatttcttgaaaagataaagcatcgaaggatgtatgtattggattgttttggaaaacgctatggatgttgggctgctcaacaattgtgtctttttgaagataaattcaaattgcg

SEQ ID NO: 4934 - DNA, 2825 bp, Picea glauca
  misc_feature (750)..(750): n is a, c, g, or t
ggtcattggcctttcgtagggagtactttggacgccgatttccattgagtcattggcctttcgtagggagaactttggacgattttcaggcgttttcgggttatatattcgggttttattcagtagcagccatgtctctcagacccatgtcgaggactgaggtccggaagaagacctacaaggtggccgtcgatgcagacgaggctcgaaggaagcgagaggataatatggtcgaaatcaggaagagtaagagggaggagagccttcagaagaagagaagggagggtatgcaagcgcagcaatttgcccccactgtgcaatcgtccgccgttgaaaagaagttggaaagtcttcctgctatggttgcaggagtatggtccgatgaacctaacctgcaattggaggcaacaacccaatttcgaaagttgctttcaattgagcggagtcctcctatagaggaagttattgatgcaggtgttgttcctcgttttgttgaattcctgacgaggcatgattttccacagcttcagtttgaagcagcatgggctttgacaaacatagcttcaggaacatcagagcatacacgagttgtgattgaccgtggagctgtgccaatatttgtacagctgctcagttcaccaagtgatgatgttcgtgagcaggctgtttgggcattggggaatgtggctggtgactcacccaaatgcagagatctggttctcagccatggtgccctgatgccactccttnctcaactgaatgagcatgctaagctttcgatgttgagaaatgccacttggactttgtctaatttctgtcgaggcaaaccacaacctgcattcgagcagacaaagccagctcttccggcacttgagcggcttattcattctaatgatgaagaagtcttaacagatgcatgctgggctctgtcttatctttctgatggaacaaatgataaaattcaggctgtgattgaggctggtgtctgtcgaagactggttgagcttctgctacatccatccccatctgttcttatccctgctctccggactgtgggcaatattgtgactggtgatgatgtacagactcagtacattatcaacaatcaagcacttccctgcctcttggcactgttgacccataatcataagaaaagtatcaagaaggaagcatgctggaccatctcaaacataactgcaggaaacaaagatcaaatacaggctgtgatcgatgcaaacatcattcctcctcttgtacagttgctgcaaactgcagaatttgatatcaagaaagaagcagcatgggctatatctaatgctacctctgggggtacacatgaacaaatcaaatatcttgtgaatcaaggatgcatcaagcctctatgtgatcttctagtctgtccagacccaagaattgtaactgtttgtcttgaagggctagagaatattttgaaagttggagaagcagagaaggacctagggaacactggaggtgtgaatctctatgctcagtttattgatgatgctgaaggactcgagaagattgagaacctgcagagtcatgacaacaatgaaatttatgagaaggcagtaaagattcttgaaacttattggctggaagatgatgaagatgaccaaacattacctgccactggagatgctgctgcacagccaacattcaattttggcacaaatcaaccaacagttccttctggtggattcacttttggttgaaaaggaatttcagctattgcaacccggggggcaatgccgtgggtgtttcaaagcaaatattccagggccttataactacattgtagtcagttgcatgtatgcaagcaaatgcatggtttttggatgttactggtggcaggttatttctgttggtatgtcattatgacagtactaactaaatcgtgcagatataagctcctcattttgaatgggttggccttagttggcttggtggtacagtttccatgctgtaccagtaaggtggtctttgtccataagttctaaaattgcatagttagataaatggactcttatctgatgagccttctgacctttaaagctctaagcttgagctaattgataatgttgccaagttgaatgccagcttctgggtatttagacggaagcagtttgatgggtcatcaaggtttatggtcatactaactgcctggttctacttgcatgtgtccttcattgcatcaaagagtctgtcccatgtcggtcttgtggccagtatttggccttactaacatactgttctgggatgatcctggaaccgtgagaagtgcatgttatcatgtgctatcttattttcctctggtgttttgcccagagttctttttggattttcacaatcaagtgagtcctctgacctttctctctcttctctttcttttgccaaactaaggatgagccagagttttctttggtttttcacgctaagtgagtcctctgacccttctctttcaatctctatctctctttctatccctctccttctcgtgtctcagacccctcctgttgccagtggtcattctattttggtagttgaaacttttattgaatcattatatggactcgcaatatttgtctccggactggagactgttttgctatgtaattttttagaattctattgttaatgaatttggaggtcttctatcaacgattttatatgtttggataaaataatcacgagttttgagatcatattgggattgttttataaaatataaataggaacgtatcttctactgtattgaaacatctgaatggttctgctttgtgcttaagattctaatgtgtttcaca

SEQ ID NO: 4935 - DNA, 2729 bp, Gossypium raimondii
gattccggtgagttaggttttctccccaacgttcaaatttaaaatcagtggcaccatcgtaattatcatcacatcaaactcatattccaccagaaagaaaagaataaataatttcgaaaaggaaagtaaaccagaaaaagaaagaaaaaagaatcccctctctctgtaaagtataaaacaatatatctttccttagcttcggcccaacgtctctcccgatccaataatacgaataacgttccaaaaaccctcttccccttccactctctctctctgtcattttctcaaacaactgatcggttctttccgaaaatcgtacgccgtatttcacctgccaattaatcagtgattcgatcggattgactgaaaaaaataaacaggcgaagatgtctcttagaccgagcgcgaggaccgaggttcgacggaaccgatacaaggtggcggttggtgcggaggaaggtcggcgaaggagagaagacaacatggtggagatacggaagaacaagagagaagagaaccttctaaaaaagcgtcgcgaaggacttcttgctcaacaaccgcaaccgcagcaacagcagatgttatcttccggcgttggttccgagaataagttagaaagtcttccggctatggttgtgggcgtttggtctgatgacaagaatgcgcagcttgaggcaaccactcaattccgaaagctgctatcaatagaacgtagtcctccaatcaatgaagttgtacaagcaggtgttgttcctcgctttgttgagttccttaatagggatgacttccctcagcttcagttcgaggcagcttgggctctcacaaatattgcttcaggaacatcagacaataccagagttgtaattgatcatggagctgtccctatatttgttaaactcctaggttctccaacggatgacgtacgcgaacaggctgtttgggcattggggaatgttgctggagactctcctaaatgccgtgacctggtccttggccatggggccttagtgcctcttttggcacaatttaatgagcatgcaaagctctctatgttgcgaaatgctacctggactttgtcaaacttctgcaggggcaagccacaaccttcatttgagcagacaaagccagctttgccagctcttgagcgccttatcaattcaaatgatgaggaagtcttgacagatgcatgctgggctctgtcatatctctcagacggtactaatgacaaaatccaagctgttattgaggcaggtgtatgcccacgacttattgagctcttgcttcatccatccccaacggtcctcattcctgcccttcgcacagttggaaatattgttacaggggatgatatgcagactcagtgcattattggccaccaagctcttccctgcctcttgaacctgttgacaaatacctacaagaagagtatcaagaaggaagcttgctggaccatctcaaacatcaccgctggaaatgtagatcagatacaggctgtaattgaggctgggattattgcccctctagtccatctccttcaaaatgccgagtttgagatcaagaaagaagctgcttgggcaatttcaaatgctacatctggtggtacccatgaacaaataaagtttttggtgagccaaggttgcattaagccattatgtgatcttctgaactgtcctgacccaagaattgtcacggtttgtttagaaggtcttgaaaacattttgaaggttggtgaagcagagaaaaatctgggtcacactggagacgtcaatctctatgcccagttaattgatgatgctgagggattggaaaagattgaaaacctccaaagtcatgacaacaatgaaatatacgagaaggcagtgaagattcttgaaacttattgggtggaggatgaggacgagcctttaccccctggtgatgctgcacaatctgggctccaatttggaggcaatcaacttcctgtcccctctggtggattcaatttcaattgaaggaagcttggttggagtggaatgaaactcagtggtcagtactttcttggtgtttctcggaattcacatatcgttcaagtaatgcataagtatgtcctcaagaagtcatcaaataaagacaaggtggtaaagacgcttgaagagtccagaagccgtacaaatatttgtttttctactttatctttgcagtagttcattctttttcagcatcgtaatacttggatgcaagggtcgaggcatgcagctccatgtcctaccttctgcttttttcccttgttttatatcagtttactttcttcattaaaggtcttctttgttttttttaaaaaaaaaaaaatttagatatttcattttagtaatagttgtggagttactattttggtctttacgatcagttttgaggaagaaaaagaaaatttgatcttttacggtaatgcatcattgtcgaaaaccagaaggatgtttttggagttagaactacagtgtttgttaaatagaattagttttattcctatattttatacccactttcgttaattgcatctcaacttactcttttgcatgaacaaggtaaaaaatttgacctttgaatctttattttttcaaaaaatttaatttgaagattggacctagattcaaaaatattgctttccctctgtgttagagcaatccagggtcggtaaatagggatcgtaacaactgggtttttatttgctccccttgatatcggctcaagtt

SEQ ID NO: 4936 - DNA, 2316 bp, Gossypium hirsutum
gccactcctctccgatccattcgataagctcaaaacctcttctttttattttttgtccatctctcaatcttccaataactgcgtcactctcttcccctctgtcattcctcaaacaacccatcgatcatttcacctacaaattaatcggcgtttcgatcagattgaaaagaagtagcgaagatgtctctcagaccgagcgccaggactgaggttcgaaggaaccgatacaaggtggcggttgatgcggaggaaggtcgccggaggagagaagacaacatggtcgagatccgaaaaaacaagagagaagagaaccttcttaaaaaacgccgcgaaggacttctcgctcaacagcagcaaccgcagcaacagcaactgctctcttcaaccgctggttccgagaaaaagttagaaagtcttccggctatggttgcgggtgtttggtcagatgacagaaatatgcagcttgaggcaaccacccaattccgaaagctgctatcaatagaacgtagtcctccaatcaatgaagttgtacaatcaggtgttgttcctcggtttgtggagttcctgaatagagatgacttcccacagcttcagtttgaggcagcttgggctcttacaaatattgcttcagggacatcagataacaccagggtcgtaattgatcatggagctgtccctatatttgttaagctcttaggttctcccactgatgatgttcgcgaacaggctgtttgggcactaggaaatgttgctggagactcacctaaatgccgtgacctggtccttggccatggggcattggtgccactcttggcacaattcaacgagcatgcaaagctctccatgttgcgaaatgctacctggactttgtcaaacttttgcaggggcaagccacagccttcatttgagcagacaaagccagctttgccagctcttgagcgtcttatccattcaaatgatgaggaagtccttacagatgcatgttgggctctgtcatatctctcagatggtactaatgacaaaattcaagctgttattgagtcaggagtctgcccccgactggttgagctcttgatgcacccatccccaacagtcctcattcctgctcttcgcacagttggaaatattgttacaggggatgatatgcagactcaatgtattataggccaccaagcccttccgtgccttttgaacctgctgacgaatacctacaagaagagtatcaagaaggaagcttgctggaccatttcaaatatcactgctggaaatgtagatcagatacaggctgtaattgaagctggcattattgctcctctagtccatctacttcaaaatgctgagtttgagatcaagaaagaagctgcttgggcaatttcaaatgctacgtctggtggcacccatgaacaaataaagtttttggtaagccaaggttgcattaagccattgtgtgatcttctaaactgtcccgacccaagaattgtcactgtttgtttagaaggtcttgaaaacattctgaaggttggtgaagctgagaaaaatctgggtcatactggagatgtcaatctctatgctcagttaattgatgatgctgagggattggagaagattgaaaacctccaaagtcatgacaacaatgaaatctatgagaaggcagtgaagattcttgaaacatattgggtagaagatgaggatgaggcattacccactggtgatgcttcgcaacctgggttccagtttggtggcaatcaacttcctgttccttctggtggattcaatttcagttgaagaacacttggtggggtggaatggagctgaaaggtcggtattttcttgttttcttttttatggaattcacatatattcgaagtcatgccacagtatgttcttaagaagtcgtcaaataaagacagggtgtacgatacggtaaagagtctggaagccatacaaaatactttaaaattttgcaatgcggtagctattctttttcagcatcctaactctcagatgcaaagggggagagatgcagcccagtattcagacttctggtttttcctcttgttttgaaaggatgtatttgcttcctttattaaaaggtcctttttttttttttcgattttagttatagtttggacatcatttatttggtctttctgttaagaaaatacagctatcaggaaaattttttcttttccggtagtgtattattgtcagaaactgtattggagttataaaatgtctgctaaacatgtctagttgtggtccttctaaatagaatttgatttattcccgaaaaagaaaaagtaccgactgcgactc

SEQ ID NO: 4937 - DNA, 2157 bp, Gossypium hirsutum
aaacaatatatctttccttagcttcggcccaacgtctctcccgatccaataatacgaataacgttccaaaaaccctcttccccttccactctctctctgtcattttctcaaacaactgatcggttctttccgaaaatcgtacgccgtatttcaccagccaattaatcagtgattcggtcggattgactgaaaaaaataaacaagcgaagatgtctcttagaccgagcgcgaggaccgaggttcgacggaaccgatacaaggtggcggttgatgcggaggaaggtcggcggaggagagaagacaacatggtggagatccggaagaacaagagagaagagaaccttctaaaaaagcgtcgcgaaggacttcttgctcaacaaccgcaaccgcagcaacagcagatgttatcttccggcgttggttccgagaataagttagaaagtcttccggctatggttgtgggcgtttggtctgatgacaagaatgcgcagcttgaggcaaccactcaattccgaaagctgctatcaatagaacgtagtcctccaatcaatgaagttgtacaagcaggtgttgttcctcgctttgttgagttccttaatagggatgacttccctcagcttcagttcgaggcagcttgggctctcacaaatattgcttcaggaacatcagacaataccagagttgtaattgatcatggagctgtccctatatttgttaaactcctaggttctccaacggatgacgtacgcgaacaggctgtttgggcattggggaatgttgctggagactctcctaaatgccgtgacctggtccttggccatgggggcttagtgcctcttttggcacaatttaatgagcatgcaaagctctctatgttgcgaaatgctacctggactttgtcaaacttctgcaggggcaagccacaaccttcatttgagcagacaaagccagctttgccagctcttgagcgccttatcaattcaaatgatgaggaagtcttgacagatgcatgctgggctctgtcatatctctcagacggtactaatgacaaaatccaagctgttattgaggcaggtgtatgcccacgacttattgagctcttgcttcatccatccccaacggtcctcattcctgcccttcgcacagttggaaatattgttacaggggatgatatgcagactcagtgcattattggccaccaagctcttccctgcctcttgaacctgttgacaaatacctacaagaagagtatcaagaaggaagcttgctggaccatctcaaacatcaccgctggaaatgtagatcagatacaggctgtaattgaggctgggattattgcccctctagtccatctccttcaaaatgccgagtttgagatcaagaaagaagctgcttgggcaatttcaaatgctacatctggtggtacccatgaacaaataaagtttttggtgagccaaggttgcattaagccattatgtgatcttctgaactgtcctgacccaagaattgtcacggtttgtttagaaggtcttgaaaacattttgaaggttggtgaagcagagaaaaatctgggtcacactggagacgtcaatctctatgcccagttaattgatgatgctgagggattggaaaagattgaaaacctccaaagtcatgacaacaatgaaatatacgagaaggcagtgaagattcttgaaacttattgggtggaggatgaggacgagcctttaccccctggtgatgctgcacaatctgggctccaatttggaggcaatcaacttcctgtcccctctggtggattcaatttcaattgaaggaagcttggttggagtggaatgaaactcagtggtcagtactttcttggtgtttctcggaattcacatatcgttcaagtaatgcataagtatgtcctcaagaagtcatcaaataaagacaaggtggtaaagacgcttgaagagtccagaagccgtacaaatatttgttttttctactttatctttgcagtagttcattctttttcagcatcgtaatacttggatgcaagggtcgaggcatgcagctccatgtcctaccttctgcttttttcccttgttttatatcagtcagtctcaatatatgctcctgcatatgctcaatttactttcttcattaaaggtc

SEQ ID NO: 4938 - DNA, 2145 bp, Gossypium hirsutum
aaacaatatatctttccttagcttcggcccaacgtctctcccgatccaataatacgaataacgttccaaaaaccctcttccccttccactctctctctctctgtcattttctcaaacaactgatcggttctttccgaaaatcgtacgccgtatttcaccagccaattaatcagtgattcggtcggattgactgaaaaaaataaacaagcgaagatgtctcttagaccgagcgcgaggaccgaggttcgacggaaccgatacaaggtggcggttgatgcggaggaaggtcggcggaggagagaagacaacatggtggagatccggaagaacaagagagaagagaaccttctaaaaaagcgtcgcgaaggacttcttgctcaacaaccgcaaccgcagcaacagcagatgttatcttccggcgttggttccgagaataagttagaaagtcttccggctatggttgtgggcgtttggtctgatgacaagaatgcgcagcttgaggcaaccactcaattccgaaagctgctatcaatagaacgtagtcctccaatcaatgaagttgtacaagcaggtgttgttcctcgctttgttgagttccttaatagggatgacttccctcagcttcagttcgaggcagcttgggctctcacaaatattgcttcaggaacatcagacaataccagagttgtaattgatcatggagctgtccctatatttgttaaactcctaggttctccaacggatgacgtacgcgaacaggctgtttgggcattggggaatgttgctggagactctcctaaatgccgtgacctggtccttggccatgggggcttagtgcctcttttggcacaatttaatgagcatgcaaagctctctatgttgcgaaatgctacctggactttgtcaaacttctgcaggggcaagccacaaccttcatttgagcagacaaagccagctttgccagctcttgagcgccttatcaattcaaatgatgaggaagtcttgacagatgcatgctgggctctgtcatatctctcagacggtactaatgacaaaatccaagctgttattgaggcaggtgtatgcccacgacttattgagctcttgcttcatccatccccaacggtcctcattcctgcccttcgcacagttggaaatattgttacaggggatgatatgcagactcagtgcattattggccaccaagctcttccctgcctcttgaacctgttgacaaatacctacaagaagagtatcaagaaggaagcttgctggaccatctcaaacatcaccgctggaaatgtagatcagatacaggctgtaattgaggctgggattattgcccctctagtccatctccttcaaaatgccgagtttgagatcaagaaagaagctgcttgggcaatttcaaatgctacatctggtggtacccatgaacaaataaagtttttggtgagccaaggttgcattaagccattatgtgatcttctgaactgtcctgacccaagaattgtcacggtttgtttagaaggtcttgaaaacattttgaaggttggtgaagcagagaaaaatctgggtcacactggagacgtcaatctctatgcccagttaattgatgatgctgagggattggaaaagattgaaaacctccaaagtcatgacaacaatgaaatatacgagaaggcagtgaagattcttgaaacttattgggtggaggatgaggacgagcctttaccccctggtgatgctgcacaatctgggctccaatttggaggcaatcaacttcctgtcccctctggtggattcaatttcaattgaaggaagcttggttggagtggaatgaaactcagtggtcagtactttcttggtgtttctcggaattcacatatcgttcaagtaatgcataagtatgtcctcaagaagtcatcaaataaagacaaggtggtaaagacgcttgaagagtccagaagccgtacaaatatttgttttttctactttatctttgcagtagttcattctttttcagcatcgtaatacttggatgcaagggtcgaggcatgcagctccatgtcctaccttctgcttttttcccttgttttatatcagtttactttcttcattaaaggtcttcttttaaaaaaaaaa

SEQ ID NO: 4939 - DNA, 2739 bp, Arachis hypogaea
attagaaaatctagggtttttttcattttccctctctcgatctatctccgaatctagggttaggggtttttgatcgttggtgacgatgtctctgaggcctagtgagaggacggaggttcgccggaaccggtacaaggtggcggtggacgccgatgagggtcgccggaggagggaggacaacatggtggagatccgaaagagtaagcgcgaggagagcctcctcaagaagcgccgcgagggcctccaagctcaacagctcctccagcagcagcaacaatttccaaccaatgtccaagcctcatccatcatggagaaaaagttggagagtcttcctgctatggtcgctggggtgttgtccaatgataacagccagcaactggaagctaccacacaatttaggaagttgctctcaatcgagcgcagcccaccaattgaggaagttatccaagctggtgttgtgccacggtttgttgagtttctccatagggacgatttcccccagcttcagtttgaggctgcatgggctctcacaaacatagcgtctggaacttctgagaacactaaggtggtaattgatcacggggcagtcccaatatttgtgaagttacttggttctccaagtgatgatgttcgagaacaggctgtttgggctttgggaaatgtcgctggtgactctcctaggtgccgtgatcttgttctcagccatggtgctttgatcccactattagcccagctgaatgagcatgctaaactttcaatgctgagaaatgccacatggactctgtcaaacttctgcagggggaagccacagcctccatttgaacacgtgaagccagcacttccaactcttgagcggttggtcttttcaaatgatgaagaggttctgacagatgcatgctgggcactttcgtatctttctgatggaacaaatgacaaaatccaagcagtttattgaggcaggtgtatgtagcaggctggtgcagcttcttttgcacccatctccttcggtgctgattcctgctcttcgtactgtgggaaatattgtgacaggggacgacattcaaactcaggctattatcaatcatggtgcactcccatgccttatgagcctgttgacgcataatcacaaaaagagcatcaagaaagaagcttgctggactatttcaaacattacagctggaaatagagatcaaatacaggctgtcattgacgctggtctgattgctccccttgtcaatcttcttcaaaatgctgagtttgacattaaaaaagaagctgcatgggcaatctctaatgctacatctggtggtagtcatgagcagatcaagtatttggttagccaaggttgcattaagcctctgtgtgatctgcttgtttgtcccgacccaagaattgtcactgtctgtttagaaggtctggagaatattctaaaggtcggggaatctgagaaggccatgggtaacagtggagatgttaacttgtatgctcagatgattgatgatgctgaaggattggagaaaattgaaaacctgcagagtcatgacaataatgaaatatatgagaaggctgttaaaattctcgaaacatattggttggaggatgaagatgagacactacctccaggcgacgttgctcaacctggtttcagttttggtggcaatgaggttccagtcccatctagcggattcaactttagttgaagacactttgctgagtggggaaattggttgcatggagatacgggttgatgctagggtggctgttcgagtcaagtccaggtaggtcaggtaagttgggagggaagagggttttggtccctgcgcatcgtggtgtctggtcgtagtccggtctgtgtctgtggtcaatgaggtgcagggagtgggtcagtctacactgccatgtccaaaataagaatgggggtttggtgggttgcagcagctgcataatgaccttgccagcggtgtatattatgcaaggaatatatgtgtgctactggagaaagtatccaagtttctatggtgcattaaaatcaaggtcccgtgtgatgtggctattgcctattggttggagtgggagggtttttgttgagtcttgaatgctgctgagtcctattaatcattgagtcgtagttgtattggtcattttatatagaatctactttatttgagtattcggaaacaaattttatggtttacatatccccttgttaatctctctctcaccatctgtgtgttctgtagtcttgggtttgagattttacatgacctttaaaggaccaagttatagttttactagtttccaatgttcaacaaacaagtaaaatcactaaaaatgccaaacacagtctaatgtaagtatgtaaccaagaaattaaataaataaaaaatcagaagtcgtatcatcatccatgcctggacataggttttatttgtatactcaataactcaacaataattttactttctcaaactgataattttgagagtcattttatttgtttaatttaatcatgattactctgttatacagcaaaactagtttattcaacttcaaataggagggaaaataatgtataataatttcgattgactttaaaagtcaacaagtcaaaaaattaagtgtacaaattcagttatgcagtccttttttccccttccccttttctttagatgtaaccatctatagtttatttattttgtgatacacaatatatatctcaattaacattttgtttacaag

SEQ ID NO: 4940 - DNA, 1918 bp, Phalaenopsis aphrodite
ggtttcgcttggtctcgtgcttcttccccgcgtttactgttgtcgttcatctcttgcctgtcgatcgccaacaactgcggcggcttcttcccctcgattctctagcgttcatctctttcctgtcgatcgttatcatctgcggagatgtcgctgaggccaagcgctcgagcggaggtccgccgaaataaatacaaagtagcggtggacgcggaggaggggcggcggcggagggaggataacatggtcgagatccgtaagagtaagcgggaggagaacctccagaagaagcgtcgcgaaggcatgcaagtgcagcccttccccacctctatccaatcttcaaccgtcgagaaaaagctagagagtcttccggctatgatttccggggtttgctcggaagacagctcgttgcagcttgaagcaacaacgcagtttcgtaaattactatcaatagaacgcagccctcccattgaggaggttatccagtctggtgttgttccccgttttgttgagtttcttacaagagatgactttccgcagcttcagtttgaagctgcttgggcacttaccaacattgcctcagggacctcagataataccaaagttgtgatagaccatggggctgtacctatatttgttaggcttcttcgttctccaagtgatgatgtgcgagagcaggctgtatgggcattggggaatgttgctggtgattctccgaagtgtcgggatctagttcttgccaatggtgcattgatgccactgctggctcagctgaatgaccatgctaagctttccatgcttaggaatgccacatggactttatcaaatttttgcagggggaagccgcaacccaactttgagcagacaaagcccgctctccctgcacttaaacacctcattcattctactgatgaagaagtcctcactgatgcatgctgggctctctcatatctttctgatggtacaaatgacaaaatccaatctgtaattgaagctgaagttgtgcctcggctggttgaacttctataccatccatcaccttcagttctaattcctgctcttcgcactgttggcaacattgttactggagatgatattcaaacacagtatgtcatcggaaacggagctcttccattccttctgaatctgctgacacagagttataagaaaagtattaagaaggaggcttgctggactatctcaaacattactgctggaaataaagagcaaatacaggccgtgattgaggctaatattattggccctctggtagatttgcttcagaacgcagagtttgatattaagaaagaggctgcatgggccatctcaaatgccacttctggaggcacccatgatcagataaagtttttagttacccagggctgcatcaagcccctgtgtgatcttctcgtctgccctgaccccagaattgtaacggtctgtttggaaggtcttgagaatatccttaaagttggcgaggccgagaagaaccttggaacaaccggaggggtaaacctttatgctcagatgattgatgaagctgaaggtctggacaagattgaaaatctccagagccatgacaacactgagatttatgagaaggctgtaaagatactggagacttactggttggaagaggaggatgaggccatgccgactggagattctgctcagactggattcaactttggtgccaatgaacagtactctgttccttctggtggattcaaatttggctagaggggaacttctggttccaagtttcacaagatatctcagctatcttgaagatgggggagtgttggtgtgcggtgcgtcctgttgagtcggtcgaggtccagtccggttatattcgtcctggcgtccagtttgtcgtggttgatcgatgcaggatgggcgtcgataaacccttttggttttt

SEQ ID NO: 4941 - DNA, 2200 bp, Rosa hybrid cultivar
tcttgcacgtacgaaattacaaaccgtcttctctctctctctcagtccctcccatttcaatactcccaggactccaaaatctctagggtttcttctccacacctctctccgtctccggccgattacagcacaaccagttagggtttcagcagcaaaaaacgacatgtcgctcaggccgaacgccaggactgaggtccgccggaaccggtacaaggtggcggtggacgccgaggagggccgtcgccggagagaggacaacatggtcgagatccggaagagcaagagggaggagagtttgttaaagaagcgccgcgaaggtcttcaagctcagcaattcccggcctctgttcagccaccgaacctcgagaagaagttggagagtctaccgtcgatggttgccggggtttggtccagcgaaagtgctctgcagctggaggctactacgcagtttcggaaactactttctatagaaagaagccctccaattgaggaagtaattcaagctggggttgttccgcgattcgttgagttccttgtcagggaggattatccacaacttcagtttgaggctgcttgggctcttacaaacatagcgtcaggaacatcggacaacaccagggtggtgattgatcacggggcagtcccaatattcgtgaagcttcttgcttcgccgagtgatgatgttagagagcaggctgtttgggcattgggaaatgttgccggtgattctccaagatgtcgtgatctagtcctcagcagtggtgccttgatgccgttgctggctcagttgaatgagcatgcaaagctttcaatgctgaggaatgccacctggacactgtcaaacttttgcaggggcaagccgcagcctcagtttgatcaggtgaagccagctcttccagctcttgagcgtttagttcattccaatgatgaagaagtcttgacagatgcctgctgggcactctcatatctctcggatggtacaaatgacaaaattcaagcagtcatcgaggcaggtgtctgcccgcgacttgtgcagcttctcttacatccatctcctgcagttctcattcctgcacttcgcactgttggtaatattgtgacaggagatgatcttcagactcagtgtataatcaccaatggtgcacttccatgccttctgagcctcttgacacataatcataagaagagcatcaagaaagaagcttgctggactatctcaaacattacagctggaaacagggaacagatacagtacgtaattgaagctggtttgattggccctcttgtcaatttgctccaaactgctgagtttgagatcaagaaagaggctgcttgggcaatttcaaatgctacttctggtggcactcatgagcaaattaagatcttggtgactgaaggctgtataaaaccattaagtgatctccttgtatgccctgatccaaggatagtaactgtctgcttagaagggttggagaacattttgaaggttggggaagctgaaaagagtttgggtaacagtggaaccaacctgtatgcacagttgattgatgaggctgatggtttggaaaagattgaaaatctgcagactcacgacaacaacgagatctatgagaaggcagttaaaattcttgagacatattggttggaggacgaagacgagacattaccagcaggagatggtactcagccaggctttaactttggagggaatgggcctcaagttccaactggtggattcaattttagctgaagaactttcaattggatggaggagcagaagtttcctgatatgggttatgttggggtcaagttcaggtcaagtcggggtggtcagggcatctcatgtgtctggtttcagtttggtctggtgtccattgtggtcagaggtgccaaggggggtcggtctgtttactctactatgagtctatgaccaaataagaagagatgggtcggtttgattatggcatggcgtttggtcggcagggatgattatcactgcgtcctaacgtgaaatactatgcaagtgtcgtagtggctcgttgttgcataaacagggcccctaaacgaatatgctagtgagggtggtttcttgaatgcagcatcgagttcaatctttttataattttgagtcgtagtctgtacgggtattttttccagagtcgggagttgttttgccttgtcgagtgaatatagatttgtt

SEQ ID NO: 4942 - DNA, 2213 bp, Quercus alba
acatacacaacgcatatatctatttacaccgatacatatatatagactatagagagagaaagagagtagtagtagcgctagggtttttgaaagaatccagaagcaaagccttagtagccatgtcgctgaggccaaacgagagaaccgaggtccgccgtaaccgatacaaggtggcggtggacgccgatgagggtcgccggagacgcgaggacaacatggtggagatccgcaagagcaagcgcgaggagagcttgcagaagaagcgccgcgaaggccttcaagccactcaccagcaatccttctcttcctctctccacgcctccgccaccaccaccgtcgaaaagaagttggagagtcttccttcgatggtttctggggtctggtctactgataacaacttgcaattggaggccactactcagtttcggaagctgctttctattgaaagaagccctccaattgaggaagtaattcaatctggggttgttcctaggtttgtcgagtttctagtcagggaggactttcctcaacttcagtttgaggctgcttgggcacttacaaacattgcatcaggaacttcggagaacacgaaggtggtgattgaccatggggcagttccgatctttgttaagttactgggttctcctagtgatgatgttagggagcaggctgtgtgggcattgggaaatgttgcgggggattcgcctaggtgccgtgatcttgtacttggtcatggagccttgattccattgctggggcagttgaatgagcatgcaaagctttcaatgctgagaaatgctacttggactctgtctaacttctgcaggggcaagccacagccgtcattcgatcaggtgaagccagcacttcctgctcttgagcgtcttgtccattcaaatgatgaagaagtcttgacagatgcctgctgggctctctcttatctctctgatggtacaaatgacaaaatccaagctgttattgaggcaggcgtctgtgcccgacttgttcagctcctcctacatccatctccttcggtgcttattcctgctcttcgcacagttggaaatattgtgacaggagatgatattcagactcagtgtataatcaaccatggtgcactgcaatgccttttgagcctgttgacccataatcataaaaagagcatcaagaaagaagcttgctggactatctcaaacattacagctggaaacagggaacaaatacaggctgtgattgaagctggtttaattggtcccttggtcaatctgcttcaaaatgctgagtttgatataaagaaagaggcagcatgggcaatttcaaatgctacttctggtggtactcatgaacaactcaagtacctggtgagtcaagggtgtataaaaccattgtgtgatcttcttgtttgccctgatgcaaggattgtcactgtttgtttagaagggttggaaaacattctgagggttggggaagcagagaagagtttgggtaactctggagaggttaacttatatgcccagatgatagatgatgctgagggattggagaagattgaaaatctacagagtcatgacaacaatgagatctatgaaaaggcagtcaagattctggaaacatattggatggaggaggatgactcattacctccagctgatggttcccagcctggctttggctttggggggaatgaggttcaagttccatcaggtggattcaactttagctgaagagaaaattgcagggactaaattcctgctggggaaggcaaagtatatgttgggtcaggtcaggtcagggcacttcgtggtgtctcatttcagtctggtcctgtgtccgttgtggtcttcaaagaggtgccaaggtgggtcagtctaatactaccgtgtccaaataaggagggggtaggtgggtttcattgtggcatgatggcctagtcagctgtttttggtgttttcacctggtaccatgatgctgtggaaggtgtccctaagttcattattgcatacgcagggtcccaatggatgtactggtggtgggtgggggtttgaatgcgttttgagtcaatttttccccagagtcatgtattagtagttcctagtctgcatttgttttgtcttgttgggtggatatatagtatccagacacagtttctggtgtcttgaagtaagagttaaatgctattttttatgtgtgatgatcttctcataattgttata

SEQ ID NO: 4943 - DNA, 2448 bp, Pseudotsuga menziesii
gggttttattcggtagcagccatgtctctcagacccatgtcgaggactgaggtccggaagaagacctacaaggtggccgtcgatgcagatgaggcccgtaggaagcgagaagataatatggtcgaaatcaggaagagtaagagagaggagagcctccagaagaagagaagggagggcatgcaagcccagcaatttgcacccgccgtgcaatcgtccgccgttgaaaagaagttggagagtcttcctgctatggttgcaggggtatggtctgatgaacctaacctgcaactggaggcaacgacccaatttcgaaagttgctttcaattgagcgtagtcctcctatagaggaagttattgatgcaggtgttgttcctcgttttgttgaattcctgacgaggcatgattttccacagcttcagtttgaagcagcttgggctttgacaaacatagcttcgggaacatcagaacatactcgagttgtgattgaccgtggtgctgtaccgatatttgtacagctgctaagttcacctagtgatgatgttcgcgagcaggctgtttgggcattggggaatgtggctggtgattcacccaaatgtagagatctggttctcagtcatggtgccctgatgccactccttgctcaactgaatgagcatgctaagctttcaatgttgagaaatgccacttggactttatctaatttctgccgaggcaaaccacaacctgcatttgagcagacaaagccagctcttcctgcacttgaacggcttattcattctaatgatgaagaagtcttaacagatgcctgctgggctctgtcttatctctctgatgggacaaatgataaaattcaagctgtgatcgaggctggtgtctgtcgaagacttgttgagcttctcctccatccatccccatctgtacttatcccagctctccggactgtgggcaatattgtaactggtgatgatgtacagactcagtacattatcaacaatcaagcacttccctgcctcttggcattgttgactcataatcataagaaaagtatcaagaaggaagcatgctggaccatttcaaacataactgctggaaacaaagatcaaatacaggctgtgatcgatgcgaacatcattcctcctcttgtacagttgctgcaatctgctgagtttgatattaaaaaagaagcagcttgggctatatctaatgctacctccgggggtacacacgaacaaataaaatatcttgtcaatcaaggatgcatcaaacctctttgtgaccttctagtctgtccagacccaagaattgtaactgtttgtcttgaagggctagagaatattttgaaagttggtgaagcagagaaggacctagggaacactggaggtgttaatctctatgctcagtttattgatgatgctgaaggacttgagaagattgagaacctgcaaagtcatgacaacaatgagatttatgagaaggcagtaaagattcttgaaacttattggctagaagatgacgaagatgaccagacattacctgcgactggagatgctgcacagcaaacattcaattttggcacaaatcaacctacagttccttctggtggattcacttttggatgaaaaggaatttcagctattgcaacctggggggcgatgccatgggtgtttcaagtaaatattccaaggccctaactacgtacgctgtagtcagttgtatgcaagcaaatgcatggtttttggatgttactggtggcaggatgtttcggttggtatgtcatcatgacactactaactgaatcgtgcagatataagctcctcattttgaatgggttggccttagttggcttggtggtacagttaccatgctgtactagtaaggtggtctttgtccaaaagtcataaaattgcatggttagataaatggactcatcttatgagccttctgacctttaaagctctatgctagagcttattgatatgttgccgagttgaatgccaaacttttcggtattttggcgaagcagtttaatgggtcattagggttcatagtcatactaactgcctggttatacttgcatgtgttcattgcatcaaagagtctgtcccaagtcggtcttgttgccagtaaaatggccttactaacatactgttccaggataatcttggaactttgagaagtgcatgtaatcatgtgttctcctattattctctggtgttttgcccagggtttgtcttcatctctctctctctcccccccttctttcttgtgctaagctttggatgatccagagtctttttgattttcacgttcaaatgagtcctgtcccttctttctctccctttctctctcgtgccaaactgtggatgagaatagagaaaataatcttttttggagtcctcacgggatttcctcctgaaatgctacactcccgagtgtctcagaccccc

SEQ ID NO: 4944 - DNA, 2484 bp, Phaseolus coccineus
cccatggcttggatccataacccgcatcgagcgcgaaggtttagatccaagatccaaaccctcacattacataaacctaactatccaatccaatctaatctgtagtatcaagtatctagctagggtttgggtttttcaaattcttcttcccctgttcttcttcacccatcccatttccacccaaaccatgtctctcaggccaaatgccagaaccgaggttcgccgcaaccgttacaaggttgcagttgatgctgacgagggtcgtcgccgaagagaggataatatggtcgagatccgaaagagcaagcgcgaagagagcttgcagaagaaacgtcgcgaaggtctccaagctcagcaacagtttccggctcctcttcaggcttccactgttgacaagaagttagagagtcttccggcgatggttgctggagtttggtcggatgataataatcttcaacttgaagccactacgcaatttcgcaagctgctttcaattgaacgaagccctccgattgaggaagttattcaagctggtgttgttccgcgttttgttgagtttcttgtcagggaggatttccctcaacttcagtttgaggctgcgtgggctcttacaaacattgcatctggaacttctgagaacactaaggtggtcattgatcatggggcagttcctatatttgtcaagctgcttagttcgcccagtgatgatgttcgggagcaggcagtgtgggctttgggaaatgttgctggtgactcccctaggtgtcgagatctagtgctcagccatggcgccctcgtcccactattggctcagttgaatgaacatgcaaaactttcaatgttaagaaatgccacatggacattatctaacttttgtaggggtaagccacagcctccatttgaacaggtgagaccagcacttccagcacttgagcgcttgatcttctccaatgatgaagaagttttgacagatgcttgctgggcattatcatatctttctgacggcccgaatgacaagattcaagcagttattgaggcacgtgtatgtcccacattggtgcagctactcttgaaccaatctccctcggtgctaattcctgctcttcgtactgtgggaaatattgtaactggagatgacatgcaaactcagtctattatcaatcatggtgcgctcccttgccttctgaacctgttgaatcataatcataaaaaaaagcatcaagaaagaagcttgctggactatatcaaatattactgctggaaataaggaacagatacagtctgttattgaagctggtctggttgccccccttgtcaatcttcttcaaaatgctgagtttgacatcaaaaaggaagctgcctgggcagtctcaaatgctacatctggtggaactcatgaccagattaagtacttggttgctcagggttgcataaagcctctttgtgatcttcttgtttgtccggatccaagaattgtcactgtctgtttagaaggcctagagaatattctgaaggttggagaagctgagaagagcctaggtaacactggagatgtcaacttgtatgcacagatgatagacgatgctgagggattggagaagattgaaaacctgcagagtcatgacaacaacgaaatctacgaaaaggctgttaaaattcttgaaacgtactggttggaagatgaagacgagaccctaccttcaggagagggtgctcaacctgattttgcttttggaagtgaactcccagtcccgtctggtggattcaacttcagctgaggaccttttcctgacaaggggcttgttggatgaagtaggtttatgccggatgacttttgggataaagtcctggtgggtcagttattgctccttgtgtctgcttacagtctggtctagtgtctccttcgtggtttatgagatgccggggaaggtcagtttagctaccatgtccaagtagagaaggcactggtggattaacagcagcataatgacctcttcagcagtgtttactgtattaaaaatatataatgctggtgagaaatatctggaagggattttgtatgttgctgtggcagggacacaggccatatgccgaggggattttgttcaatgcggctttgggtgctacttttatcgagtcatagattggtaaagatttactggggtcagtatttgatttgggtaaatatatttttccgaaaccaattttatggtctactctaaatttgaatcttaaattagtgttatttttgtacgtggttttcaagctttttgcttgttcatatatattttgggcaatcatgattaccaatttgctaggaaaggtgtaataagtttaagctctacactaatttgtcccaatggtgacaggtgaaatagactctacatacatcataacattacttttaacactaaaatttgatagtattaataacttgtacgaatagagtgtgacgttattatagatatcaaagtggattgaatc

SEQ ID NO: 4945 - DNA, 2884 bp, Gossypium hirsutum
ggttatatctattgatattatctggtagatcatataaattaattaaactaaactcatttttaaaggaagaaatatttaaccatttttcacccaaatatattacaagacaacccaaatgatcaaactttgtaatgaaagagtagactctactcccaagtcccaatttgattgggttattttccttttcttttaatggaggaaattctttcctctctgatttccaaacaaaattatacaatatgagaggattaaacactaaaaacatctctagttaatcacataccatagccaacatcggtgaacttgctcttgatccacttaaagctgttcctaacacttgatttaagcttaccctccattgtaaacacgttgtatgaggcaatcctcttcttcctcttaagttccgggtcattcgaggccgcgaacccgttactcttgctgcacggcccgttgaaattatacgaactcgaccggttttcgaactcgaattcacctgacaaagatgaagaataatattgaggcaatgacttgctcttctccataatacccttttggtatagtaatatagctcgtgccgaattcggcacgagcgaataaggctccaaaaaccctcttcttttttattttttgtccatctctcaatcttccaataactgcgtcactctcttcccctctgtcattcctcaaacaacccatcgatcatttcacctacaaattaatcggcgtttcgatcagattgaaaagaagtagcgaagatgtctctcagaccgagcgccaggactgaggttcgaaggaaccgatacaaggtggcggttgatgcggaggaaggtcgccggaggagagaagacaacatggtcgagatccgaaaaaacaagagagaagagaaccttcttaaaaaacgccgcgaaggacttctcgctcaacagcagcaaccgcagcaacagcaactgctctcttcaaccgctggttccgagaaaaagttagaaagtcttccggctatggttgcgggtgtttggtcagatgacagaaatatgcagcttgaggcaaccacccaattccgaaagctgctatcaatagaacgtagtcctccaatcaatgaagttgtacaatcaggtgttgttcctcggtttgtggagttcctgaatagagatgacttcccacagcttcagtttgaggcagcttgggctcttacaaatattgcttcagggacatcagataacaccagggtcgtaattgatcatggagctgtccctatatttgttaagctcttaggttctcccactgatgatgttcgcgaacaggctgtttgggcactaggaaatgttgctggagactcacctaaatgccgtgacctggtccttggccatggggcattggtgccactcttggcacaattcaacgagcatgcaaagctctccatgttgcgaaatgctacctggactttgtcaaacttttgcaggggcaagccacagccttcatttgagcagacaaagccagctttgccagctcttgagcgtcttatccattcaaatgatgaggaagtccttacagatgcatgttgggctctgtcatatctctcagatggtactaatgacaaaattcaagctgttattgagtcaggagtctgcccccgactggttgagctcttgatgcacccatccccaacagtcctcattcctgctcttcgcacagttggaaatattgttacaggggatgatatgcagactcaatgtattataggccaccaagcccttccgtgccttttgaacctgctgacgaatacctacaagaagagtatcaagaaggaagcttgctggaccatttcaaatatcactgctggaaatgtagatcagatacaggctgtaattgaagctggcattattgctcctctagtccatctacttcaaaatgctgagtttgagatcaagaaagaagctgcttgggcaatttcaaatgctacgtctggtggcacccatgaacaaataaagtttttggtaagccaaggttgcattaagccattgtgtgatcttctaaactgtcccgacccaagaattgtcactgtttgtttagaaggtcttgaaacattctgaaggttggtgaagctgagaaaaatctgggtcatactggagatgtcaatctctatgctcagttaattgatgatgctgagggattggagaagattgaaaacctccaaagtcatgacaacaatgaaatctatgagaaggcagtgaagattcttgaaacatattgggtagaagatgaggatgaggcattacccactggtgatgcttcgcaacctgagttccagtttggtggcaatcaacttcctgttccttctggtggattcaatttcagttgaagaacacttggtggggtggaatggagctgaaaggtcggtattttcttgttttcttttttatggaattcacatttattccaagtcatgccacagtatgttcttaagaagtcgtcaaataaagacagggtgtacgatacggtaaagagtctggaagccatacaaaatactttaaaattttgccatgcggtagctattctttttcagcatcctaattctcagatgcaaagggggagagatgcagcccagtattcagacttctggtttttacccttgtgttgaaaggatgtatttgcttcctttattaaaaggtccttttttttcccttctactttctattcgattttagttatagtttggacttcatttatttggtctttctgttgagaaatatacagctatcaggaaaattttttcttttccggtagtgtattattgtcaaaaacgtgaaggatgtattggagttataaaatgtctgctaaacatgtctgattgtggtccttctaaatagaatttgattttttcccg

SEQ ID NO: 4946 - DNA, 2226 bp, Solanum tuberosum
gatttggtatatactctctctctttctccctcgattcaattatcgttgtagggttttctgtaattgcttttagtatctcatctcgttttgcagttttcattctctataccaaccaacatgtctctgaggccaagtgataggaccgaggttcgtaggaaccgatacaaggttgccgtcgatgccgacgaaggccgccgccggcgagaggacaatctggttgagatccgtaagagtaaacgagaagagagtttgctcaagaagcgtcgtgaaggccttcaagcccaacaacaacagttccctgctaatcttcaaacttccaccgttgaaaagaagttggaaagtcttccatcaatggttgctggtgtttggtcaaatgataacaatatgcagctggaggcgaccacacaatttcgtaaattgctctctattgaaagaagtcctcctattgaggaagttattcaatctggtgttgttcctcgttttgttgagtttctaatgagggaagattttccgcaactccagtttgaagctgcttgggcgctcacaaacattgcgtctggtacctcggagaataccagagtggtgattgaccatggcgctgtgccaatttttgtaaagcttctggcttctccaagtgatgatgttcgtgagcaggctgtgtgggcactgggaaatgttgctggtgactctcctaggtgccgtgatcttgttcttagtaatggggcgttgattccattgctgtctcagttgaatgagcatgccaagctttcaatgctgagaaatgccacatggaccttgtcaaacttttgtagaggcaagccacaacctccatttgagcaggtgagaccagcactttcagctcttcagcggcttgttcattcaaatgatgaagaggttctaacagatgcatgctgggcactttcttacctttctgatggtacgaatgacaaaattcaagctgtcattgaagcgggtgtttgtccacggctggttgagctcctcatgcatccgtctccttcagtactcatccctgccctccgtacagtaggaaatattgttacaggagatgacctccagactcagtgcattattgaacatggcgcccttgcttgcctgctgagcttgttatctcacagtcacaaaaagagcatcaagaaagaggcctgttggactatatcaaatattactgccgggaacaaggaacagatacaggctgtggtcgaggctggattaattagtcctctggtcaatttgcttcaaactgcagagtttgatataaaaaaagaggctgcctgggctatttcaaatgctacttccggtgggagtcatgagcagatcaagtttttggtgagtcaaaactgcataaagcctctgtgtgatttgcttgtgtgccctgacccaaggattgtcaccgtctgtctagaaggattagaaaacatattgaaggttggggaagcagaaaaagccaacactgaaggcattaattactatgctcagctgattgatgatgctgagggattggaaaagattgaaaaccttcagagtcatgataacaatgaaatatatgagaaggctgttaaaatactggagacatactggttggaggaggaggatgaaacagtgccagctggtgatggagcacaaaatgagttcaattttggcggaaatgatattcaacttccatctggtggtttcaagtttggttgaaagtactactacactcatcctccaaatatctcccttaacaggctgtgtatggtggatgagaagtgcagtttgaaagatgacatgttggtactggtgtcatgtcaagtcgagtcagatcacctccccgagtctggtcagtccgggtcaagagtcagtcgtggttgaggaggtgtgccgaaaagggatggtcgtaaataagactgcgtgaagagtctaaaaggtaaaagcagtgggcatgttgggaatttgatacacgattcccgtgcatgcttgtattgtttggtgaaaagtatgaaagttattactattatcagtgaattagcatctcaaagtgtggagtcctttttccagtcagcacatgagatgtatctgcagtagtttgtctggaaagattgtcgtctagattataatattgagttggcgagtgaatgtgtatactttatgagtcatttcttattaaatattgctattgaacacgtttgagcaaattttgatcattctttttgtccttaaaaaaaa

SEQ ID NO: 4947 - DNA, 2223 bp, Solanum phureja
atttggtatatactctctctctttctccctcgattcaattatcgttgtagggttttctgtaattgcttttagtatctcatctcgttttgcagttttcattctctataccaaccaacatgtctctgaggccaagtgataggaccgaggttcgtaggaaccgatacaaggttgccgtcgatgccgacgaaggccgccgccggcgagaggacaatctggttgagatccgtaagagtaaacgagaagagagtttgctcaagaagcgtcgtgaaggccttcaagcccaacaacaacagttccctgctaatcttcaaacttccaccgttgaaaagaagttggaaagtcttccatcaatggttgctggtgtttggtcaaatgataacaatatgcagctggaggcgaccacacaatttcgtaaattgctctctattgaaagaagtcctcctattgaggaagttattcaatctggtgttgttcctcgttttgttgagtttctaatgagggaagattttccgcaactccagtttgaagctgcttgggcgctcacaaacattgcgtctggtacctcggagaataccagagtggtgattgaccatggcgctgtgccaatttttgtaaagcttctggcttctccaagtgatgatgttcgtgagcaggctgtgtgggcactgggaaatgttgctggtgactctcctaggtgccgtgatcttgttcttagtaatggggcgttgattccattgctgtctcagctgaatgagcatgccaagctttcaatgctgagaaatgccacatggaccttgtcaaacttttgtagaggcaagccacaacctccatttgagcaggtgagaccagcactttcagctcttcagcggcttgttcattcaaatgatgaagaggttctaacagatgcatgctgggcactttcttacctttctgatggtacgaatgacaaaattcaagctgtcattgaagcgggtgtttgtccacggctggttgagctcctcatgcatccgtctccttcagtactcatccctgccctccgtacagtaggaaatattgttacaggagatgacctccagactcagtgcattattgaacatggcgcccttgcttgcctgctaagcttgttatctcacagtcacaaaaagagcatcaagaaagaggcctgttggactatatcaaatattactgccgggaacaaggaacagatacaggctgtggtcgaggctggactaattagtcctctggtcaatttgcttcaaactgctgagtttgatataaaaaaagaggctgcctgggctatttcaaatgctacttccggtgggagtcatgagcagatcaagtttttggtgagtcaaaactgcataaagcctctgtgtgatttgcttgtgtgccctgacccaaggattgtcaccgtctgtctagaaggattagaaaacatattgaaggttggggaagcagaaaaagccaacactgaaggcattaattactatgctcagctgattgatgatgctgagggattggaaaagattgaaaaccttcagagtcatgataacaatgaaatatatgagaaggctgttaaaatactggagacatactggttggaggaggaggatgaaacagtgccagctggtgatggagcacaaaatgagttcaattttggcggaaatgatattcaacttccatctggtggtttcaagtttggttgaaagtactactacactcatcctccaaatatctcccttaacaggctgtgtatggtggatgagaagtgcagtttgaaagatgacatgttggtactggtgtcatgtcaagtcgagtcagatcacctccccgagtctggtcagtccgggtcaagagtcagtcgtggttgaggaggtgtgccgaaaagggatggtcgtaaataagactgcgtgaagagtctaaaaggtaaaagcagtgggcatgctgggaatttgatacacgattcccgtgcatgcttgtattgtttggtgaaaagtatgaaagttattactattatcagtgaattagcatctcaaagtgtggagtcctttttccagtcagcacatgagatgtatctgcagtaagtagtctctgtctggaaagattgtcgtctagattataatattgagttggcgagtgaatgtgtatactttatgagtcatttcttatttaatattgctattgaacacgtttgagcaaattttgatcattctttttgtcctt

SEQ ID NO: 4948 - DNA, 2117 bp, Solanum lycopersicum
atttacggtctcctctccaaatatatttgttttcattctctataccatgtctctgaggccaagtgataggaccgaggttcgtaggaaccgatacaaggttgccgttgatgccgacgaaggccgccgccggcgagaggacaatctggttgagatccgtaagagtaaacgagaagagagcttgctcaagaagcgtcgtgaaggccttcaagccgcccaacaacaacagttccctgctaatcttcaaacttccaccgttgaaaagaagttggaaagtcttccatcaatggttgctggtgtgtggtcaaatgataacaatatgcagttggaggcgaccacacaatttcgtaaattgctctctattgaaagaagtcctcctatcgaggaagttattcaatctggtgttgttcctcgttttgttgagtttctgatgagggaagattttccacaactccagtttgaagctgcttgggcgctcacaaacattgcgtctggtacctcggagaataccagagtggtgattgaccatggcgctgtgccaatttttgtaaagcttctggcttctccaagtgatgatgttcgtgagcaggctgtgtgggcactcggaaatgttgctggtgactctcctaggtgccgtgatcttgttcttagtaatggggcgttgattcctttgctgtctcagttgaatgagcatgccaagctttcaatgctgagaaatgctacatggaccttatcaaacttttgtagaggcaagcctcaacctccatttgagcaggtgagaccagcactttcagctcttcagcggcttgttcattcaaatgatgaagaggttctaacagatgcatgctgggcactttcttacctttctgatggtacaaatgacaaaattcaagctgtcattgaagcaggtgtttgtccacgtctggtcgagctcctcatgcatccatctccttcagtactcatccctgccctccgtacagtaggaaatattgttacaggagatgacctccagactcagtgcattattgaacatggcgcccttgcttgcctgctgagcttgttatctcacagtcacaaaaagagcatcaagaaagaggcctgttggactatatcaaatattactgctgggaacaaggaacagatacaggctgtgattgaggctggattaattagtcctctggtcaatttgcttcaaactgcagagtttgacatcaaaaaagaggctgcctgggctatttcaaatgctacttccggtgggagtcatgagcagatcaagtttttggtgagtcaaaactgcataaagcctctgtgtgatttgcttgtgtgccctgacccaaggattgtcacggtctgtctagaaggattagaaaacatattgaaggttggggaagcagaaaaagccaacactgaaggcattaattactatgctcagctgattgatgatgctgagggattggaaaagattgaaaaccttcagagtcatgataacaatgaaatatatgagaaggctgttaaaatactggagacatactggttggaggaggaggatgaaacagtgccggctggtgatggggcacaaaatgagttcaattttggtggaaatgatattcaacttccatctggtggtttcaagtttggttgaaagtactactacactcatcctccaattatctcccttagcaggctgtgtatggtggatgagaagtgcagtttgaaagatgacatgttggtagtggtgtcatgtcaagtcgagtcagttcacctccccgagtctggtcagtccgggtcaagagtcagtcgtggttgaggaggtgtgccgaaaagggacggtcgtaaataagactgcgtgaaaaggtaaaagcagtgggcatgttgggaatttgataaacgcttcccgtgcatgcttgtattgtttggtgaaaagtatgaaagttattattatcagtgaattagcatctcagagtgtggagtcctttttccagtcaagcacatgagatgtatctgcagtagtctgtctggaaagagtcgtctagattttatattgagttggcgagtgaatgtgtatactttatgagtcatttcttattaaatactgctattgaacaagtttcagcaaattt

SEQ ID NO: 4949 - DNA, 2146 bp, Phaseolus coccineus
  misc_feature (1390)..(1390): n is a, c, g, or t
  misc_feature (1788)..(1788): n is a, c, g, or t
agaaaacccaaaattctctctttactttcccatatccagttatcccaaaccctaccgttaggttccccaattcaacactcccaggaacggtgcgctgcttcttagttcgtacagtttccgtcgattatctctgaaacgatgtcgtatcgcccaagcgggaactccaggaccgatgtccgccggaaccggtacaaggtggcggtggacgccgaggaaggtcggagacggcgagaagacaccatggtggagatccggaagaaccgcagagaggagagtttgcagaagaagaggcgcgaagggctccagcctcaacagattcctgcttccgttcactctactttggtagagaagaagttggaacaccttccatcaatggttgctggtgtttggactgaggacaataacctgcaactcgaggcaacgactcagtttaggaagctgctttcgattgaacgaagtcgctccgattgaggaggttattcagaccggtgtagtttctcggtttgtcgaatttctgatgagggaagactttccgcagttgcagtttgaggctgcttgggctttgacaaatatagcttctggaacctcaaaaaacaccaaggtggtgattgaccatggggctgtcccaattttcgtgaagctacttgcttctcccagtgatgatgtccgtgaacaggcggtgtgggcattaggaaatgttgctggggattctcctagatgtcgggaccttgttctcggtcatggggcattgattcctttgttagcacaattgaacgaacaggccaagctttctatgcttagaaatgctacttggacactttcaaacttctgcaggggcaagccacagcctccttttgatcaggttaaacctgcactgcctgctcttgcacgtcttatccattcaaatgatgaagaagtcttgactgatgcatgttgggcactgtcatatctttctgatggtacaaatgataaaatccaagctgtaattgaagctggtgtttgtccccgacttgttgagcttctgatgcatccatccccttcagtactaattcctgctcttcgaactgttggaaatattgtcactggagatgatatgcaaactcaggttatcatcaatcatcaggctcttgcttgccttctgaatctgttgaccaataattacaaaaaaagcattaagaaggaagcttgttggactatatcaaatattacagctgggaataaacagcagattcagtctgtgattgaggctaatttaattactcctctggtcaacttacttcaaaatgccgagtttgatatcaagaaagaggctgcttgggctatctcaaatgctacatccggtggttcccatgaacaaatcaagttcctagtaagtcaagggtgtattaancccttgtgtgatcttctcatctgtcccgaccccaggattgtgacagtttgcctggaaggccttgaaaacatcttgaaggtgggagaagctgataaaagtattggcaacactggtgatgtgaatctatatgcccaaatcattgatgacgctgaggggctggagaaaattgagaacctccagagtcatgacaatacagagatttatgaaaaggcggtgaagattcttgagacatattggttggaggaggatgacgagactatgcctcctggggatgcttctcagtcagggttcaactttggtaacaatgacgctccggctgtgccttccggtggatttaactttaattagaagatgctcatgctctactgggggagttttggttggtctatcagtgtaangtcctccattatgacgggacagcagttgggggacaagtcaaagtcttgtcattgtcattgtcattgggtcttacaaggttcagcaagtaaatacatggttgctggaccggattaggtttttgcagtgcctggtgtttcatatctcattgtgtaaaatgctttgtggctatatttttttgccaccgtagagtcttctttctgccaagtgatcattccatagaatcaatgaatgctcagtctcgtatttttttttatcttgatatatatgtcatagattgcagttgaagttacgattggttttttggcaaatgccaaatgctaaatagttacaaggaacgttggagtctttcttttatcc

SEQ ID NO: 4950 - DNA, 1681 bp, Ambrosia trifida
gattaatcttcagccgatctgtataaatctgtaatcaaatcatgtctctaagaccaaacgcgagaaccgaggttcgccggaaccgttacaaggtcgccgtcgatgccgacgaaggcagacgccgtagagaagataatatggtcgagatccgtaagaataagcgagaggagaacctccttaagaagcgtcaagtccttccggctgctcagccgttgttatccaccggtgctcctctacctagttccaccatcgagaaaaagttagagagccttccttctatggttgctggagtctattcaaatgataacaacatgcagcttgaggcaactacccagtttcgtaaattgctctcaatagaacgaagcccaccaattgaggaagttatacagtctggtgtggtacctcgcttcgtcgagttcttgatgagagaggattatccacagcttcagtttgaagctgcttgggcactcacaaacatcgcttctggaacttctgagaatacaaaggttgtaattgatcatggggctgtcccaatttttgtgaagcttcttggttctcaaagtgatgacgtccgtgagcaggctgtttgggcgctgggaaatgtagctggtgattcacccaggtgtcgggaccttgttcttggttcaggtgctttgcgtccattgctggctcagttaaatgagcatgctaagctttccatgctgagaaacgccacatggaccctatcaaatttctgtcgggggaaaccacaacccccttttgaggagacaaaaccagcactacctgcccttgaacgccttgttcattcaaacgacgaagaggtgttgactgatgcgtgctgggctctctcctatttgtccgatggaacaaatgacaaaattcaagctgtcattgaggctggtgtctgcagacgccttgttgagctcctcttgcacccgtctccttcagtactcattcctgcacttcgaactgttggcaacattgtgactggtgatgatctccaaactcagtgtatcattgagcatggtgcactaccgtgcctgctgagcttgttgaccaataaccacaaaaagagcatcaagaaagaagcctgctggacaatctcaaacatcactgctggaaacaaagaacaaatccaggctgtaatcgaagctgggttaatcgctcccctagtccatctcctccagactgctgagtttgatataaagaaagaagctgcatgggcgatatcaaacgccacttctggtggcactaatgaacagatcaagtatttggtgaatcaaggttgtatcaagccgttgtgtgatctccttgtatgtccggatccaaggattgtgactgtgagtttagaagggcttgagaacatcttgaaggtgggagaagctgagaaaaacttgggtaacactggagatgttaatttctacgcccagttgatagacgacgcagaaggcttagaaaagatcgagaacttacagtctcatgacaacaatgaaatttatgaaaaagctgttaagattctcgagacctattggttggaagaagaggaggagccggtggttgatggttcacagcctggtttcaactttggcggcccaaatgctcaagttccacctggtggattcaactttaatggctgaaggaaatcatcacaaaggtatgtttggtttggtcatagttcaag

SEQ ID NO: 4951 - DNA, 2167 bp, Ricinus communis
ggaatatataaacaccacaccgtctctgataatcactagagctttacagtcacttcttatcaaatcgatcgaaaaactcgccgctgctacaaagctttaattcataaaatcagtcatgtctttaagacccagcgcaagaaccgaggttcgccgaaaccgttacaaagtagccgtcgacgccgatgaaggtcgtcggcgaagagaagacaacatggtggagatccgaaagaataagcgagaagagaacttgcaaaagaagcgccgtgaaggccttcaagcccaacagttccctgccgctgttaatctcacttcttctaacatggaaaagaagttagaaagtttgcccgcaatggtagctggtgtttggtctgatgataaaagcttgcagctcgaagccactactcagtttcgaaaactgctctcaattgaacgaagccctcccatagaggaagttatacaatctggagttgttcctcgtttcgttgagtttcttgtcagagaggattttcctcaacttcagttcgaggctgcttgggcgctgacaaacattgcctcggggacctcagaaaacacaagggtggttattgatcatggtgcagttccaatatttgtaaagcttcttgcttctcccagtgatgatgttcgggagcaggctgtgtgggcattgggcaatgttgctggtgattctccaaaatgtcgtgatcttgttctcagcaacggagcgctccttccattgttggcacagctgaatgagcatgcaaagctttcaatgttgcggaacgctacctggaccctatcaaacttttgtaggggcaagccacagcctccgtttgagcaggtgaggcctgcacttccagcacttgaacgtcttgtgcattcaactgacgatgaagtcctaaccgatgcttgttgggcactttcatatctttctgatggtacaaatgataaaatccaagctgtgattgaggcaggagtctgtcccagacttgttgaactcctcctgcactcatctccttcagtgcttgtccctgcccttcgtacagttggaaatattgtgacaggggatgatctccagactcagtgcataattagcaatggtgcacttccataccttctaaacctattggctcataatcataaaaagagcatcaagaaagaagcatgctggactatctcaaacattacagctggtaacaaggaacaaattcaggctgtaattgagtctgaattaattgtcccattggttaatctgcttcaaaatgctgagtttgatataaagaaagaagctgcttgggcaatttccaatgctacttctggcggtactcatgagcaaattaagtacatggtgagtcaagggtgcataaaaccattgtgtgatcttcttgtatgtcccgatccaaggattgtcactgtgtgtctggaagggttggagaacattcttaaggttggtgaagctgaaaagaatttggggaacagtggagatgttaatctatatgcacagttgatagatgatgcggagggattagaaaagattgaaaatctacagagtcatgacaataatgagatctatgagaaggcagtgaaggttcttgagacatattggttggaggaagatgatgagacattacctccaggtgataattcccagcaaggttttcactttggtggaaatgatccgtcagctccagcgggtgggttcaactttagttgaaggtggcaactacattggtgttaaattcagtctgtctgtcacaactccttgcatttcactacagtttggtctaagggtctataatctgaactggccctggacaagtcattctgcattgtacacggtgttgcatcaattgtttcgaagagaccatattacgtagagagaaatacttgatgttgtgccttacacacgacgtgctattcaaggtgcggagagaaaatcttatagttgcatgagcatcggcctcctcagctattatcactgaattgggtacacagtgctggtgttagggtattaattgtatgcagggttgtactagtagttttcacatgattggtatttcttttatattccgagtgcatgatcgcaaacctcattttcctgatgtatttcaagagatttaaaaagaaaaatgaattagtaatattttctttttcatttgtgatgattgtt

SEQ ID NO: 4952 - DNA, 2374 bp, Malus domestica
tataaaatcccgaaaagaaaaaaatatataaattttttcaaaccccgaatcaggcctgtaggaacccttctctctccctcagtccccctctcagagaagtccaatttctagggttttctgttgctctccttctccgtctccaacccattgggatcacgatcaatctcccttagacgtactcaaatcatacggcatgtcgctgaggccgagcgcgaggaccgaggtccgccggaaccgctacaaggtggcggtggacgccgaggagggacgtcgcaggagagaggacaacatggtggagatccggaagagcaagcgcgaagagagcttgctgaagaagcgtcgcgaaggcctccaaccccagcagttcgcgtcatctctccagccctcaaatctcgagaagaagttagagagtcttcctgccatggttgctggggtttggtctgacgacaacaatttgcagctggagtccactacgcagttcagaaaacttctttcgattgaacgaagccctccgattgaggaagttatccaatctggagtggttcctcgctttgtcgcgttcctcattagggaggattttccacaacttcagtttgaggctgcttgggctcttacaaacatagcgtcaggaacctcagagaacaccaaggtggtgattgagcagggggcagtcccaatctttgtaaagcttcttgcttctccgagtgatgatgttagggagcaggctgtgtgggcattgggaaatgttgctggtgattctcctagatgccgtgatcttgtcctcggcagtggagccttgatgccgttgctggctcagttgaatgagcatgcaaagctttcaatgctgagaaatgcaacatggactctgtctaacttttgcaggggcaagccacagcctccatttgaccaggtgaagccagcacttccagctcttgaacgtttagttcattccaatgatgaagaagtcttgacagatgcctgttgggcactttcatatctctcagatggtacaaatgacaaaatccaagctgtgattgaagcaggtgtctgcgtccgacttgtgcagctcctcttacatccatctccttctgttctcattccggcacttcgcactgttggtaatattgtgaccggagatgatcttcagactcagtgtattattaacaatggttcactcccatgccttctgagcctgttgactcataatcataaaaagagcatcaagaaagaagcttgctggacaatctcaaacattacagctggaaatagggatcaaatacagtctgtaattgaagctggtttgattggtcctctggtcaacttgcttcaacatgctgagtttgacataaagaaagaagctgcatgggcaatctcaaatgctacttctggtggcactgctgatcaaatcaagtacctggttggcgaaggctgtataaaaccattgtgtgatcttcttgtatgccctgatccaaggatcgttactgtctgtttagaagggttggagaacattctgaaggttggggaagctgaaaaagctgcgggtaacagtggagaagttaacttgtatgcccagctgattgatgatgctgagggtctagaaaagattgaaaatctacagagtcacgacaacactgagatctatgagaagtctgtaaaaattcttgagacatattggttggaggaagacgaagagacattaccagcaggagatggtacccagcaaggcatccgctttgaagggaatgaggttcaggttccatctggtggattcaactttagctgaaagagcttgtgattgaatggagcagaagtttctgatgagggtcaagtttggggtcaagttgaggtcaagttggagtgggtcgggggcatcttgtgtgtctggtttcagtctggtccggtgtccattgtcgtcagagatgccaaggtgggtcagtttattctactatgaccgaataagaagagatgggtgggttcagttgtggcacatgaagtttggtcggcaggggtcatgatcgctgcctcttaccatgaaatactatgggaagtgtcgtagaggctcgttgctgcatgaacagggcccttgaaggaatgtgctggtgagggttttcttgaatgcagcatcgagttttataatttggagtcaatagtttgtacgagtaaatttagtttttctgaagagtcggggatttgttttgccttgtcaagtgaatatagagttgatgaagtcattttctggtgtattgcaaggaaaatgattagtggtgttttagtaatatgaccttgtgattgttgtattatattttttccatatttccaatttttacagcttgggccttgttaagtttcacctctagattttttgcttttgttt

SEQ ID NO: 4953 - DNA, 1956 bp, Arnica chamissonis
ttgagtggtatcaatcagtcatcagatcatgtctttgaggcccagcgcgagaactgaggttcgccggaaccgttacaaggtggccgtcgatgcggatgaaggaagacgacggagagaagacaatatggtcgagatccgtaagaataagagagaggagagcttgcttaagaagcgtcaagtactacctgcgtcacagccgttatctactggtgctccggtcccaacctccaccgtcgagaaaaagttagagagccttccttctatggtcgctggagtgtattcaaatgataacaacatgcagctggaggctactactcagtttcgtaaattgctctctatagaacggagcccaccaattgaggaagttatacaatctggcgtggtacctcgctttgttgagttcttgatgagagaggattttccacagcttcagtttgaagctgcttgggcactcacaaacattgcttcaggaacttctgagaatactaaggttgtaattgatcatggggccgtcccaatttttgtcaagcttcttgcttctccaagtgatgatgtccgtgagcaggctgtttgggcgttgggaaatgtagccggtgattcacccaggtgtcgggatcttgttcttggtcaaggtgctttgcgtccattgctggctcagttaaatgagcatgctaagctctccatgctgagaaatgccacatggacactatcaaatttctgtcgagggaaaccacagcctccttttgaggagacaagaccagcactacctgcccttgagcgtcttgttcattcaaatgatgaagaggtgttgaccgatgcatgctgggctctctcctatctgtctgatggtaccaatgacaaaattcaagccgtcattgaggctggtgtttgcagacgtctggttgagcttctcttacacccatctccgtcagtactcattcctgcacttcgaactgttggcaacattgtgactggtgatgatctccaaactcagtgtattattgagcacggtgcactcccgtgcctgctgagcttgttgaccaataaccacaaaaagagcatcaagaaagaagcctgctggacaatctcaaacatcaccgctggaaacaaagaacaaatccagtccgttatcgcagctgggttaattgctcccctggtcaatctccttcaaactgctgaatttgatataaagaaagaagctgcatgggcgatatcaaacgccacttctggtggcactaatgaacagatcaagtttttggtgagtcagggatgcatcaagccgttgtgtgatctccttgtgtgtcccgatccaaggattgtgactgtgagtttagaggggctcgagaacattttaaaggtgggggaagctgagaaaaacttgggtaactctggagaggttaatatttatgcccagatgatagacgatgcagaagggttagaaaagatcgagaacttacagtctcatgacaacaatgaaatttacgaaaaagctgttaagattcttgagacgtattggttggaagaagaagaggagcctgtggttgatggttcgcagcctggtttcaactttggcggtccaaatgttcaagttccacccggtggattcaattttaacggctaaaggggtctagcagaaaggtatgttggatggggtcacagttcaagtctagtctggtcaggtcaggtgtagtcgggtcaaggtcaggtttagtcgggtcaacgtcatataatggcggtccaggtacaataaatgaatgggttcacagtttggggtcgagttgggtggtgggcagttgtttggttttctttacctcgagtcgttgaatgttttggaacaatgatcgaggtggatatgaatggacgacgttgttttattcttttttatcgtgtatattcatatgatcttgaatctatatttcatatttgtaatgttaacattatgttttccccatttgg

SEQ ID NO: 4954 - DNA, 2080 bp, Beta vulgaris
gctcacctccaaaccctttctctctctcttcgctcttgctttgattgatcgaattcgactaaaacgatgtcgttaaggccaaatgctaggacggaagttcgccggaatcggtacaaagtcaccgtcgacgcagatgaaggtcgtcggcgtagagaagataatatggtggagatccgaaagagtaagagagaagaaagtttgcttaaaaagcgtcgcgaaggtcttcaagttcagcagccatttgctccgcctcttcatacttctactgttgagaagaagctagagagtctgcctaatatggtagctggggtttgttctgacaataatcaaatgcagttggaggccactacacagttccgtaaattgctttcaatagaaagaagtccgccgattgaggaagttatagaggctggagttgttccccgctttgtggaatttctgcagagggaggattatccacagctacagtttgaggctgcatgggctctcacaaacattgcgtcagggacctcggagaataccaaggtggtaattgatcatggggctgttccgatttttgtgaagcttcttgcttctcctagtgatgatgttcgtgagcaggcagtgtgggctctgggtaatgttgctggtgactctcctagatgccgggatctagttctgagcagtggtgcgttaattccactgcttgctcagctaaatgagcattccaagctttcaatgcttagaaatgccacatggactttatcaaatttttgcagaggaaagccacagccaccttttgaccaggtgaagccagctcttcctgcccttgagcgtcttgttcattcaaatgatgaagaagtgttgacagatgcatgctgggcactttcttatttatcagatggaccaaatgacaagattcaaactgtgatagaggcaggtgtatgccctcgattggtggagctcctcatgcatccagctccatcagttctgattcctgcccttcgtacagttggcaatattgtcactggagatgatgtacaaacacagtttatcatcagcaatggtgcattgccatgccttttgaacttgttgactctgaatcacaaaaagagcattaagaaggaagcttgttggacaatatcaaacattacagctggaaataaggaacagatacaggctgttgttgaagctggtttgattggtcccctagtcaacttgcttcaaactgcggaattcgacatcaagaaagaagctgcttgggcgatatctaatgctacatctggtggatctcaagagcaaataaagtacctagtgaatcaggggtgcataaagccattatgtgatctacttgtgtgccctgatccaaggatcatcactgtctgtcttgaagggctggagaacatcctgaaggtaggtgaagcagagaagagtttgggcagtactggagatgttaattactatgcccagttgatagatgaagctgagggattggaaaagatagaaaatttacaaagtcatgataacaatgagatctatgagaaggcggtgaaaattcttgaaacatattggttagaggaagaggaagagaccgtaccatcaggtgatcaagctgggttccagatgtggagcaatgaaggtccctctggcggttttaagtttggctgaaggattcagatagatgggtgcatgaagttgcagtatgttgaagtccacatcgggtttcagactctagcttgacataaggtgaactttgaagtccagctctgctcaagctgggtttggtgtcaatagtatgggttggtatcagtggttaaagaggtgtcgcgagcgggtttgtcaatggtgaatgtggtcttgtttggcgtccctccgtgtatttttacccttcagttaggggttttatgtcgaaatattgaattttttaccgggtcggtgtttcttttggggggttttgtctgggtggaggggtgatatggggagtttacttatgttgaagggggtttatgtagtcagtgactcattgtttgcatgttcaaatttcaatagcatcattattagtagtttttatcccagagactcgagagtccaggaaatatat

SEQ ID NO: 4955 - DNA, 2830 bp, Cedrus atlantica
gcaattagtgagggtcctgcaccagcccaaagctcgcatcagaatctccgatctgcgaaaccttcacctccgaattataccccaacgtcgggagcagttcttccggccagtcactgtagaacaggaaattactatttagctcgtgagacaagcccgtggagcactcgttcatgaaatccgccagcaaaaccgcctcccctcgggacttctctggaatcggcctttcgtagggagagctctgggcgattttcaggcgttttcggggtatatattcgggttttattcagtagcagccatgtctctcagacccatgtcgaggacggaggtccgaaagaagacctacaaggttgccgtcgatgcagatgaggcccgaaggaagcgagaggataacatggtcgaaatcaggaagaacaagagggaggagagcctccagaagaagagaagggagggtatgcaagcgcagcagtttgcgcccactgtgcaatcgtccgctgttgaaaagaagttggagagtcttcctgctatggttgcaggagtatggtctgatgaacctaacctgcaattagaggcaacgacccaatttcgaaagttactatcgattgagcgtagtcctcctatagaggaagttattgatgcaggcgttgtgcctcgttttgttgaattcctaacgaggcatgattttccacagcttcagtttgaagcagcatgggcattgacaaacatagcttctggaacatcagagcatactcgagttgtgattgaacgtggagctgttccaatatttgtacagctgctaagttcaccaagtgatgatgttcgcgagcaggctgtgtgggcattggggaatgtggctggtgactctcccaaatgcagagatctggttctcagtcatggtgccctaatgccactcctttctcaactgaatgagcatgctaagctttcaatgctgagaaatgccacttggactttatctaacttttgcagagggaaaccacaaccgtcatttgagcagacaaaaccagctcttccggcgcttgagcggcttattcattctaatgatgaagaagtcttgactgatgcttgctgggctctctcttatctctccgatgggacaaatgataaaattcaagctgttattgaggctggtgtctgtcgaaggcttgttgagcttctgcttcatccatccccatctgttcttatccctgctctccggaccgtgggcaatattgtaactggtgatgatgtacagactcagtacattatcaacaatcaagcacttccctgcctcttggcgctgttgactcataatcacaagaaaagtatcaagaaagaggcatgctggaccatttcgaacataactgcaggaaacaaagatcaaatacaggctgttatcgatgcgaacatcattcctcctcttgtacagttgcttcaaactgctgagtttgatatcaagaaagaagcagcatgggctatatctaatgctacatctgggggtacacatgaacaaatcaaatatcttgtgaatcaaggatgcattaagcctctatgtgaccttctagtctgtccagacccaagaattgtaactgtctgtctggaggggctggagaatattttgaaagttggagaaggggagaaggacctagggaattctggaggggtgaatctctacgctcagtttattgatgatgctgaaggacttgagaagatagagaacctgcaaagtcatgataataatgaaatttatgagaaggcagtaaagattcttgaaacttattggctggaagatgacgaagatgaccagacattacctgccactggagatgctgcacagccagcattcaactttggcacaaatcaaccaacggttccttctggtggattcacttttggttgagaaggaatttcagctattgcaaccaggggggcgatgccatgggtgtttcaaagcaaatattccaaggcctcattacatggtagtcagaagtatgcaagcagatgcatggtttttggatgttactggtggcaggttatttctgttggtatgtcattatgacagtactaactaaatcgtgcagatataagctcctcattttcaatgggttggccttagttggagtggtggtacagtttccatgctgtactagtaagatggtctttgtccataagtcataaaattgcatagttaggtaaatggactcttatctgatgagccttccggccttgatggctctaagcttgagcttattgatgtattaccgagttgaatgacaaacttctgggtattcagacgaagcagtgtgaatgggtcatcaaagtttatagtcatactaactacctggttcctcttgcatgtgttcttccttgcatcaaagagtctgtcccaagtcggtcttctggccagtaaatggccctactaacataatgttctgggataatccttgaactgttctcctattcttctattctcctctggggttttgcccagagttttctttggatttcacgttcaagtgagtcctgatccttctctctctttccctctttctcatcccaaactgtggatgagaatagagaaaattgtcccttttggaagtatgacgtgatttcctccacaaacggtatattctgagtgtctcggacccctcctgttgccagtggtcattctattttggtagttgaaacttttattaaatcatttcatgcacttggaatattcgtctccatgcttggagacttttgctatgtaattttttagaattctattgttaatgaatttggaggtcttctatcaactatttcaaatgtttggataaaaaagcttttgcgtttc

SEQ ID NO: 4956 - DNA, 2150 bp, Flaveria ramosissima
cccctcatctttctctctctaaatcctctcaaaggtatatctagtgtatatacacacttatacacactcaacttcccctaaatcatgaactttgttgcatattaactcctttttgcacacgaattcgtctgtttagggttcgatttcacctcgattcgcatcgatcgatcatcaattcatcggatcatgtctctgaggccaaacgcgaggacggaggttcgccggaaccgctacaaggtcgccgtcgatgcggatgaaggaagacgacggagagaagacaatatggtcgagatccgtaagaataagcgggaggagaacttgctgaagaagcggcaggtgctgtcgtcgtctcagccggtggctactggtgctccggtcccgacctccaccatcgagaagaagttagagagccttccttctatggttgctggagtctattcgaatgataacaacatgcagctggaggcaacaactcagtttcgtaaattgctctcaatagaacgtagcccaccaattgaggaagttatacaatctggtgtggtacctcgcttcgttgagttcttgatgagagaggattttccacagcttcagtttgaagctgcttgggcgctcacaaacattgcttctggaacttctgagaatacaaaggttgtaattgatcatggggctgtccctatctttgtcaagcttcttgcttctccaagtgatgatgttcgtgagcaggctgtttgggcattgggaaatgtagctggtgattcgcccaggtgtagggatcttgttcttggtcaaggtgctttgctcccattgcttgctcagctaaatgagcatgctaagctatccatgctgagaaatgccacgtggacactatcaaatttctgtcgggggaaaccacagcctccttttgaggagacaaaaccagcactacctgcccttgagcgtcttgttcattcaaatgatgaagaggtgttgactgatgcatgctgggccctctcctatctgtctgatggtaccaatgacaaaattcaggctgtcattgaggctggtgtctgcagacgtcttgttgagcttctcttacacccatctccttcagtactcattcctgcacttcgtactgttggcaacattgtgactggtgatgatctccaaactcagtgtattattgagcatggtgcactcccatgcctcctgaacttgttgaccaataaccacaaaaagagcatcaagaaagaagcctgctggacaatctcaaacatcactgctggaaacaaagaacaaattcaggctgtaatcgaagctgggttaattgctcccttggtcaatcttctccaaactgctgaatttgatataaagaaagaagctgcatgggcaatatcaaacgccacttctggtggcactaatgagcagatcaagtttttggtgagtcagggttgtatcaagccattgtgcgatctccttgtatgtcctgacccaaggattgtgactgtgagtttagaagggcttgagaacatcttaaaggtgggggaggccgagaaaaacttgggtaacacaggagacgtaaactattatgcccagttaatagacgatgcagaagggttagaaaagattgagaacttacagagtcatgacaataatgaaatttatgaaaaagctgttaagatcctcgagacctattggttggaagaagaagaggaggctgttgttgatggttcacaacctggttacaactttggcggtccaaacgttcaagttccaccaggtggattcaacttcaatggctaaaggggatctagcagaaaggtatgttgggtggggtcaaagttcaagtctggtctggtcgggtcaagtcaggtgtagtcaggtcaaggttcgttgggtcgaggtcaggtgtagtcgggtcaaggtcatataaatggcggtccaggtacaataaacgaatgggtttagagtgttggggtcgagtgggacggtggggagtcgtttggttttctttacctcgagtcgttgaatgttttgggacaatgttcgaggcggatatgaacgaattgtgtccttttttgtcttttgttcacggggcatttgttttggtattaagggtcgagtgtatattcatatgatcttgaatttatattccatatttgtaatgttagatt

SEQ ID NO: 4957 - DNA, 2006 bp, Lippia dulcis
agattttggattgttttggttttggatcgacgcgaagatgtcgttgaggcctagtgcgaggaccgaggtgcgccggagccggtacaaggtggcggtggacgcggaggaggggcggaggcggagggaggataatatggtggagatccggaagaatagaagagaggagaatttgctgaagaagcgccgcgaggggcttcaagctcagcagtttcagcctacagtcaacgttccgcagctcgataagaagttagaaagccttccagctatggttgttggagtatggtcaaatgatggcgcattacaacttgaggcaacaacacagttccgtaaacttctgtcaatagaacgaaatccaccaattgaggaagtcatacagtctggagttgtacctcgctttgttgagttccttgcaagagatgattacccacagcttcagtttgaggcagcctgggctctcacaaacattgcttccggaacttctgacaacaccaaggttgtgatcgatcatggtgctgttccaatttttgtgagacttcttagttcagcaagtgatgatgttcgcgagcaggctgtttgggcgttaggaaatgttgctggtgattcaccgaagtgtcgagatcttgtccttggttatggagctttaatgccattattagcacaattcaatgatcaagcaaagttatccatgctgcgtaatgcaacatggactctgtccaatttctgtcggggaaagccacaacctcagtttgagcaggtcaaaccagccctccctgctcttgctcaccttatacatacaaatgatgaagaagtccttactgacgcatgctgggcactttcatatctctctgatggtgtaaatgataaaatacaagctgtgattgagactggtgtatgccctcgtctggttgagcttttaatgcatccctcaccatctgttctgattcctgctctccgcacggttggcaatattgtgactggtgatgatgtccagactcaggttatcattgaaaataggtctcttccttgcctccttagcttgttgacgcaaaactataagaaaagcattaagaaggaagcttgttggactatctcaaacattactgcaggaaataaggatcagatacaggctgtgattgaggctggaataatctcacctcttgtaaatctgcttcaaaatgctgaatttgagattaagaaagaggctgcctgggctatttcaaatgccacttctggtggaactcatgatcaaatcaaggttttggttcgtgagggatgtataaagccactatgtgatcttctagtgtgtccagacccaagaattgtcacagtctgcttggaaggtcttgagaacattttgaaggttggagaagtggacaagactcaaggtaacactggagatgtgaacgtttttgcacagatgattgatgatgcagaaggtctagagaagattgaaaatcttcaatcccatgacaacaatgaaatatatgagaaggcagtgaagattcttgaaacatattggttagaagaggatgatgagcagctagtctctgctgaggctccacaatcaggcttcaactttggaggtggtgaccttcctgtcccttcaggggggtttaagttcagttaaaggaagtcctgaaatcgtgtgggtgagtgtcctatcctatggatctggctgattgagtcgttgggagtcaggtgggcagtcaaagtcagtctcaaaaggttttccatgtttcatgcaaatgccatatatgagtgaagagatgaagtccacttagtgttttgggtcgtccgaggtggctgagtaattcgtgtgggtgtatcatcagccgtttaattaatgcaagttgtttgatgttgaaatcaaacagcttgaatattagagtcctctctttctttttttgtttatggggtccgtactgttagttacttctcaaagataacattttgaaaaccttatgtatattgcgcgggaagtgtttatccatgtcgctaagagcaaa

SEQ ID NO: 4958 - DNA, 2132 bp, Helianthus annuus
actcccctaaatcgcaaggtatatcttgtgcatctacacttccccttttttacattcaaaaattcatctctctagggttaatcatcatgtcgttgagacctaacgccagaaccgaggttcgccggaaccgttacaaggtcgccgtcgatgcggacgaaggaaggcgccggagagaggataatatggtcgagatccggaagaataagcgagaggagaacttgcttaagaagcgtcaagtgcttccgtctgctcagccgctcgccaccggtgctccggtgccggtttccaccatcgagaagaagttagagagccttccttctatggttgctggagtctattcaactgataacaacatgcagcttgaggcaactacccagtttcgtaaattgctctcaatagaacggagcccaccaattgaggaagttatacaatcaggtgtggtaccacgcttcgtcgaattcttgatgagagaggattttccacagcttcagtttgaagctgcgtgggcacttacaaacattgcttctggaacttctgagaatacaaaggttgtaatcgatcacggggctgttccaatattcgttaagcttcttgcttctccaagtgatgacgttcgtgaacaggctgtttgggcgttgggaaatgtagctggtgattcaccgaggtgtcgagatcttgttcttggtcaaggtgctctgcgtccactgctggctcagttaaacgagcatgcaaagctttccatgctgagaaacgctacatggacactatcgaatttctgtcgggggaaaccacaacccccttttgaggagacaaaaccagcactacctgcccttgagcgtcttgttcattcaaacgatgaagaggtgttgaccgatgcatgctgggctctctcctatttatctgatggtacaaacgacaaaattcaagctgtcattgaggctggtgtttgcagacgtcttgttgagcttctcttgcacccgtctccttcggttctcattcctgcactacgaactgttggcaacattgtgactggtgatgatatgcagactcagtgtattattgagcatggtgcactcccgtgcctgctgagtttgttgaccaataaccacaaaaagagcatcaagaaagaagcctgctggacgatctcaaacataactgctggaaacaaagagcaaatccagtcggtaattgaagctgggttaatcgctcccctagttcatctcctccagactgctgaatttgatataaagaaagaagctgcatgggcgatttcaaacgccacttctggtggcactaatgaacagatcaagtatttggttaatcagggttgtatcaagccactatgtgatctcctcgtgtgtccggatccaaggattgtgacggtgagtttagaagggctcgagaacatcttaaaggtgggggaagccgagaagaacttgggtaacaccggagacgttaattactatgctcagttgatagacgatgccgaaggtttagaaaagatcgagaacttacagtctcacgacaacaatgaaatctatgaaaaagccgttaagatcctcgagacttattggttggaagaagaagacgagcccgttgttgatggttcacagcctgctttcaactttggtggcccaactgctcaagttccacctggcgggttcaattttaacggctgaaagtaatcacaaaggtatgtcgggttgggtcaaagttcaagtctggtcgggtcgggtcaggtcaggtgtagtcgggtcaaggtcagtttgggtcaaagttgggtgtagtcgggtccatgtctggtgtagtcgggttaagggcatataaatggcggtccaggtacaataaaggaacgggttcagagtttggggtgggcggttgtttggttttttgtttacctcgagtcgttgaatgttttggaacaatgttcgaggcggatatgaatgaacgtcgtgtacgggtcgttttgttttggtattaaaggggtgagtgtatattcatatgatgttgaatctatatttcatatttgtaatgttaaattttatgttctcatgggatgatggtattgatttctttatactgtggcttggtttgtaacgtcttatattatttagtgaaggaaaactagtaag

SEQ ID NO: 4959 - DNA, 5100 bp, Theobroma cacao
gatctgggtttagtacttttgctttttcaaaattttgaaaaaacaatccatagatattagatggattcgaaaaaagtctcaattattacaaccgtcctttttatcattttcctttttcttttctatttgttttcctttaaaaaaaatatccccgtgagctggattccataacggcatgaggacgttagggttcccccaactttcaaattcaaaatcagtggcatcatcgttattaacaccacatcaaatcccgaatccacgacgaaaaaaataaattatttcagaaagcaaaaatacaagtcctctataaacaatatcactctgctcaccttcggcccctctctcccgatcctttcgaataacgctccaaaaaccctcctcttctttctttctttttcctctctctcactctcttccaaaaaccgcgtcactctctttccctctgtcattttctcagacaatcgatcgaactcttccgaaaaccgtacatcgtattgtacctgtaaattaatcggcgattcgatcagattgaaagaaagaaaaaagcaatcggaaaaaagcgaagatgtctctaagaccgagcgccaggaccgaggtccgaaggaacaggtataaggtggcggttgatgccgaggaaggtcgccggaggagagaagacaacatggtcgagatccgaaagaataagagagaagagaaccttcttaagaaacgccgcgaaggacttcttgctcaacaacaacaacctcagcagcagcagcttctctcttccaccgccgcttcggagaaaaagttggaaagtcttccggctatggttgcgggtgtttggtcagaagacaggaatgcgcagcttgaggcaaccactcaattccgaaagctgctatcaatagaacgaagtccaccaatcaatgaagttgtacaatcaggtgttgttccccgctttgttgagttccttgctagagatgacttcccacagcttcagtttgaggcagcttgggctctcacaaatattgcttcagggacatcagaaaacaccagggttgtaattgatcatggggctgtccctatatttgttaaactcctaggttctccaactgatgatgttcgtgaacaggctgtttgggcactaggaaacgttgctggagactcacccaaatgccgtgacctggtcctcggccatggtgccttggtgccactgttggcccaattcaatgagcatgcaaaactctctatgttgcgaaacgcaacctggactttgtcaaacttctgcaggggcaagccacagccttcttttgagcagacaaagccagctttgccagctcttgagcgtcttattcattcaaatgatgaggaagtccttacagatgcatgctgggccctgtcatatctctcagatggtactaatgacaaaattcaagctgttattgaggctggtgtctgccctcgacttgttgagctcttgcttcatccatccccaacagtcctcattcctgctcttcgcacagttggaaatattgttacaggggatgatgtgcagactcagtgtataataaatcaccaagctcttccatgccttttgaacctgctgacaaataactacaagaagagtatcaagaaggaagcttgctggacaatctcaaacatcactgctggaaatgtagatcagatacaggctgtaattgaggctggtattattgcccctctagtccatctacttcaaaacgctgagtttgagattaagaaagaagctgcttgggcaatttcaaatgctacatctggtggcacccatgaacaaataaagttcttggtgagtcaaggttgcattaagccactgtgtgatcttctaaactgtcctgacccaagaattgtcacagtttgtttagaaggtcttgaaaacattctgaaggttggtgaagctgagaaaaatttgggtcacacaggagaagtcaatctctatgcccagttaattgatgatgctgaggggttggagaaaattgaaaacctccaaagtcatgacaacaatgaaatctatgagaaggcagtgaagattcttgaaacatattgggtggaagatgaggatgagccattaccccctggtgatgcttcacaatctgggttccagtttggagccaatcaacatcctgttccttctggtggattcaatttcagttgaaggacacatggagtagaatgaagctcagagatgggtattttctcggtgtttttgggaattcacatatagttgaagtgatgccaaagtatgttcttaagaagtcattgaataaagacaagggtgtatgataccatgaaaaatgtttgaagagtctggaagccacacatatactttttacttttccatgcggtagttattctttttcagcatcctatttctcagatgcaagggtgagaggcatgcagctccctatgccaaacttctggttttttcccccttttacatcattcccaacttatgctcctgcttatgtatttgcttcctttattaaaggtcctttcttcttttcttttcaatatttcattttagtgatagttgtggactcattatttggtctttctgatcagaaagacacaccaacatcagttttgagaaggaaaagttttctctggttatgtatcattgtcaaaaacccgaaggatgtattgaagttaaagttacagtgttccttaacttgtccggtctttgcgaatagaatttgatttgttccctaatgtttccttggaaagtgcaggccatgatccggatgtgcattgcatttcaaatgctatctgcaatgccttggatgtggcaaaattatttaacttcatcttgctttgcggacatctaagaaaatggtgcgaggcaacggctgtgaggccaacctcatctcaatgattgcattagagacatggtggtagggccgtcaccatatggtaattcagtgtgacaaaaatacccataccatagcaaattacaaaactttttgtgagggtaattgtgtaaaataacgagcagttggtactgcatgtaaacgaaccatcatctgctccaggaaggagcctggaagttggcttcggatcccgtctgaaggcagatcccgtgaactcgtgtttgggagggctttgaaccactgcttttgtcatgtatctctttatttccttaaccttattcgtaacagtgcgatcatagcattaggctcaaactgttcacacttaaagatttgaattgacggccgctacccatcattgttcgctgcgaattgacgggctccgaagagaagagatgaaaagccaagtctcttgtgttgatgaagacgactgtgaatcgtgtagattggcgtattgttggtggagaacagctgcaaaattcgatgaatgtgctaagcttaagctggactttcctgacgtttccattctaacgcctaggcttagactgcttagagaattagagagattggctttaattgcacctgaaggactaaatgagcttcggcacaagcttcttgggtatcgttcaggtgatttctgggtacccactggagggattaagaaggaagatatggatattccgccggtgagcacaatactcttggtgggattctccggttctggcaagagctcgcttataaatctcatgtacagtattctgggtcggtctggcctaattccctttgctcaaacatcatcaggaagtcgttccaattatacaaccatgtacatggaagaacacaacgtcctgagatcaatgcgaagtggtttctgtgtttacgattcaagagggtttgattatgttagaacgacagaggctttgggggaattgtcgagctggatgattgaggggattcatcataatcagctatgcttcagatatggtgactgcacgacgatgacagatgatgtggagaatattgtcacgagatcatcttcaaaatttgtgcagagaagagtgaattgcgtgatggtcgtagcgaacatagcagagatttacaatgctttgaaagcaggcgattttaagccgttagaggctaccagacagctcttctgctcccctgcgttgcgaaaaagcaatgaaaaccctctcttgatcctgacacacggtgacttgttatccactgaggagaggatagatggcaggctgaagatatgcgaatgtctggatatatcggagactaacggagtttatgacatagtttgcctcacagaatacgggtttctagttgaagaatctgatccagtgtcagcctatgcgttaactgaagctgtatacagagcacttcttatctcagatagaggccactttccaaagaaaaaattccaggactgggcactgttgattttgttatggcttgtgcgttttattggtgtgtgcttcgctatcctagctgatgtttgttccaaactcggacagaaagagaaactgaagatgtgattcaagagatcaacagcttaaccaaggatttaatttgtaaaaagcaatgcctcatcactagaataatgctttttttagtagtttagtttagaagactgatcttgagatagggtaacttactgactagacacgtcagaccaagtgacttgattcttgtcatatttctagcccatcatctgcttttactcactgatgtattgatttgttattataatgaagaataacctggtttctagcataatttgggtttgattttggaggtgcccatgtacagccgggcaactgggttagaaatgtaatctatattggtatttagtaaggggaagtgcaaatggacgtgtagaacatatgacaggaaatatttttggcttccaacctatgccacataccaatttgtcccattttttttttatttttgtttttcttttgtctgtggtgtggtgcctgcttgactgttttgcgtaaagtatgttttccccagcgaatagcaataaagaaaaggatgcctcactattgccacttaggtgccctagacttttgcatagaatttgttaggttctactcataattttggaaacacataaggggtattccggtaatttaatactgtgaactagggtttgcgatcgtcccattgctacccaaatgaacattttggttgataaaatgtagcacatagt

SEQ ID NO: 4960 - DNA, 2278 bp, Castanea mollissima
ctctctctctcaccgactcttcgatcttcgattcccacatcgaccaaaaaccatgtctctgagacccaacgccaggaccgaggtgcggcggaaccgctacaaggtggcggtggacgccgaggaaggccgccgtcgcagggaggacaacatggtcgagatccgtaagaaccgtcgtgaagagagcttgcagaagaagcgtcgtgaaggccttgttgctcctcaaatgccttcaactccaacttctgaaaagaagttagaaagtctacctgccatggttgctggcgtttgttccgatgacatgaacttgcagcttgaggcaaccactcagttccgaaagctgctttcgattgagcgcagtcctccgattaatgaagttgtacaatctggtgttgttcctcgctttgttgagttccttgcgagggatgagttcccgcaacttcagtttgaggcagcttgggccctaacaaatattgcttctgggacatcggaaaacaccagggttgtaattgatcatggagccatcccgatatttgtcaaacttttaggctctccagctgatgatgttcgcgaacaggctgtttgggcattaggaaatgttgctggtgactcacctaaatgccgtgatcttgtccttagtcatggggccttaatgccgttgctgttacagtttaatgaacatgcaaaactttctatgttgagaaatgcgacatggacattatcaaacttctgtaggggcaagccaccgcctccatttgagcagacaaagcctgctatcccagcgcttgagcgtcttatacagtcaaatgatgaggaagtcctcactgatgcatgctgggcactatcatatctttcagatggtaccaatgataaaatccaagctgtcattgatgcgggtgtttgtccccgacttgttgaacttctactgcatccatctccaacagtcctcattcctgcccttcgcacagttggaaatattgtcacaggggatgatatgcaaactcagtgtatgataaatcatcaagctcttccttgcctcctgaacctgttgacacataatcataagaagagcatcaagaaggaagcttgctggaccatttcaaacatcacagctggaaatgtaaatcagatacaggctgtaattgaggctggtatcattccaccccttgtccaactacttcaaattgcagagtttgagatcaagaaagaagcagcttgggcaatttcaaatgctacatctggtggcacccatgatcaaatcaagtacttggtaagccaggggtgtattaagccattgtgtgatctcctaatttgtccagacccaagaattgtcacagtttgcttggaagggcttgagaacattctaaaggttggggaagctgagaaaaatatgggcaagacagatgtaaacttgaatgcccaattgattgatgatgctgaggggatagataagattgaaaatcttcagagtcatgacaacaatgagatatatgagaaggcagtgaagattttagagacatattgggttgaagatgatgatgagccattgcccccaggtgatgctcctcaatctagcttcaattttggaggaaatgaagttcctgttccttctggtggatttaacttcagttgaaggacttccggttggcagtggaatgaagtttggagtctaggtttgtgacattgaatatttttcaacttctggtggctaggatatctacttaccctttggtcctgttatgttcgcgagtctggtgtagttgaagagattgcagaagtatgtttgctctcttacagtggtccaataaaaagggggtgtgtgtgataccatgaattaggttagattgtgaaaattgtggaagcactagcaattgcccgagaaaacccacctgaacaatgttgcaacccctgcctccattttatttcttttcctttgctggttactcttccattttatttcctttactttgctggttactaaaatggaagggcaaggcctgtttggtttttcctgctttatagcttagagcgatataagaaaaagatactttatgttttttatttattttttattttcaagtgaaggtcttgtttttatttatcaaaaagaaaaagaaagtgaaggtcctgttttgatggtaataggggatctcaagattttgtcattttagtaagaaaggtttctgttctggataccatgtgtttggtgatgaaagattttttgttggttgtattaatgttaaaaaagtcaaggattaatgaagtttatgtttggttaaaa

SEQ ID NO: 4961 - DNA, 1966 bp, Taraxacum officinale
cttcggtgatgtatatccacttctattatttattcatcaattgatcttgcatatgtatttgttatcataggggttcgattctgagttgagttacatcgatcacccattaatcatgtctctgaggccaaacgctaggactgaggttcgccggaaccggtacaaggtagccgtagatgcggaggaaggaaggcggaggagggaggacaatatggttgagatccgtaaaaacaagagagaggagaacttgcttaagaagcgtcaagtagtgccgtcgtcacaaccgctgtctactggtgctcctattcaaaccgccacaaccgagaaaaagttagagagtcttccctcaatggtagctggagtatattcgaatgataacaatatgcagttagaggcaactacccagtttcgtaaattgctctctatagaaaggagtcctccaattgaggaagtcatacaatctggtgttgtacctcggtttgttgagttcttaatgagagaggattttccacaactccagtttgaggcagcttgggcactcacaaatatagcttctggtacttctgagaatacaaaggttgtaattgatcatggggctgtcccgatttttgtgaagcttcttgcttctccaagtgatgatgttcgcgagcaggctgtttgggcattggggaatattgcaggagattcacccaaatgtcgtgaccttgtgttaggtcaaggtgccttggttcctttgctggctcagttgaatgaacatgctaagctgtcaatgcttagaaatgccacatggacattatcaaacttttgtcgtggaaaaccacaacctccatttgagccgacaaaaccagcacttcctgcattggaacggcttgttcattcaaatgatgaagaggtgttgacagatgcctgctgggctctctcctatttgtctgatggtacaaatgacaaaatccaggctgtcatccaggccggtgtctgtcaacgtctcgttgagctgctcctacatccttctccttcagtactcattcctgcacttcgaactgttgggaatatcgtgacaggagatgatctccaaactcagtgtattatcgagcacggtgcacttccatacctgctaagcttgttgacacataaccacaaaaaaagcatcaagaaagaagcctgttggacaatctcaaacatcactgctggcaacaaagaacaaatacaggctgtaatcatagcaggattaatcagcccactagtgaatctcctccaacagccgaattcgacatcaaaaaagaagcagcatgggccatatcaaacgccacttccggtggcaacaatgaacaaatcaagtacttagcggcacagggatgtatcaaacccttatgcgaccttcttgcatgtccggacccacggatcgtgactgtttgtttagaaggactcgaaaacattctcaaagtcggggaaatcgagaagaattcgggtcaaagtggagatgttaatttctatgcacagttaatagatgaagctgagggtttggaaaagattgaaaatctacagagtcatgataataatgagatatatgaaaaagcggttaagattctggagacgtattggttggaagaggaagatgaggcggttggagatgctgctggtcaaggtcaaccggggtttaattttggagggaataatgttccgcttccatctggcggattcaatttcaacaattaaagggttttggaagtgggatagtatgttgatgtggtctatggtcaagtccaagtccggtcaggtcaggtcagttgagagaatgttggggcagtgtggttggtgagttaaatattgattgagatgtatatgatatgagatttatatctctttgctattgtgtgaagagatgttttattttccggttatttggtcatttttctaaatcctctttattgtaacaatattttttatgcttttatcttatatatatata

SEQ ID NO: 4962 - DNA, 2046 bp, Lactuca sativa
ttcaaatttgaaaaaaccctacgaataagctttctttttggcccgcccgtatctcttcctctatttctctcccggggcggaaaacacaaaaccctcactcgctctttatagtcggtgtcgctctacaattgatcgatactgaatacctggtattagatttacagacatagaatctctagtcccttaaccgctttctagggtattctctttctcgctaggaactgtaacgatgtcgctgagacctagcgccagaacggaggttcgccggaaccgatacaaggtggcggttgatgccgaggaagggcgccggaggcgagaagacaacatggttgagatccgtaagaaccggagagaagaaagtttgcagaagaagagacgcgaagtcactgctggccagttcgccatgcccgttcagtctgcttccgccgccgaaaagaagttggaaaatctccctgcaatggttgctggagttctctctaatgataacaacatgcagcttgaggccactactcaatttcgtaaactcttatcaatagaacgcagccctccaattgaagaagttattcaatctggtgttgttcctcgctttgttgagttccttgtgagggaggatttcccccaactacagtttgaggctgcttgggctttgactaatattgcgtctggaacatctgaacacacaaaggtggtgattgatcatggagctgtcccgatatttgtgaaacttcttgcatctcccagtgatgatgttagggagcaggctgtatgggcgctagggaatgtagctggtgattcccctaaatgtcgtgaccttgtacttggacaaggagctttgatttctttactttctcagttaaacgcacatgctaagctatctatgttgcgaaatgccacttggacactttccaatttttgtaggggcaaaccacagccttcttttgatcagacgaaacctgcacttccagctctacagcaacttattcgttcagaagacgatgaagtcttgacagatgcttgttgggcactttcatatctttctgatggcaccaatgataaaatccaagctgttattgaagcaaatgtatgtccaagattggttgagctactgaatcgcgcatctccaagtgtgcttatccctgctcttcgtacagttgggaacattgttactggagatgatatgcaaactcagtatataatcaatcttcaagcattaccttgtcttctgaacctgttgaatggtaatcacaaaaagagcattaagaaggaagcttgttggactatatcaaacatcacagctggcaacaaggagcagattcagatagtgattgaagcaaatatcattggtccccttgttcttttgcttcaaactgctgaatttgacatcaagaaagaggctgcatgggccatctcaaatgctacttctggtggaacccacgaccaaattaagtatttagttagtgaggggtgtatcaaacctttgtgtgacctgctgatctgtccagacccacgaatagtgacagtgtgtttagaggggcttgagaacattttaaaggttggggaagctgaaaagaatttggggcaatctggggatgtaaatgtttatgcacaaatgattgatgatgctgaagggttggagaaaatagaaaatttacagagtcatgataacaatgagatatatgagaaagcagtgaagcttcttgagacgtattggttggatgaagaggatgatgttatgccacctggcgaagcaacccctcagcctcaggctgctgctttccattttggaggtgctgatgtttccgttccctctggtggatttaccttcaactgattcaagtgaaggtgattcctcctttctgaagtgaagtagggctctttttttgacctgggtggtggtctagctttattatagttttgacttttgagggtttatgtttaactgttaagaatcaatatcttagcagtgatgattggtgtcttgatgaattatgatgtaaagtagttatacttctctttgattatttgacgttgggatttatggattta

SEQ ID NO: 4963 - DNA, 1923 bp, Arnica chamissonis
gacgtgtttttctaatcgattgatatgtttcgcatatgtaatcatcacagtttatggattttctctaaatcaacgagtttttattgatcgatttgtgttgagtatgtatttgcacgtctagggttttaatttttgagttcagtgaaatcaattagccatcaatcatgtctctgaggcctagcgcacggaccgaggttcgccgaaaaccgttataaggtggccgtcgatgcggatgaaggaggcggcggagggaggacaacatggttgagatccgtaagaacaagagagaggaaaacttgcttaagaagcgtcaactgctgtcgtcatcacaaccgttgtctactggtgtttctgttcaaacatccacagtcgagaaaaagcttgaaagtctcccttctatggttgccggagtttattccactgataataatttgcagcttgaagcgactactcaatttcggaaattgctttccatagaacggagcccaccaattgaggaagttatacagtcgggggttgtacctcgctttgtcgagttcttaatgagggaagattttccacaacttcagtttgaagctgcttgggcactcacaaacattgcctcgggaacctctgagaatacaaaggttgtaattgatcatgggtcggtcccgatttttgtcaagcttctagcatctccaagtgatgatgtgcgcgagcaggctgtttgggcattggggaatgttgctggtgattcccctagatgccgtgatcttgtccttggtcatggtgctttgattcccttactttctcagctaaatgagcatgctaagctttccatgctcagaaatgccacatggacattatcaaacttctgtcgaggaaagccacaacctccatttgagcagacaaggcccgctcttccagcccttgagcgtcttattcattcaaatgatgaagaggttttgacagatgcatgctgggctctctcctatctttctgatggtaccaatgacaaaattcaagctgtgattgatgctggtgtctgccagcgtcttgttgagcttctcctccatccttctccttcggtactcatccctgcgcttcgaactgttgggaatattgtcacaggcgatgatctccaaactcagcacattatcgagcgtggcgcacttccttgcttgctgagcttgttgacccataaccacaagaagagcatcaaaaaggaagcctgctggacaatctcaaacatcactgctggaaacaaagaacaaatacagactgtgattgaggctggattaattgctcccctagtcaatctgctccagactgctgaatttgatataaaaaaagaggctgcatgggcaatatcaaatgccacttctggtggtaccaatgagcaaatcaagtatttggtgattcaaggctgtataaaacccttgtgtgatctccttgtctgtcctgatccaagaattgtgactgtctctctagaaggcctcgaaaacattcttaaagtaggtgaggtggaaaagcaagcaggtaacacgggtgatgttaatttatatgcccagttgattgatgacgcggaggggttagaaaagatcgagaatttgcaaagccatgataataatgaaatttatgaaaaggctgttaagattcttgagacgtattggttggatgaggaagatgaaaatttggctgatggtgctcaagctactttcgactttggtggaaataatgttcaagttccttctggtggattcaactttaacagctgaagttgcagggtttcagggtatggtgaagtacgttggtggcgtcaaaggtcaagtcctgttaggtcgggttgagtcatcgggtcaggtcatgtcgggtagggtcagagcatctcacgtcatcgagttacggaatgatcgagtcactggtctttgtgttgaagagatg

SEQ ID NO: 4964 - DNA, 2285 bp, Populus trichocarpa
agtgtaaagccccgctctttgccttcttcactctcaaaattaaaaaaacacgccacactctctctgattccctatctgtttttttaaaaattagggttttcaaattaccgtcaatcaaccatgtcgttgagacctagcgcgagaaccgaggttcgccggaaccgatacaaagtcgcagtcgacgccgatgaaggtcgccggagaagagaggacaatatggtggagatccgcaagaacaagcgtgaagagagtttgctaaagaagcgacgcgaaggtctccaggcacaacagttccctcccgctattctctcttcttctaatgtggaaaagaagttagagaatttgccttcgatggtggctggtgtttggtctgaggatggcaatttgcagcttgaatcaactactcagtttcggaaactgctttcgattgagaggagtcctccgatagaggaagttatacaagctggggttgttcctcgatttgttgagtttcttgttagggaggatttccctcagcttcagtttgaggctgcttgggctctcacaaacattgcctctggaacttcagagaacactaaggtggtaattgatcatggtgcagttccaatatttgtcaagcttctcggttctcccagtgatgatgttagggagcaggctgtgtgggcattgggaaatgttgctggtgactcccctaagtgccgtgatcttgtgctcagccatggagccttgattccattgctggcacagttgaatgagcatgcaaagctttcaatgctgaggaatgctacgtggacactatcaaacttctgcaggggcaagccacagcctccgttcgagcaggtgaggccagcccttcctgcacttgaacgtcttgtacattcaactgatgaagaagtcctaactgattcttgctgggcactctcttatctttctgatggtacagatgataaaatccaagctgttattgaggcaggtgtctgtccacgacttgtggagctcctcctccatccttctccttcagtgcttgttcctgccctccgcacagttggaaatattgtgacaggggatgatatgcagacccagtgcataattaccactggtgcactcccatgccttctaagcctgctgactcataatcataaaaagagcatcaagaaagaagcttgctggactatctcaaacatcactgctggaaacaaggagcagatccaggctgttattgagaatggtttaattggcccgctcgttaatttacttcaaaatgcggagtttgatataaagaaagaagctgcttgggctgtgtctaatgctacttcgggtggcactcacgagcaaattaagtttttggtcagtcagggatgtattaaaccattgtgtgatcttcttgtatcccctgatccaaggattgtaactgtatctcttgaaggattagagaacattctgaaggttggggaagcggagaagaatttggggaatagtggagatgctaatttctatgcccagatgatagatgatgccgagggactagaaaagattgaaaatctacagagtcatgacaacaatgagatatatgagaaggcagtcaagattctcgagacttattggttggaagaagacgacgagactttgccttcaggtgatggtgcccagcaaggatttcagtttggtgggaacggtgttcaagttccatctggtggattcaacttttagctgaaggaatctgtagagtttggaatggtgaagcagttcttggttggggtgataaatatgtcggggtcaagttgggtctggtctcggcacctcgttacttgttacagtctggtatagagtccattgtggtcaaagaggtgcctaacaggtcagtctatactacagcgtccgataagaagggggtcaggaaggtactatagcaacattgttacctggtcagccatgcttgataatttggccttattgctatggagtggcatggagggtgttaagaagtccattgttgcataacccttggctttgatcactgaacacgctgggggaggtttttttgtacgctgatcgaagtccttttttatgtcgagtcatgttgtgctagtattttttttttatatatatatatatagtctatttggtttttctttgattgggtgaatatggtatttgataaacctcattttctttggagtagtgtttaattttatggagatttttttaaagaaatcactcgagtttcgtaagtttaattgttgtgatttttccaggaaagattctgtaaaatcagtatttgttct

SEQ ID NO: 4965 - DNA, 1953 bp, Helianthus annuus
gtcagatcatcatgtctctgagacctaacgcgagaacggaggttcgccggaaccgttacaaagtcgccgtggatgcggacgaagggcgccgccggagagaagataatatggtggagatccggaagaataagagggaggagaacttgcttaagaagcgtcaagtgctgccgtcggcgcaaccggtttctgccggtgctccggtcactacctccgccaccgttgagaaaaagttagagagcctaccttctatggttgctggggtctattcaactgataacaacttgcagctggaggcaactactcaatttcgtaaattgctctcaatcgaacggagtcctccaatcgaggaagtcatacaatctggtgtcgtacctcgctttgtcgagttcttgatgagagaagatttcccacagctccagtttgaagctgcttgggcactcacaaacattgcttctggtacctctgagaacacaaaggttgttatcgatcacggggcggtccctattttcgttaagcttcttgcttctccaagtgatgatgttcgtgagcaggccgtatgggcattgggaaatgtagctggtgactcaccgagatgtcgggatcttgttcttggtcaaggtgctttgcttccattgctggctcagttaaacgagcatgctaagctttccatgctgagaaatgccacgtggacactatcaaatttctgtcgtgggaagccacaaccgccttttgaggagacaaaaccggcattgcctgcacttgagcgacttgttcattcaaatgatgaggaggttctaactgatgcatgttgggctctctcttatctgtctgatggtacaaacgacaaaattcaagctgtcattgaagctggtgtctgtaggcgtcttgttgagctcctcttgcatccgtctccctcagtcctcattcctgcacttcgaactgtaggtaacattgtgactggtgatgacctccaaactcagtgtattattgagcacggtgcactcccatgcctgctgagcttgttgaccaataaccacaaaaagagcatcaagaaagaagcctgctggactatctcgaacatcactgctggcaacaaagaacaaatccagtctgtaatcgaggctgggttgattgctcccctggtcaatctccttcaaaacgctgaatttgatgtaaagaaagaagctgcttgggccatatcgaacgccacttctggtggaactaatgaacaaatcaagtacttggtgagtcagggttgtatcaaaccgttgagtgatctccttgtatgtcccgatccaaggatcgttaccgtgagtttagaaggacttgagaacatattaaaggttggtgaagctgagaagaacttgggcaacactggagatgttaactactttgcgcaattgatagacgatgcagaaggcttagaaaagattgagaatttacagtctcatgacaataatgaaatttatgaaaaagccgttaaaattctcgagacttactggttggaagaagaagaagaagagcttgtggttgatggtgcacaagctggtttcaactttggtgggcccaatgctcaagttccacctggcgggttcaattttaacggctgaagaaagatatgacgggtgggtgaaacatcaagtcggggtccgcttgggtcatataatggcggtccaggtacaataaacaaatgggttcatagtttgggtttgggcggggcaatttttgggttctttttttttttttttttacctcgagtcgttgaatgttttggaacaatgttcgagggggatattgtgtatggagtcggggcaattgttttggagtcatgagtgtatattcatatgatctttgaatctatatattggccacgttgtaatggtaaaattgatgtatttactgtttgccatggatgaagtttacacttttattgaagagcatttcatgttaagc

SEQ ID NO: 4966 - DNA, 2013 bp, Helianthus annuus
aaatcacgaagctttttcgtattataattcgtttatattcacacaaattcattcgtttagggtttgattttgactttgagttgttagatcatcatgtctctgagacctaacgcgagaacggaggttcgccggaaccgttacaaagtcgccgtggatgcggacgaagggcgccgccggagagaagataatatggtggagatccggaagaataagagggaggagaacttgcttaagaagcgtcaagtgctgccgtcggcgcaaccggcttctgccggtgctccggtcaatacctccgccaccgttgagaaaaagttagagagcctaccttctatggttgctggggtctattcaactgataacaacttgcagctggaggcaactactcaatttcgtaaattgctctcaatcgaacggagtcctccaatcgaggaagtcatacaatctggtgtagtacctcgctttgtcgagttcttgatgagagaagatttcccccagctccagtttgaagctgcttgggcactcacaaacattgcttctggtacctctgagaacacaaaggttgttatcgatcacggggcggtccctattttcgttaagcttcttgcttctccaagtgatgatgttcgtgagcaggccgtatgggcattgggaaatgtagctggtgactcaccgagatgtcgggatcttgttcttggtcaaggtgctttgcttccattgctggctcagttaaacgagcatgctaagctttccatgctgagaaatgccacgtggacactatcaaatttctgtcgtgggaagccacaaccgccttttgaggagacaaaaccggcattgcctgcacttgagcgacttgttcattcaaatgatgaggaggttctaactgatgcatgttgggctctctcttatctgtctgatggtacaaacgacaaaattcaagctgtcattgaagctggtgtctgtaggcgtcttgttgagctcctcttgcatccgtctccctcagtcctcattcctgcacttcgaacagtaggtaacattgtgactggtgatgacctccagactcagtgtattattgagcacggtgcactcccatgcctgctgagcttgttgaccaataaccacaaaaagagcatcaagaaagaagcctgctggactatctcgaacatcactgctggcaacaaagaacaaatccagtctgtaatcgaggctgggttgattgctcccctggtcaatctccttcaaaacgctgaatttgatgtaaagaaagaagctgcttgggccatatcgaacgccacttctggtggaactaatgaacaaatcaagtacttggtgagtcagggttgtatcaaaccgttgagtgatctccttgtatgtcccgatccaaggatcgttaccgtgagtttagaaggacttgagaacatattaaaggttggtgaagctgagaagaacttgggcaacactggagatgttaactactttgcgcaattgatagacgatgcagaaggcttagaaaagattgagaatttacagtctcatgacaataatgaaatttatgaaaaagccgttaaaattctcgagacttactggttggaagaagaagaagaagagcttgtggttgatggtgcacaagctggtttcaactttggtgggcccaatgctcaagttccacctggcgggttcaattttaacggctgaagaaagatatgacgggtgggtgaaacatcaagtcggggtccgcttgggtcatataatggcggtccaggtacaataaacaaatgggttcatagtttgggtttgggcggggcaatttttgggttcttttttttttttttttttacctcgagtcgttgaatgttttggaacaatgttcgagggggatattgtgtatggagtcggggcaattgttttggagtcatgagtgtatattcatatgatctttgaatctatatattggccacgttgtaatggtaaaattgatgtatttactgtttgccatggatgaagtttacactttta

SEQ ID NO: 4967 - DNA, 1669 bp, Flaveria ramosissima
atcgacaccagtgtactctattgcataaacaacatccactcactgtaaaccctaaatccctaatttctagggtttgttctttctattctagcacaatcaaacatgtcgttgaggcctagcgagagaacagacgctcgccggaaccgctacaaggttgcggtggacgccgacgagggtcgccagaggagggaggacaatatggttgagatccgtaagaatcggagggaggagagcttgcagaagaagagacgtgagggactcgctgcgagtcagtttcctctgccggttcaatctgcttccgctgccgaaaagagttagaaaccctcctgcaatggtagcgggggtttgcagatgacaataatatgcagcttgaggcaactacccagtttcgtaaactgttatcaatagaacgcagccctcccattgaagaagttattcaagctggtgttgttcctcgttttgttgagtttcttatgagggaggattttccccaactacagtttgaggcagcttgggctttgactaatattgcttcggggacatctgaccacacaaaagttgtgattgatcatggtgctgttcctatatttgtgaaacttcttgcatctcctagtgatgatgttcgggagcaggctgtatgggctctaggtaatgttgctggtgattcccctagatgtcgtgaccttgtacttggacaaggtgcattgattcctttgctggcacaactaaatgagcatgctaagttgtctatgttgcgaaatgccacatggaccctttccaatttttgtagaggcaagccacaaccttcttttgatcagacaagacctgcgcttccagctcttcaacaacttattcattcgaatgatgaagaagttttgactgatgcttgttgggcgctttcatatctttcagatggtactaatgataaaatccaagctgtaattgaagcaaatgtgtgtcccagattggtagagttactaaatcatccatcgccttcagtactcatccctgctcttcgtacagttggcaacattgttactggtgatgatatgcaaactcagtatatcatcaatcatcaagcactgccctgtcttctgaatctgttgatcaataatcacaaaaagagcattaagaaggaagcttgctggactatatcaaacatcactgctggcaacaaggagcaaattcagacggtgatcgatgcaaatatcattgggccgcttgttcatttacttcagaatgcagaatttgacatcaagaaggaggctgcatgggccatctcaaatgctacttctggtggaagtcatgaccagattaagtatcttgttagtcagggatgcattaaacccttatgtgacttacttgtgtgtccagaccctagaatcgtgacagtttgtctagagggacttgagaacatattgaaagtgggtgaatcagagaagaatttgggaagatctggagatgtaaatctttatgcacagttgattgatgatgctgaaggattggagaaaattgagaacctacaaagccacgataacaatgagatatatgagaaagcagttaagcttcttgaaacatattggttggaggaagaggaggaggatgtgatgccgcctggcgaaacagcgcagccaggtttcaattttggtggtggtgatgtttctgttcc

SEQ ID NO: 4968 - DNA, 2627 bp, Abies balsamea
aggagcaactatgtctctcagacccatgtcaaggaccgaggttcgaaagaagacctacaaggtggccgtcgatgcagacgaggcccgaaggaagcgagaggataatatggtggaaatcaggaagaataagagagaggagagtctccagaagaagagaagggagggtatgcaggcgcaacagtttccgcccaccgtgcaatcaaccgccgttgaaaagaagttggagagtcttcctgccatggttgcaggagtatggtctgatgaacctaccctgcaactggaggcaacaactcaatttcgcaagttgctttcaattgagcgtagtcctcccatagaggaagttattgatgcaggcgttgttccacgttttgtcgatttcctgacgaggcatgattttccacagcttcagtttgaagcagcatgggctttgacaaacatagcttcaggaacatcagagcatacacgagttgtgattgagcgtggtgctgtaccaatatttgtacagctgctaagttcaccaagtgatgatgttcgtgagcaggctgtatgggcattggggaatgtggccggtgactcccccaaatgcagagatctggttctcagccatggtgcattgccgccacttcttgcccaactgaatgagcatgccaagctttcaatgctgagaaatgctacttggactttatctaatttttgccgagggaaaccacagccagcattcgagcagacaaagccagctcttccagcacttgagcggcttatccattctaatgacgaagaagtcctaactgatgcttgctgggctctgtcttatctctctgatggaacgaatgataaaattcaagctgttattgaagctggtgtctgtcgaaggcttgttgagcttctgctccatccatcaccatctgttcttatccctgctctccggactgtgggcaatattgtaactggggatgatgtacagactcagtacattatcaacaatcaagcccttccctgcctcttggcactgttgactcataaccataagaaaagtataaagaaggaagcatgctggaccatatcaaacataactgcaggaaataaagatcaaatacaggctgttatcgatgcgaacatcattcctcctcttgtgcagttgctgcaaactgctgagtttgatatcaagaaagaagcagcatgggctatatctaatgctacatctgggggtacacatgaacaaatcaaatatcttgtgaatcaagggtgcattaagcctctatgtgaccttctagtctgtccagacccaagaattgtaactgtttgtcttgaggggctggagaatattttgaaagtcggagaagcagagaaggacctagggaacactggaggggtgaatctctatgctcagtttattgatgatgctgaaggactcgagaagatagagaacctgcaaagccatgataacaatgaaatttatgagaaggcagtgaagattcttgaaacgtattggctggaagatgatgaagatgaccaggcattacctgctactggagaggctgcgcaaccagcattcaattttggttcaaatcaaccgactgttccttctggtggattcacttttggttgaaaaggaatttcagctgctgcaacctggggggtgatgccatgggtgttttaaagcaattattccaaggccttataactacattgtagtcgtcagtcgtatgcaagcaaatgcatggtttttggatgtcactggtggcaggggatttctgttggtatgtcattatgacagtactagctaaatcgtgcaaatataagctcctcattttgaatgggttggccttagttggcgtggtggtacagttttcatgctgtactagtatggtggtctttgtccataagtcataaaattgcatagttagataaatggactcttatctgatgagccttctgatcttcatagcgctaagcttgagcttattgatgtatgggtatttagacgaagcagtgtgatgggtcatcaagttttctgtcgtcatactaactgcctggttctacttgcatttgttcttcattgcatcaaagagtctgtcctaagtcggtcttgtggccagtaaatggtcctactaacatactgttcctggataatcctggaacctgtgagaagtgcatgtaatcatgtgttctcctattctcctctggggttttgcccagatttttctttggatgttcacgttctagtgagtcctctgacccttctctttctctccctctttctcaccccaaaaatgcggatgagattagagaaaatcgtgtcttttggaagtctggcgggatttcctcaaatggtacattctgagcgtctcagacccctcctgttgccagtggtcactctattttggtagttgaaacttttattgaatcattttatgcacttgcaatatttgtctccagactggagacttttgctatgtaattttttagaattctattgccaatgaatttgaaggtcttttatcaactattttaaatgtctgggtaaaaataaatctcgtgttttttagtatcatatttggattgttttatacaatatttgctgaatgtatcgtgtactgtattgaaaggaaggtagatttgttggt

SEQ ID NO: 4969 - DNA, 2801 bp, Amborella trichopoda
gtaactagttttaattgtaatgcatttctggtttttttctttcgatccatcaaaacacaagagattttattggtttatgtactcaattttttattgagttactttgaaagttttgatttattgcttttgctttgagcctcgtttttttatttctttatgtagtttttggttagggtctggatgtgggagagattttaagatttggttggcaaagatgtctctaaggccgaattcacgtgctgaagttcggaagaagaactataaggttgcagtcgatgcagatgaggcaagaaggaagcgtgaggacaacatggtggagatcaggaagagtaagagggaggagagcctccaaaagaagaggagagaagggatgcaggctcagtttgctcccactgtacagccctctgctatggacaagaagcttgaaagtcttcctaatatggtggcaaagatatattccgaggatagtgccatgcagcttgaagcaaccacacagttccggaagctactttctatagagcgcagccctcctattgaggaagttatcgaagctggtgttgtgcctcgttttgttcaatttcttacgaggcaggacttccctcagcttcagtttgaggcagcctgggccctcacaaatattgcatctggaacatcagacaataccaaggttgtgattgaccaaggtgcagttcccatatttgtacagcttctttcctctcccagtgatgatgttcgagaacaggctgtttgggcattgggcaatgttgctggagactctccaaaatgtagagatcttgtgctcagccaaggagctcttatgccactattggcccagttgaatgagcatgctaagctttcaatgttaaggaatgctacatggaccctttcaaacttctgcaggggtaaacctcagccaccatttgagcagactaggccagcacttccagccctggagcggctgattcattcaaccgatgaggaagttttgacagatgcatgctgggcgctttcctacctttccgatggtacaaatgacaaaattcaggctgtgattgaagctggtgtctgtcggagacttgttgaactcttgatgcatccttctccttccgtccttatccctgcacttcgcacagttggaaatatagttactggggatgatgtgcaaactcagtatattatcaacaatcaggcgcttccctgcctccttacactcttgacacataatcacaagaagagcattaagaaggaggcatgttggaccatctcaaacatcactgcaggcaacaaagagcagatacaggctgtaatcgatgcgaacattattccacctcttgttcaattgcttcaaacggctgaatttgatatcaagaaagaggctgcgtgggccatttcgaatgccacatctggtggcacccatgaacaaattaagtacttggtgaatcaaggatgcattaggccactctgtgatcttctggtttgcccagatcctcgtattgttacagtctgcttggaagggcttgagaacattttgaaggttggggaagccgaaaagaaccttggaaacactgatggagtgaacctctatgctcagcttatcgatgatgctgaaggtctggataagattgagaatttgcagagccacgataacaatgaaatatatgagaaggctgttaagattcttgagacctattggttagaggaggatgaggataccttattgccacctggtgaaactgctcctgctgcttttacttttggttccaaccagcccccgattggtggattcaacttcagttgaagccttgaggttctcatgttgggtcggagtgctaagttgaaggtttcatactaagtgtcagaggatgatggggggttgggctttcgctgaagagcagggtgttgtctgtcactggagtgggtccgggattcttttcgagtcgttggttgctgatcggttttgtgttgaaatagagaaagctcccaaaactcccacttgttcatgaatggggagttttgggctcggatcagtggcagttatggtcgcgtcataaatttccaggcttttttttctttttaatgtttactgaacaaggaatgtgtaaagagcctggggttttcagctggagtcatcttttatatgggtctgggtcgggtcttttatcaggagatggtcaatctaagactgttcttcttttagagccattttaccaatctttggagtggctctttttacagtgggacttgctgcccctccctctcttattgggagtggggtggaagggttgatcatggggggtctttatttgctctctatgagtggtctaatgggggcttcctcatcagggagtttccagagtgtcttcttattacgtgtctttttttatagcaatacagcgtcattttgtaataacgggttatcggtctctctctctctctctcagagtcttgtgtgtgtatgtgttggatttggtattcaaggtagtatttcttgtatttgaaggatgccattacttcgtcagcatggattttttttttcatgggtacgtggattgcccttgattgccaactaaagcttcgtcccgcttgaacccttgatttccgagtgctcttcagacatttgacaaattcgttaatataagattcgttattggattaacgattagaaaaacactgactgttttggattttttggtagtggtgctaagaatgtgatatattatgtatatcttgaggttggaatggacagatgggagaattttccaataacactcttctagacggtttttgtaataatagtaggg

SEQ ID NO: 4970 - DNA, 1967 bp, Cirsium arvense
ggatttttgagttgaatcatatcaatcagccaacaatcatgtctctgagacctagcgccaggacggaggttcgccggaaccggtacaaggtggccgtagatgcggaggaaggaaggcggaggagggaggacaacatggttgagatccgtaaaaacaagagagaagaaaacttgcttaagaagcgtcaagtagtgccgtcgtcacagccgttgtctagcggtgctcctgttcaaacctccacaatcgagaaaaagttagagagtcttccttctatggttgctggagtatattcaaatgatagcaatatgcagctagaggcaactacccagtttcgtaaattgctctctatagaacgaagtccaccaattgaggaagtcatacaatctggggtcgtacctcgctttgtcgagttcttaatgagggaagattttcctcagctccagtttgaggctgcttgggcactcacaaacattgcctccggtacttctgataacactaaggttgtaattgatcatggggcagtgccaatttttgtcaaacttcttgcttccccaagtgatgacgtgcgtgagcaggctgtttgggcattgggaaatgttgctggagattcacccagatgccgagatctcgttcttggccaaggtgccttggttccattgctgtctcagttgaacgagcaagctaaactttccatgctgagaaatgccacatggaccttatcaaatttctgtcggggcaaaccacaacctccattcgagctgacaaaaccagcacttcctgcccttgaacgtcttgttcattcaaatgatgaagaggtgttgacagatgcatgctgggctctctcctatctgtctgatggtacaaatgacaaaattcaagctgttattgaggcaggtgtctgccaacgtcttgttgagctgctcctgcatccttctccttcagtactcattcctgcccttcgaactgttggcaacattgtgacaggtgatgatgtccaaactcagtgtattatcgagcatggtgcacttccatgcctgctgagcttgttgacacataaccataaaaagagcatcaagaaagaagcctgttggacgatctctaacatcactgctggaaataaagaacaaatacaggctgtaatcgaagcagggttaatcactcccttggtgaatctgcttcatacggctgaatttgacataaagaaagaagctgcttgggcaatatcaaatgccacatctggtggtaataatgaacagatcaagtacttggtgagccagggatgtataaagcccctttgtgatcttcttgcttgtcctgactcaaggatcgtgaccgtgtgtttagaaggacttgaaaacatattaaaagtaggggaagtagagaagaatttgggtcacactggagatgttaattattatgcccagttgatagatgaagcagaaggtctagaaaagatcgagaatttacagagtcatgataataatgaaatttatgaaaaggcggttaagattcttgagacatattggttggaagaagaagatgagcccgtaggagatggtgctgcacaaccggggttcaactttggaggtggtaacgttcaagtcccatctggtggattcaacttcaacaactgaaggtttttggaggcaggatggtatatgttgatgtcgtcaaaggtcaaatgcggtcgggtccggtcaggtcgggtcaggtcaggatgggtcaggtcaagtcatgtcaggtaaggtcagttgagagcatctcatgtagtctggttgcccattatggtgtggtccagtcaaggtcagttgtccaagagatgtgaagtcggtcggttttgatgagtctgggcattgcttttgttgtatacaagatgtacatctctttgccatagtgtgaaaagaagagatgggaacgatgatgtctttttttttctttttgctatttgtcaaatgacaaagttggag

SEQ ID NO: 4971 - DNA, 2566 bp, Citrus sinensis
cttgctttttctcagccttgactctcactccaaatccctaattttcaatttaatcacaagttagggtttttttccaaagccaaaacgatgtcgctgaggccgaacgccagagccgaggttcgtcgaaaccgttacaaggttgccgtcgacgccgatgaaggtcgacgacggagagaagataacatggtggagatcagaaagaataagcgcgaagaaagcttgctcaagaagcgacgtgaaggtctccaatctcagcaatttcctcctcctgctcctgcatccaatctgaatctccaaactaagttggaaagtttgcccgccatggttgctggggtttggtcagacgacagtagcttgcagctggaagcaactactcagtttcgaaaactgctttcaatcgagaggagtccaccaattgaggaagtcatacaatctggtgttgttccgcgttttgttgagtttcttatgagggaagactatccgcaacttcagtttgaggctgcctgggctcttacaaacattgcttctggaacttcagagaacactaaggtggtgattgaccatggtgctgttccaatatttgtgaagttacttgcttctccaagtgatgatgttcgtgagcaggctgtttgggcattgggaaatgtcgctggtgactctcctagatgccgtgatcttgtgctcagccaaggagctttgattccattgctggcacagttaaatgagcgtgctaagctttcaatgctaagaaatgccacatggactttgtctaatttctgcagggggaagccccagccaccatttgaccaggtgagaccagctcttccagctcttgcacagcttgttcattcaaatgatgaagaggtcttgactgatgcctgctgggcactctcctatctttctgatggaacgaatgacaaaattcaagctgtgattgaggcaggtgtttgtccacgacttgttgagctccttggtcatccatcaccctcagtgctcattcctgcccttcgtacagttggaaatattgtgacgggagatgatttccagactcagtgtataattacctatggtgcactgccctaccttttgggcctgttgacccataatcataaaaagagcatcaagaaggaggcctgctggactatttcaaatattacagctgggaacagggaccagattcaggcggtaattgatgctggcttagttggtccccttgtcaatctgcttcaaaatgctgaatttgatataaagaaggaggctgcttgggcaatttcaaatgccacctcgggtggtactcatgagcaaatcaagtacctggtgagagaagggtgtataaaacctttgtgtgatctctttgtatgccctgatccacggattgtcactgtttgcttagaaggattagagaacattttgaaggtcggggaagctgaaaagaatatgggtactgccactgcagatgttaatcaatatgcccagttggttgaggaggctgaggggttagaaaagattgaaaatctacaaagtcatgacaacaatgagatctatgagaaggcagtaaaaattcttgagacatactggttggaagaggacgatgagacaatagctgcaggtgatggtcctcagccaggtttcccatatgcagggaatgaggttcaagttccgtctggtggattcaatttcagttgaaaatcaattggctcgttttctggtgggagggatacatagtttgtcggatggagcagaagtttgtgttggggtgggtttgaatgttgacgacgtatgtcggggtcaagttgggtcgggtcagggcgcctttgcatgtctggttacaggtttggtccagtgtctattgtggttgaaaaggtgccaactaaggtcggtctatacttacagtgtccaataaagtgaggctggatggattaactacaatatgatggcatgtgtttttgccttggaaatgcttcaagaggaatgcaagaagtgtatatccagggactgatctgaagtggtctggtggttgtggtggtgttgtagtcggggcattgtcgagtctacaatttgtcccatgagtcgtgtgtgtaaccagagtctctctacggcttggcatatttgtttcattgtggtgggtgaataactgaaaatgtagagtaccaaaaacctcttgtttgggtgtattacgagtaattagcagtatctttcttaaatgtgcgaaatcctcatgttcttactttcatctctacaatcatgttctcgcaagcgcatgtgtgagcctgagctgaataatcagaattaggctcatttgactaaagggtgaacatggctgaattgagctggagtttgcatcagtggagtttatgggctggactaaaatgtgaactgttccgcatgtgggaagattttgctgccgcaaatcgccgctgttttagtagcaggcgtgtttacaatacaaccgttgtctttacattctcctttgaaaatctcaaattctgaactgttgggagtcaaagaccaaaaatttcttggtgtgagtgatgaattttcaatggaaaatgtgtttgtgacgtca

SEQ ID NO: 4972 - DNA, 2398 bp, Quercus alba
tagtatcagccggaattcccgggataacttctctctctctctctctctcatcaaaacccaattttaattaaaaatttttaagtttttaaaattttttgtactctctctctatctttcaaaacaaaaaacgatgtcgttgaggccgagtgctcgaacggaggtgcggcggaacaggtacaaggtggcggtggacgcggaggaggggcggcggaggagggaagacaacatggtggagatccgcaagtcgcgaagagaagagagtcttttgaagaagcgtcgcgaaggtctccaacagctctcctccggtgcggcgcaaaaccagctgcagcaaccgctgctcggctcttcttttcaatcctccgccaccggtctcgaaaagaaattagaacatctaccatccatggttgcgggagtgtggagtgatgatagtaatctgcagcttgaggcaactactcagttcaggaaattgctttcaattgagcgtagccctccaattgaggaagtgatacagtcgggcgttgttcctcgctttgttgagtttctcatgagggaggactacccacagcttcagtttgaggcagcctgggctctcactaacattgcttctgggacatctgagaacactaaagtggtaattgatcatggggctgtcccaatatttgtcaaacttcttggttctcctagtgatgatgttcgtgagcaggctgtgtgggcattgggaaatgttgctggtgattcccctagatgtcgtgaccttgtcctaggcaatggggctttgcttccattgctggcacagttgaatgagcatgccaagctttctatgctgagaaatgctacctggacactgtcaaatttttgccgaggcaagccacagcctccttttgatcaggttaagcctgcactcccagctcttgcacgccttattcattcaaatgatgaagaagtcttaactgatgcttgctgggcactctcgtatctttctgatggtacaaatgacaaaattcaagctgttattgaagcgggtgtttgtcctcggcttgttgagctattattccacccatctccttctgtgctcattcctgctcttcgtacagttggaaatattgttactggagatgatatgcagactcaggttatcatcaaccacaatgctcttccttgcctattaaacctattgaacaataattataaaaagagcattaagaaggaagcttgttggaccatttcaaatatcactgctggcaataaggagcagattcaggctgttattgcggctgatataattgccccccttgttaatttgcttcaaaatgctgagtttgatattaggaaagaggctgcatgggcaatctcaaatgccacatctggtggttctcctgaacaaatcaagtacctggtaaatcaagggtgtatcaagcccttgtgtgatcttctcatctgccccgatccaaggattgtcacagtttgtttggaagggcttgaaaacatattgaaggtaggggaagctgataagaactcgggcagttctggagatgtaaatctctatgctcaaatgattgatgatgcggaggggctagagaaaattgagaatctccagagtcatgacaatactgagatttatgagaaggctgtgaagattcttgagacatattggttggaggaagatgatgagacaatgccaggtgatgctgcccagtctacgttcaactttggagggagcgaagttccttctgttccttcaggtggattcaaattcgactgaagtatttggtggcgagagattagttggggtcaggtcaggtgtcttgtcgtgtttgggtcctctttggtccagtctggtgcatgatttatgggggtgctggactggcacaagtgtcggtaatggctggattaagatgttgagggatacttggattggttatatgacagaactagaatttgttgctgcaacaaagttgaggagccagagttctctttttggggaatggttattccaggtgattgggctctcccatgaagtcgatgtcgagtctcataagttgtttcatttgttctatttgccatagaacagagtcggagtctgtcagttgcggggtgatttttgtactaccaaattcactctatagacacttgtagttatgagggatactggatttttatgttcattgtatgttgtgatgatttttccccccctttgagtcgaaaatgtatttgcctagggtataccgtttactggtttgatatgaaaagttgtctaaaactcattgaaggaaaagagtctcttaatatttattgatatcagagttctagtctgcctccttttttcgtttgtattgcacttgactttgctataaaggctatatgttaataaattttgtatgaactgtgattttttccc

SEQ ID NO: 4973 - DNA, 2159 bp, Helianthus annuus
atcattcatatttccgttttttaactttaaaccactctacaagaacaaattcatcctccctcttctctctccgtacattcttcagggtaattgattaggaattgatcatgtcgctgaggcctagcgcgcgtacggaggtgcggcggaaccggtacaaggtggcggttgatgcggatgaaggacggaggcggagggaggataatatggttgagatccggaagaataagagagaggagaacttgttgaagaagcggcagttgttgtcgtcgtcgcagtcgttggctgctggtgtgcctgttcaagcgtctacggttgagaagaagctggaaagtctcccttctatggttgctggagtttactccaatgataataatttgcagctggaggcaactactcagtttcgtaaattgctttccatagaacggagcccaccaattgaggaagttatacaatcgggggttgtacctcgctttgtcgagttcttgatgagggaagattttccacagcttcagtttgaggctgcttgggcactcacaaacatcgcctctggaacctctgataatacaaaggtcgtaattgaacacggggcggtcccaatatttgttaagcttctagcttctccaagcgatgatgtacgcgagcaggctgtttgggcgttgggaaatgttgctggtgattctccccgatgccgtgatctcgttctcggtcatggtgctttgatgcccttacttgctcagttaaacgagaatgctaagctttctatgctcagaaacgccacatggacgttatcaaatttttgtcgaggaaaaccacagcctccatttgagcagacaaggcctgctcttccggcccttcagcgtcttattcattcaaatgatgaagaggtgttgacagatgcatgctgggctctctcttatctttctgatggtaccaatgacaaaatacaagctgtgattgatgctggtgtttgccaacgtcttgttgagcttctccttcatccatctccttcggtgctcatccctgcgcttcgaactgttgggaatattgtcacaggcgatgatctccaaactcagcatattatcgaatgcggtgcgcttccttgcttgttgagcttgttgacccataaccacaagaagagtatcaaaaaggaagcttgctggacaatctcaaacatcactgctggaaacaaagaacagatacagacggttatcgaggctggattaatagctccgctagtcaatctactccagactgctgaattcgatattaaaaaagaggccgcgtgggcaatatcaaatgccacttctggtggtaccaatgagcaaatcaagtatttggtgaatcaaggctgtataaaaccgttgtgcgatctcctcgtatgtcccgatccaagaatcgtgaccgtctctctagaagggcttgagaacattcttaaagtaggtgaggtggaaaagcaagtgggtaactcgggtgacgttaatttcttcgcccagttgattgatgatgcggatggtttagagaagattgagaatttgcaaagtcatgataataatgagatttatgaaaaggcggttaagattctcgagacgtattggcttgatgaggatgatgaaaatgtggctgatggtggtcaggctggttttgacttcggtggaaataacgttcaagttccgtctggtggatttaattttaacagctgaagggttttcaaggtatgatgaagtacgttggtggcgtcaaaggtcaagtcctgttaggtcgggttaagtcatcgggtcaggtcaagtcgggtcgggtcagagcatctcgtgtcgtcgggttacagaatggtcgagtcactggttattgttttgaagagatgcaaaaggtgggtctgttggttccagtattcgaaggggttgaccaaggattttatttagcgagtttatcggtaaattgtttggttgttacttcaagcagctggaggtggtcatttcgttttagtgagggtttaagagttacaaatatacacggagtctttattaatttcgggtttttatctttgatatttttggacacgtatgtttttatactctgtcggggcgttcgttttactagtgtcttatgttttattgttgagttggacgtgttcatgttttaccgtttatggaaatatcaca

SEQ ID NO: 4974 - DNA, 2126 bp, Eschscholzia californica
cccctacgacctactcaacctcttcccgaactcaacccagcctcactctatcaactgtgagtgattctagggtttattcaatcaaacaaccatgtctctccgaccgaacgccagaactgaggttcgaaggaaccgatataaagttgctgttgatgccgatgagggaagaagaagaagagaagataacatggttgagatccgaaaaaataaaagagaagaaagtttgatgaagaagagaagagaaggtatgcaaccgcagcagtttccaacttcgattcagggaaccaccgctgagaaaaagttagaaagtcttccttctatggttgctggggtttggtcagaagatagagagttgcagcttgaagctactacccagttccgaaaactgctttcaatagaacgtagccctccgattgaggaagttattcaatctggtgttgttcctcgttttgttgagttcctcatgagagaagattatccacagcttcagtttgaagctgcatgggcgcttacgaacatcgcgtctggaacatctgataacaccaaggttgtaattgaccatggggcagtccctatctttgtcaaacttcttggttctccaagtgatgatgttcgtgagcaggctgtctgggcactaggaaatgttgctggtgactccccacgatgtcgtgatcttgttcttagagaaggggctttgcttccattgcttgcgcagttgaacgaacatgccaaactttctatgttgagaaatgccacatggactctatcaaacttctgcaggggcaaacctcagcctccatttgagcagacaaggcctgcacttccagctcttgagcgtctaattcacaccaacgacgaggaggtcctgacagatgcttgctgggcactctcatatttgtccgatggtacaaatgacaaaattcaagctgttattgaagctggtgtctgccctaggctcgttgagcttttaatgcacccatctcccacggtgctcattccagccctccgtacagttgggaacattgtaactggagatgatcaccagactcagtttgttatcaaccaccaagctttgccttgcctcgtgactttacttacgagcaatcacaagaagagcattaagaaggaagcttgctggaccatttcaaacattacagctggaaacaaggaccagatacagtctgtaattgatgctggtatcataagccctcttgtccacctgcttcaaactgctgaatttgatatcaagaaagaagctgcatgggcaatctcaaatgctacctctggtggtgcccatgaacaaatcaagtttttagtggaccagggttgtatcaagccactgtgtgatctccttatctgccctgatccaagaattgttacagtttgtttagaaggtttagagaatatcttgaaagttggcgaagctgagaagaacttgggaaatactgatggtgttaacatctatgctcaattgatcgatgatgccgaggggttagagaaaatagaaaacctacagagccatgacaataccgagatttacgagaaggcagtgaagattctcgaaacttactggttagaagaagatgatgagccattgcctcctggtgatgcttcggcccaaactgggttccacttcggagggaatgaaccaccagttccttctggtggattcaacttcagctgaaagtaacaggattttggtctgagcagttgaacccagtttgagtcttgagcgtcttgtttgtgttgtcggttcagtcggtaagagtctgtctccaaggtggatgttaggatcgctttggtaagaaggtattcttcaaggagaaaactcatgtagcagagagctctacatttggggaagatgagtttttgagcaaggtggaatctgagtcccaggtttctttaattattttttttcttggcactagtagtagcagtcttattatatatggaacagtttagtttttgaagcgtctactgtgaaaggaagataggggaaaaaaggttgttttacttttattatatctgaaggttttgtgatttcgtgagtttggttcggatttttcccttaaaagggtgaaaaacatatgctgttttggaagggtttgaaaggaaagaacattaat

SEQ ID NO: 4975 - DNA, 2183 bp, Eucalyptus grandis
ctcgccccctcgccctgcacaaaaaactctcgagcagcgacatcgccgcacggccgccgtccagccacccccgccgcgcctcgatttcgcccgcgcgagccgacccgcgagagagagagagagagcgagccatgtcgctgaggcccagcgctagggcggaggtccgccggaaccgctacaaggtggcggtggacgccgacgaggggcggcggcgccgggaggacaacctggtggagatccgcaagagcaggcgcgaggagagcctgctcaagaagcgccgcgaggggctgccgctcgccgcccctccccaatcgaccaacctcgagaagttggagagtcttcctttgatggtagccaaagtctgctctgcggatgcggcattgcagctggaagcaactacacagttccgaaaaattctttcgatagagagaaaccctccgatcgaggaagttatacaatccggtgtagttcctcgctttgtagagtttctacttagggaagacttcccgcagcttcagtttgaagctgcatgggctctcacaaatgtcgcatcagggacctcagagaacaccaaagttgtgattgatcacggggcagttcctatctttgtgaagctgcttgcctcacctagtgatgatgtccgtgaacaggctgtgtgggcattgggaaatgttgctggcgactcgcccaaatgccgtgatttagttttgggtcatggagctttgatgcatcttctggctcaattaaatgaaaatgcaaagctctcgatgctgagaaatgccacatggaccttatccaatttctgcagaggcaagccacagccttcattcgagctggttaagccagggcttccatctttggagcgtctcattcattcaaatgatgaagaagttttgacagatgcctgttgggcactttcttatctttctgatggtacaaatgacaaaatacagtctgttattgaagcaggtgtctgccctcggctaattgagcttctgcttcatccttctccttcagtgctgattcctgcccttcgcacagttggaaacattgtcactggagatgatatccaaactcagtgcattattaataatggtgtgcttccatgccttctgagtctgttggcccacaatcacaaaaagagcatcaagaaggaagcatgctggacgatctcgaatgtcacagctggaaatagtgaacagattcaggctgtcatagaagctggtcttattggcccccttctcaatctacttcaaaatgctgagtttgatataaagaaagaggctgcttgggcaatatcaaatgctacatctggcggttcccatgaccaaatcaagtatatagtgagtcaaggatgtatcaagccactatgtgatctgcttgtgtgccctgatccaaggattgtaactgtttgcttagaagctctagagaatattctgaagattgggcaagcagagaaggaatgcggcaatactggggataatgtctatgcccggatgatagatgatgccgaggggctggagaagattgagaatcttcagagtcatgacaacaatgagatctacgagaaggcagtgaagattctcgagacatattgggtggaggaggaggatgagatagtacccccaggtgataatacacaaccgggcttcaacttcggaggcaacggactacctccatctgatggattcaactttaattgaagggatttaacgttggggcaattgataatcacattgggggcgctattgaagtcagaacagcttgggatgtctggttgcactgtcagtcagtttggagtctgttgaggtcaaaggggtgtctgagcacgtctatctgagctacgttgtcccaaacaagcagggtatggacttgaccttcatgccctcgttcaatgatcgtgttgtcgagattttgagtgtctcaagaggttcattttttagggtggtcgcctgaatgtccatcatctatccattccgagtcagtttaccattgctagtcttttctagatttgagaagtttttggctggtcgttgcacctttgttgaacgcaaacatctgaaagcctcattcctgatgtactacagttagaaaggcaaatccatgagtttttgtatttcagccttatcacatgcattctatgtcaactgcagtcactttaatatgaaagaagagtaagaaaa

SEQ ID NO: 4976 - DNA, 2357 bp, Vitis vinifera
cgggtcctatcttacaaaatccaaatccccctctcttccgctctcattcctctcagaaacccttcgccactcgcctccattgatcaccgatcatcaatctccggcgctatcggtgatttttcttgatcggcagccatgtctctgaggcctagcgccagaaccgaggttcggcggaaccggtacaaggtcgccgtcgatgcagaggaaggccgtaggaggagagaagacaacttagtcgagatccgaaagaataagagagaagagagcttgcagaagaagaggcgcgagggccttcaagcgcagcagttcaccactcccgtcagtgcttcaaccttcgagaggaagttagaaagtcttcccgcgatggttgcaggtgtttggtcagaggatagcaacttacagctcgaggcaaccacttatttccgaaaactgctttcaatagaacgcagtcctccaatcaatgaagttatacaatctggtgttgttcctcgcttggttgagttccttggcagggatgacttcccacagcttcagtttgaggctgcttgggctctcacaaacattgcttctggaacatcagaaaacaccaaggttgtaatagatcatggagcagttccgatttttgtgaagcttcttggttcccaaaatgatgatgtccgtgaacaggctgtatgggcattaggaaatgttgctggtgactcacccaaatgtcgagatcttgtccttggccatggggccttgatgcctttgatggctcaattcaatgagcatgcaaaactttctatgttgagaaatgcaacatggacattgtcaaatttctgcaggggcaagccacagcctcaatttgagcagacaaagcctgccctcccagctcttgaacgtcttatacattcaaatgatgaagaagtccttactgacgcatgttgggcactatcatatctttctgatggtaccaatgataaaattcaagctgttattgaagccggtgtttgtccccgacttgttgaactgttacttcacccatctccctcagtcctcattcctgcccttcgcacagttggaaatattgttactggggatgatatccaaactcagtgtattataaactatggagctcttccttgccttttgaacctgttgtcacataattacaagaaaagcatcaagaaggaggcttgctggaccatctcaaacatcacagctggaaataaagatcagatacagtctgtaattgaggctggcatcattcctccccttatctatctgcttcaaaatgctgaatttgagatcaagaaagaggctgcttgggccatttcaaatgctacttctggtggaacccatgatcaaataaagctcttggtgagccagggttgtattaagccattatgtgatcttcttatctgtcccgacccaagaattgtcactgtctgcttggaaggccttgagaacattctgaaagttggggaagctgataagagcttgggacacactgatgtgaaccagtttgctcaagctattgatgacgctgatgggttggaaaagattgaaaatcttcagagccatgacaacactgagatatatgagaaggcagtgaagattcttgagacatactggttggaggaggatgaggagccattgcctccaggtgatgcttcccaatctgaattccattttggtggcaatgaccatcctcctgttcctcctggtggattcaactttggttgaaggacattcagatggcagtggaatgaagctcaaagtccaggttttggggtggtgaattaatttttgaggtcatggaggggcatctcattgtcgtctttggttctttgggttctggtcggtgcaagatggaggtggtgtgggtggagagatgctggagtctgtttgctctcttgcagtagttgaataaaagtcgggctgtgctatatcatgagtgggttacatggtagatgatgaggactgtttggggatctttgccattgcaaatgaatctagtctcttttccttcttccttttgttgcttattctttctaccgtggtatagcggatacaacttcttatggttatttctgtttcaatccatggtttatagacagagcgcaataagggggaaaaaaagatataacatttggtcatggttctcttttttttttactttttatcccttcccttcctttttttatagttgggggaggaagtaaatacatgttctgttttggttttctgggtgggcgaagcattattattgctgcattaaagattttgttaccttctgatggaattgatatgttttatgcacagagatatatatttgttttgttctcttttctaagatggatatgtatttgttttgt

SEQ ID NO: 4977 - DNA, 2286 bp, Phalaenopsis aphrodite
gtgtgatggtaatattacaatttgtacatggccatggctgatttgatacactgaaatccaggtttcaaaagggacgttcacaattcatctctaggttttcggtttggcattgttgtttcggtctgacgctgacctagttgtcgatattggtggtttgcgatgtcgctgcggccgagcgcgagggcagaggttcgccggagtaaatacaaggtagcggtagacgcagaggaggggcggaggcgaagggaggataatatggtcgagattcggaagagtaagcgggaggagaaccttctgaagaagcgtcgtgagggcatgcaggttccgcctttcgccgcttccgtgctcggttcagccgttgagaaaaagctagagagtcttccggctatggtggcgggtctatacgcggatgatggtgcctcgctacttgaatccaccacacaattccgtaaattgctatcgatagaacgcagtcctcctatcgaggaagttatacagactggtgttgttcctcgctttgtggagtttctcattagggatgatttcccacaacttcagtttgaagcggcttgggcactcaccaatattgcttctggaacgtctgaaaacaccaaggttgtgattgaccatggagctgtgccaatatttgtgaagcttcttggttcccctagcgatgatgtacgagagcaggcagtgtgggcattaggcaatgttgctggtgattctccaaaatgtcgggatcttgttcttgctaatggtgcactgatgcctctgctgtctcagctgaatggcaatgctaaactttcaatgcttagaaatgcaacgtggactttatccaatttttgcaggggtaaaccacagccaaattttgagcagacaaagcccgctcttccaactcttaaacacctcatccattcaactgatgaggaagttctcactgatgcttgctgggctctctcttatctgtctgatggtacaaatgacaaaatccaagctgttattgaagctgaagttgtacctcgacttgttgagcttcttttacatccttcaccatccgtgcttattcctgctctacgtactgttgggaacattgtcaccggggatgatgtacaaacacagtatgtcatcagcagcggagctcttcaattccttttcaatcttctgacccaaaatttgaagaaaagcatcaagaaagaggcttgctggaccatttctaacataactgccggaagtaaggagcaaatacaggctgtgatcgagtccaatatcattgctcctctggtagacttgcttcaaaatgcagagtttgacatcaagaaagaggcagcatgggctatttcaaatgccacatctggaggtactgatgatcaaataaagtttttagttagccaaggatgtattaagcccttgtgtgatcttcttgtttgtccggaccccagaattgcgacagtctgccttgagggtcttgaaaacattctaaaggttggtgaggccgaacaaaaccttggagccactggaggggtaaacctgtatgctcagatgattgatgaagctgatggattagagaagattgaaaatctccagagtcatgacaacacagagatctatgagaaggctgtaaagatcctggagacttactggttggaagaagaagatgatgccatgcatgcaggagatgctgatcaaagtggtttccaatttggagccaaccaacagttttctgcccctattggtggattcaacttcagttaaagggatttctgctgttgaactatgagaatgatgatgattgacctgcagtaatggagttattttgatttggacttctcatgcaaacttggtaatggtcagtttggaaccgttcctgcatccagttttttgtgttcatttgatgcaagggtgggcgtcaataaaaaagctgtggctgcgttgggtgctttttgttccttaatgcttctatggagtttcagatcttatttaatttttagggcttttcaacctgtgcttgggaacatcaacgggatttttatttggctgtttagatttttgaggggaaataggaatcagtttatgttttcttgtttgcgattggagtccagggcatataccatgagccgttgagggttttttgggatgccacagtttttgatttttgctgagtttggtcagtgtatttaagaaagtccaatgcatattcatggaataggtattcatatagtttgcgtatatgttaatgttttgacgtacttttttcctcatttcacagttcaaatagcgaaaaaaatg

SEQ ID NO: 4978 - DNA, 2177 bp, Eucalyptus grandis
ctcgccccctcgccctgcacaaaaaactctcgagcagcgacatcgccgcacggccgccgtccagccacccccgccgcgcctcgatttcgcccgcgcgagccgacccgcgagagagagagagagagcgagccatgtcgctgaggcccagcgctagggcggaggtccgccggaaccgctacaaggtggcggtggacgccgacgaggggcggcggcgccgggaggacaacctggtggagatccgcaagagcaggcgcgaggagagcctgctcaagaagcgccgcgaggggctgccgctcgccgcccctccccaatcgaccaacctcgagaagttggagagtcttcctttgatggtagccaaagtctgctctgcggatgcggcattgcagctggaagcaactacacagttccgaaaaattctttcgatagagagaaaccctccgatcgaggaagttatacaatccggtgtagttcctcgctttgtagagtttctacttagggaagacttcccgcagcttcagtttgaagctgcatgggctctcacaaatgtcgcatcagggacctcagagaacaccaaagttgtgattgatcacggggcagttcctatctttgtgaagctgcttgcctcacctagtgatgatgtccgtgaacaggctgtgtgggcattgggaaatgttgctggcgactcgcccaaatgccgtgatttagttttgggtcatggagctttgatgcatcttctggctcaattaaatgaaaatgcaaagctctcgatgctgagaaatgccacatggaccttatccaatttctgcagaggcaagccacagccttcattcgagctggttaagccagggcttccatctttggagcgtctcattcattcaaatgatgaagaagttttgacagatgcctgttgggcactttcttatctttctgatggtacaaatgacaaaatacagtctgttattgaagcaggtgtctgccctcggctaattgagcttctgcttcatccttctccttcagtgctgattcctgcccttcgcacagttggaaacattgtcactggagatgatatccaaactcagtgcattattaataatggtgtgcttccatgccttctgagtctgttggcccacaatcacaaaaagagcatcaagaaggaagcatgctggacgatctcgaatgtcacagctggaaatagtgaacagattcaggctgtcatagaagctggtcttattggcccccttctcaatctacttcaaaatgctgagtttgatataaagaaagaggctgcttgggcaatatcaaatgctacatctggcggttcccatgaccaaatcaagtatatagtgagtcaaggatgtatcaagccactatgtgatctgcttgtgtgccctgatccaaggattgtaactgtttgcttagaagctctagagaatattctgaagattgggcaagcagagaaggaatgcggcaatactggggataatgtctatgcccggatgatagatgatgccgaggggctggagaagattgagaatcttcagagtcatgacaacaatgagatctacgagaaggcagtgaagattctcgagacatattgggtggaggaggaggatgagatagtacccccaggtgataatacacaaccgggcttcaacttcggaggcaacggactacctccatctgatggattcaactttaattgaagggatttaacgttggggcaattgataatcacattgggggcgctattgaagtcagaacagcttgggatgtctggttgcactgtcagtcagtttggagtctgttgaggtcaaaggggtgtctgagcacgtctatctgagctacgttgtcccaaacaagcagggtatggacttgaccttcatgccctcgttcaatgatcgtgttgtcgagattttgagtgtctcaagaggttcattttttagggtggtcgcctgaatgtccatcatctatccattccgagtcagtttaccattgctagtcttttctagatttgagaagtttttggctggtcgttgcacctttgttgaacgcaaacatctgaaagcctcattcctgatgtactacagttagaaaggcaaatccatgagtttttgtatttcagccttatcacatgcattctatgtcaactgcagtcactttaatatgaaagaagagta

SEQ ID NO: 4979 - DNA, 2099 bp, Ambrosia trifida
ccctctcaataataacaatcacttcaaccccttctctctttctctctctctctacacacacacactttcaattgttctgcacacaaacataatctctatactgattaatcttcagtcgatctgtataaatctataaccaaatcatgtctctaagaccaaacgcaagaaccgaggttcgccgtaaccgttacaaggtcgccgtcgatgccgacgaaggcagacgccggagagaagataatatggtcgagatccgtaagaataagcgagaggagaacctgcttaagaagcgtcaagttcttccgtctgctcagcccttgttatccaccggtgctcctgtacctagttccaccatcgagaaaaagttagagagccttccttctatggttgctggagtctattcaaatgataacaacatgcagcttgaggcaactacccagtttcgtaaattgctctcaatagaacgaagcccaccaattgaggaagttatacagtctggtgtggtacctcgctttgtcgagttcttgatgagagaggattatccacagcttcagtttgaagctgcttgggcactcacaaacatcgcttctggaacttctgagaatacaaaggttgtaattgatcatggggctgtcccaatttttgtgaagcttcttggttctcaaagtgatgacgtccgtgagcaggctgtttgggcgctgggaaatgtagctggtgattcacccaggtgtcgggaccttgttcttggttcaggtgctttgcgtccattgctacatcagttaaatgaacatgctaagctttctatgctgagaaacgccacatggaccctatcaaatttctgtcgggggaaaccacaacctccttttgaggagacaaaaccagcactacctgcccttgaacgccttgttcattctaacgacgaagaggtgttgactgatgcatgctgggctctctcctatttgtccgatggaacaaatgacaaaattcaagctgtcattgaggctggtgtctgcagacgccttgttgagctcctcttgcacccgtctccttcagtactcattcctgcacttcgaaccgttggcaacattgtgactggtgatgatctccaaactcagtgtatcattgagcatggtgcactaccgtgcctgctgagcttgttgaccaataaccacaaaaagaagcatcaagaaagaagcctgctggacaatctcaaacatcactgctggaaacaaagaacaaatccaggctgtaatcgaagctgggttaatcgctcccctagtccatctcctccagactgctgagtttgatataaagaaagaagctgcatgggcgatatcaaacgccacttctggtggcactaatgaacagatcaagtatttggtgaatcaaggttgtatcaagccgttgtgtgatctccttgtatgtccggatccaagaattgtgacagtgagtttagaagggcttgagaacatcttaaaggtgggagaagctgagaaaaacttgggtaacactggagatgttaatttctacgcccagttgatagacgacgcagaaggcttagaaaagatcgagaacttacagtctcatgacaataatgaaatctatgaaaaagctgttaagattctcgagacttattggttggaagaagaagaggagccggtggttgatggttcgcagcctggtttcaactttggcggcccaaatgctcaagttccacctggtggattcaactttaatggctgaaggtaatcatcacaaaggtatgtttggttgggtcaaagttcaagtctggtcaaaggtcaggtcaggtgtagtcgggtcatggtcaggtgagtcagtcaaggtcatataaaatcgtggtccaggtaacaataaaggaacggggtggttgtttggttttctttacctcgagtcgttgaatgttttggaacaatggtcgaggcagatatgaacgaaagtcgtcatgtatgggtattttgttttggtattaaggggggtgagtgtatattcatatggtgtcgaatctatattccatatttgtaatgttaaattttatgttttccccatttgtcatgggatgatgtcattgattttttatggtc

SEQ ID NO: 4980 - DNA, 2458 bp, Arachis hypogaea
gtgaatggcacggacaactagccactacgctgtctacgcttgtgcatcctagacacaagttatacttgtccagttgttctcctttccaaacacacccagtctgctcccgcttcctgccatttcttcaatagcaaaaaccctatttttcaagacttccaacttccaatagcttaaggcttaaacccaaaatctcttcgattctatttatctactctccaagaaaccctactaatcagttcactcttctcttgattgttcccaaacgatgtcgtatcgcccaaccggaaactcaaggaccgatgtccgccggagccgctacaaggtggctgtcgacgccgaggagggtcgccggcggcgagaagacaccatggtggagatcaggaagaaccgaagggaagagagcttacagaagaagcggcgcgagggtctccaagcacagcagattcccgcttcggcacaatccactgtaactagagaagaagttggaacacctacctacgatggttgcaggtgttatctgatgataatagccttcagctggaagcaactactcagttccggaagttgctttcgattgagcgctgtccgccgattgaggaggttatacaggctggtgtcgtttctcgctttgttgaatttctttcgagggatgatttcccccagttgcagttcgaggcagcttgggctttgacaaatatagcttctggaacatctgaaaacaccaaggtggtaattgatcatggggctgtccccatttttgtaaggctccttgcttcacccagtgacgatgtccgtgaacaggcagtgtgggcattaggaaatgttgctggggattctcccagatgccgtgatcttgtactcagtcatggtgctctgcttcctctgttggcgcaattgaatgaacatgccaaactttccatgcttaggaatgctacctggacactttcaaacttctgcaggggcaagccacagcctccttttgatcaggttaaacctgcacttcctgcccttgctagtcttatccattcaaatgatgaagaagtcttgacagatgcttgttgggcactttcatatctttctgatggtacaaatgacaaaattcaagctgtaattgaagctggtgtctgtccccggctagttgagcttttaatgcacccatccccttcagttctaattcctgctcttcgtacagttggaaatattgtcactggagatgatatgcaaactcaggttatcatcaaccatcaagctcttccttgccttcttaatctgttgtctaataattataaaaaaagcatcaagaaggaagcttgttggaccatatcaaacatcacagctggtaataaacagcagattcaggctgtaattgagtctaatataattggtcatttggtcagcctgcttcaaaatgctgagtttgacatcaagaaagaggctgcttgggctatatcaaatgctacatctggtggatctcatgaacaaatcaagtacttggtaagccaagggtgtatcaagcccttgtgcgatcttctcatctgtcccgatcctagaattgtgacagtttgtctggaaggactggaaaacatcttgaaggtgggagaagctgataaaaatatgggcactattggtgatgtgaatctatatgcccaaatgattgacgatgcggagggtttggagaaaattgagaaccttcagagtcatgataacacagagatttatgaaaaggcagtgaagattcttgaaacatactggttggaggaagatgacgagactatgcctccaggggatggttcacaaccagggtttaactttggtggctctgatggtcctgctgtgccacccggtggattcaacttttaattagaagatattcatgctttttcttgggaattttggctggcttaaagtcgttcagtaccacaggacaacaattggggtaaagttaatgctgtcattgtgtgcatcctataaggtccatccttggtaaatagaggattgctggacccagctttggttttcgcactggctggttttacatatcacatggtgtcagatgagttgtggcatggttttttttgccactttagattgcacttacgggttcattctgccaagtaatcatcatcatagaattgatgttcagtcttgtggtctttcctttgtaatatgctaaatattatgtctgtccttcattatagttacaagaaaacattgaagtctttgttttccctgatgtttccccgaatgggcgttttttcgttatgtttttttgtgtctttctagtttggtttgagtagcagaaaaatagtttggtgctaccatttttttaattatcaactgtcaagtgtcaaaacatcatacatagtttcttatctcgtttgttggttctccaacaaaatacctccctatttaacggtctcaaagtggggttcattgattataccattcagcctaatta

SEQ ID NO: 4981 - DNA, 1765 bp, Fagus grandifolia
aaggtctcagactcacacacacagccctcctctccatctcatttcgaattataaaaaaatttcactcactttctcactcattcactccctctcaaatctcaatccaactctcccttctctctcactctcaccctctccgatttccgattctcacagcaaccaaaccatgtctcttagaccgaacgcgagaaccgaggttcgccggaaccggtacaaggtggccgtggacgccgaggaaggccgtcgtcgcagggaggacaatatggtcgagatccgaaagaaccgtcgtgaagagagcttgcaaaagaagcgtcgagaaggtcttctcgctcctcaaatgccttcaactcccacttccgaactcaagttagaaagtttacctgccatggttgccggtgtttgctctgaggacaggaacttgcagctcgaggcaaccactcaatttcgaaagctgctttcgattgagcgcagtcctccgattaacgaagttgtacagtccggtgttgttcctcgatttgttgagttccttgcgagggatgatttcccgcaacttcagtttgaggcagcttgggcgctaacgaatattgcttctgggacatcggaaaacactagggttgtaattgatcatggagctgtaccgatatttgtgaagcttttaggctctccagccgatgatgttcgtgaacaggctgtttgggcattaggaaatgttgctggtgactcgcctaaatgtcgtgatcttgtccttagtcatggggccttaatgccattgctggcgcagtttaatgaacatgcgaaactttctatgttgagaaacgcgacatggacattatcgaacttctgtaggggcaagccaccacctccatttgagcagacaaagcctgctatcccagctcttgagcgccttatacagtcaaatgatgaggaagtcctcaccgatgcttgctgggcactttcatatctttcagatggaaccaatgataaaatccaagctgtcattgaggcaggtgtctgcccccgacttgttgaactactgcttcatccatctccaacagtcatcattcctgcccttcgcacagttggaaatattgtcactggggatgatatgcaaactcagtgtatgataaatcatcaagctcttccttgccttctgaacctgttgacacataatcacaagaagagcatcaagaaggaagcttgctggaccatttcaaacatcacagctggaaatgtaaatcagatacagactgtaattgaggctgctatcattcccccccttgtccaactacttcaaaatgcagagtttgagatcaagaaagaagctgcttgggcaatttcaaatgctacatctggtggcacccatgaacaaatcaagtacttggtgagccaggggtgtattaagccattgtgtgatctcctaatttgtccagacccaagaattgtcacagtttgcttggaagggcttgagaacattctaaaggttggggaagctgagaagaatatgggtaacgcagatgcaaacttgtttgcccaattgattgatgatgctgagggaatagataagattgaaaatcttcagagtcatgacaacaatgaaatatatgagaaggcagtgaagattctggagacttattgggttgaggatgatgaggagccattgcccccaggcgatgctgccccatctagcttcaattttggaggaaatgaaccttctgttccttctggtggtatttaacttcagttgaaggacttcagtcggcattgg

SEQ ID NO: 4982 - DNA, 2131 bp, Vinca minor
atcccccactaagctttctctctctaaaaaacgcactccgggtttttgaattgattaactgtggaaaaagaagaagaaacagacttggaaagatgtcgttgagaccgagtgagaggacagaggttcgtcggaaccgatacaaggtgactgtggatgcagaggaaggaaggcggaggagagaggatcaaatggtggagatccgtaagaataagcgtgaggaaaaccttcttaagaagcgacgtgaaggtctccaaatgtcacaaccgtttccaaccaccactcctaccagtaatatcgagaaaaagttagagagtcttccttctatggttgctggggtttggtcaaatgatggtaatttgcagctggaggcaactactcagttccgtaaactgctctcaatagagcgaagtccccctatcgaggaagttatacaatctggagttgttcctcgctttgttgagtttcttatgagggaggatttccctcagcttcagttcgaggcagcttgggctcttacaaacattgcttctggaacctcggagaatactaaggtagtgattgatcatggagctgtgccgatatttgtacagcttctgcagtctccgagtgatgacgttcgtgagcaggctgtatgggctttagggaatgtcgctggtgattccccaaggtgccgtgaccttgtcctcagccatggagctttaattcctttgctttctcagttgaatgagcatgccaagctgtcaatgttgagaaacgccacttggaccttgtccaacttctgccgagggaaaccacaacctccatttgagcaggtgaggccagcacttccagcacttcaacgtcttgttcattcaaacgatgaagaagtgttaactgatgcatgctgggctctctcctacctatctgatggtacgaatgacaaaattcaagcagtgatagaggcaggtgtctgtcaccggcttgttgagcttctccttcatccatctcctaccgtgctcattcctgcacttcgcacagttggaaacattgtgacgggagacgatttccaaacccagagtatcattgaccagggagctctgacttgcttgctgagcctgttgactcataatcacaaaaagagcatcaagaaagaagcttgctggacaatttctaacatcaccgctggaaataaggagcagatacagactgtgatcgacgctcaactaattggccctcttgtcaatcttcttcaaactgctgaatttgatataaagaaagaggctgcctgggctctttcaaatgctacttctggtggaactcatgatcaaattaagtacttggtttctcagggctgtataaagcctttgtgcgatcttcttgtatgccctgatccgaggattgttactgtatgtttagaggggcttgaaaatatattgaaggttggggaagttgagaagaacctcggaaacactggagatgtcaattactacgcccaattaattgatgaagctgagggcttagaaaagattgagaacttgcagagtcatgacaacaatgaaatttacgaaaaggcagttaaaatactggagacatattggttggaggaagaagatgttgtgttacctcctggtgatggagcccaaccaggatttaatttcggaggaaatgatgtccagcttccatctggaggattcaaatttggctgaaggactgtcagatggtggatgtatcctcagattggggtcacagtgtgttggcgtcaagtcactggtcaagtcagttcaggtcgggtcgggtcaagttcaaggtcaggcagttcaggtcagtcggagcacctcagagttgagttatggtatggttcagagtctgtcgtgtgaaagaggtgcaaatttccgagtattactatggggaataagagaaagaatagagttgtatgattttgctatttgtctatgctatcggtcttatttgtctaatatgcgtttaattcctattttggttgtcttgagaggatgctggaaatttatcctcccaaaacgcgatccagataaaattgcctggagaatattactcgatccgttgacaggaaactgctgtttacttacttgaaggataattatgttgggtggggttttagttgtagagcttatat

SEQ ID NO: 4983 - DNA, 2449 bp, Malus domestica
taatgaaaatacctgaaaaaccataagtaaccagcggttataaaatcccgaaaagaaaaaaaaaaaaaaattcaaacacccgattggggcctatagaaacccttctctctcttcctcagtccctctctctctttcgaatactcagagaagtccaatttctagggttttctgttgctctccttctccgtctccaacccattgggatcacgatcaatctcccttagacgtactcaaatcgtacgacatgtcgctgaggccgagcgcgaggaccgaggtccgccggaaccgctacaaggtggcggtggacgccgatgagggtcgtcgcaggagagaggacaacatggtggagatccggaagagcaagcgcgaagagagcttgctgaagaagcgtcgcgaaggcctccaagcccaacaattcgcgccatctctccaggcatcaaatctcgagaagaagttagagagtctacctgccatggttgctggggtttggtctgacgacaacagtttgcagctggagtccactactcagttccgaaaactgctttcgattgaacgaagccctccgattgaggaagttatccaatcaggagttgttccccgctttgtggcattcctcatgagggaggattttccgcaacttcagttcgaggctgcttgggctcttacaaacatagcgtcaggaacctcagagaacaccaaggtggtgattgagcagggggcagtcccaatctttgtaaagcttcttgcttctccgagtgatgatgttagggagcaggctgtgtgggcattgggaaatgttgctggtgattcccctagatgtcgtgatcttgtcctcagcagtggagccttgatgccgttgcttgctcagttgaatgagcatgcaaagctttcaatgctgagaaatgcaacatggacactgtctaacttttgcaggggcaagccacagcctccatttgaccaggtgaagccagcacttccagctcttgaacgtttagttcattccaatgatgaagaagtcttgacagatgcctgctgggcactctcgtatctctcggatggcacgaatgacaaaatccaagctgtgattgaggcaggtgtctgtgtccgacttgtgcagctcctcttacatccatctccttctgttctcattcctgcacttcgcactgttggtaatattgtgaccggagatgatcttcagactcagtgtatcatcaacaatggttcactcccatgccttctgagcctgctgactcataatcataaaaagagcatcaagaaagaagcttgctggacaatctcaaacattacagctggaaacagggatcaaatacagtctgtaattgaagctggtttgattggtcctctggtcaacttactccaacatgctgagtttgacataaagaaagaagctgcatgggcaatctcaaatgctacttctggtggcactcctgatcaaatcaagtacctggttggcgaaggctgtataaaaccattgtgtgatcttcttgtatgccccgatccaaggattgtcactgtctgtttagaggggttggagaacattctgaaggttggggaagctgaaaaagctgcgggtaacagtgaagttaatttgtatgcccagctggttgatgatgctgagggtctagaaaagattgaaaatctacagagtcacgacaacactgagatctatgagaagtctgtaaaaattctggagacatattggttggaggaagatgaagagacattaccagcaggagacggatcccagccaggcttccgctttggagggagtgaggttcaggttccatctggtggattcaactttagctgaaggagcttgtgattgaatggagcagaagtttctgatgagggtcaagtttggggtcaagttgaggtcaagttggagtgggtcgggggcatcttgtgtgtctggtttcagtctggtccggtgtccattgtcgtcagagatgccaaggtgggtcagtttattctactatgaccgaataagaagagatgggtgggttcagttgtggcacatgaagtttggtcggcaggggtcatgatcgctgcctcttaccatgaaatactatgggaagtgtcgtagaggctcgttgctgcatgaacagggcccttgaaggaatgtgctggtgagggttttcttgaatgcagcatcgagttttataatttggagtcaatagtttgtacgagtaaatttagtttttctgaagagtcggggatttgttttgccttgtcaagtgaatatagagttgatgaagtcattttctggtgtattgcaaggaaaatgattagtggtgttttagtaatatgaccttgtgattgttgtattatatttttctccatatttccaatttttacacctggagcctagtttaaagtttcacctctgagttttttactccgtatttgtctcacttggttttgtttaatc

SEQ ID NO: 4984 - DNA, 2445 bp, Quercus alba
ctatccatctataaaatcatgtcatgtcactcacagagccctcctctccatctcatttcgaattagtctaaacagaacagaacaaacaaaaaaaaaatcactatctcacagtctcactcattcactcacggtcacacacacactttaccctcaaatctcaatctcactctctctctcaccgactcttcgatcttcgattcccacgccgaccaaaaaaccatgtctcttagaccgaacgccaggaccgaggtgcggcggaaccgctacaaggtggcggtggacgccgaggaaggccgccgtcgtagggaggacaacatggtcgagatccgtaagaaccgtcgtgaagagagcttgcagaagaagcgtcgtgaaggccttgttgctcctcaaatgccttcgactccaacttctgaaaagaagttagaaagtctacctgccatggttggtggcgtttgttccgatgacatgaacttgcagcttgaggcaaccactcagttccgaaagctgctttcgattgagcgcagtcctccgattaatgaagttgtacaatccggtgttgttcctcgctttgttgagttccttgcgagggatgagttcccgcaacttcagtttgaggcagcttgggccctaacaaatattgcttctgggacatcggaaaacaccagggttgtaattgatcatggagccatcccgatatttgtcaaacttttaggctctccagctgatgatgttcgcgaacaggctgtttgggcattaggaaatgttgccggtgactcacctaaatgccgtgatcttgtccttagtcatggggccttattgccgttgctggcacagtttaatgaacatgcaaaactttctatgttgagaaatgcgacatggacattatcaaacttctgtaggggcaagccaccacctccatttgagcagacaaagcctgcaatcccagctcttgagcgtcttatacagtcaaatgatgaggaagtcctcactgatgcatgctgggcactatcatatctttcagatggtaccaatgataaaatccaagctgtcattgatgcgggtgtttgtcccagacttgttgaacttctactgcatccatctccaacggtcctcattcctgcccttcgcacagttggaaatattgtcacaggggatgatatgcaaactcagtgtatgataaatcatcaagctcttccttgcctcctgaacctgttgacacataatcataagaagagcatcaagaaggaagcttgctggaccatttcaaacatcacagctggaaatgtaaatcagatacaggctgtaattgaggctggtatcattccaccccttgtccaactacttcaaattgcagagtttgagatcaagaaagaagctgcttgggcaatttcaaatgctacttctggtggcacccatgatcaaatcaagtacttggtaagccaggggtgtattaagccattgtgtgatctcctaatttgtccagacccaagaattgtcacagtttgcttggaagggcttgagaacattctaaaggttggggaagctgagaaaaatatgggcaagacagatgtaaacttgaatgcccaattgattgatgatgctgaggggatagataagattgaaaatcttcagagtcatgacaacaatgagatatatgaaaaggcagtgaagattttagagacatattgggttgaggatgatgatgagccattgcccccaggtgatgctcctcaatctagcttcaattttggaggaaatgaagttcctgttccttctggtggatagttgaaggacttccggttggcagtggaatgaagtttggagtctaggtttgtgacattgaatatttttcaacttctggtggctaggatatctacttaccctttggtcctgttatgttcgcgagtctggtgtagttgaagagatcgcagaagtatgtttgctctcttacagtggtccaataaaagggggtgtgtgtgataccatgaattaggttagattgtgaaaattgtggaagtactagcaatcgccagagaaaaccacccgaacaatgtagcaacccctgcctccatttaatttcttttcctttgctggttactaaaatggaagggcaaggcctgtttggtttttccgctttatagctcagagcgatataagaaaaagatactttatgttttttatttatttatttttattttcaagtgaaggtcctgtttttatttatcaaaaagaaaaagaaagtgaaggtcctgttttgatggtaataggggatctcaagattttgtcattttagtaagaaaggtttctgttctggataccatgtgtttggtgatgaaagattttttgttggttgtattaatgtcaaaaaagtcaaggattaatgaagtttatgtctggttatttctttagcgaaactctactattggttcctaaaagtttaaactt

SEQ ID NO: 4985 - DNA, 2607 bp, Citrus sinensis
ctcattttccctcccttgctttttctcagccttgactctcactccaaatccctaattttcaatttaatcacaagttagggttttttttccgaagccaaaacgatgtcgctgaggccgaacgccagagccgaggttcgtcgaaaccgttacaaggttgccgtcgacgccgatgaaggtcgacgacggagagaagataacatggtggagatcagaaagaataagcgcgaagaaagcttgctcaagaagcgacgcgaaggtctccaatctcagcaatttcctcctcctgctcctgcatccaatctgaatctccaaactaagttggaaagtttgcccgccatggttgctggggtttggtcagacgacagtagcttgcagctggaagcaactactcagtttcgaaaactgctttcaatcgagaggagtccaccaattgaggaagtcatacaatctggtgttgttccgcgttttgttgagtttcttatgagggaagactatccgcaacttcagtttgaggctgcctgggctcttacaaacattgcttctggaacttcagagaacactaaggtggtgattgaccatggtgctgttccaatatttgtgaagttacttgcttctccaagtgatgatgttcgtgagcaggctgtttgggcattgggaaatgtcgctggtgactctcctagatgccgtgatcttgtgctcagccaaggagctttgattccattgctggcacagttaaatgagcgtgctaagctttcaatgctaagaaatgccacatggactttgtctaatttctgcagggggaagccccagccaccatttgaccaggtgagaccagctcttccagctcttgcacagcttgttcattcaaatgatgaagaggtcttgactgatgcctgctgggcactctcctatctttctgatggaacgaatgacaaaattcaagctgtgattgaggcaggtgtttgtccacgacttgttgagctccttggtcatccatcaccctcagtgctcattcctgcccttcgtacagttggaaatattgtgacgggagatgatttccagactcagtgtataattacctatggtgcactgccctaccttttgggcctgttgacccatagtcataaaaagagcatcaagaaggaggcctgctggactatttcaaatattacagctgggaacagggaccagattcaggcggtaattgatgctggcttagttggtccccttgtcaatctgcttcaaaatgctgaatttgatataaagaaggaggctgcttgggcaatttcaaatgccacctcgggtggtactcatgagcaaatcaagtacctggtgagagaagggtgtataaaacctttgtgtgatctctttgtatgccctgatccacggattgtcactgtttgcttagaaggattagagaacattttgaaggtcggggaagctgaaaagaatatgggtactgccactgcagatgttaatcaatatgcccagttggttgaggaggctgaggggttagaaaagattgaaaatctacaaagtcatgacaacaatgagatctatgagaaggcagtaaaaattcttgagacatactggttggaagaggacgatgagacaatagctgcaggtgatggtcctcagccaggtttcccatatgcagggaatgaggttcaagttccgtctggtggattcaatttcagttgaaaatcaattggctcgttttctggtgggagggatacatagtttgtcggatggagcagaagtttgtgttggggtgggtttgaatgttgacgacgtatgtcggggtcaagttgggtcgggtcagggcgcctttgcatgtctggttacaggtttggtccagtgtctattgtggttgaaaaggtgccaactaaggtcggtctatacttacagagtccaataaagtgaggctggatggattaactacaatatgatggcatgtgtttttgccttggaaatgcttcaagaggaatgcaagaagtgtatgtccagggactgatctgaagtggtcgtggtggttgtggtggtcgttgtagtcggggcattgtcgagtctacaatttgtcccatgagtcgtgtgtgtaaccatagtctctctacggcttggcatatttgtttcattgtggtgggtgaataactgaaaatgtagagtaccaaaaacctcttgtttgtgtgtattacgagtaattagcagtatctttcttaaatgtgcgaaatcctcatgttcttactttcatctctacaatcatgtttttgcaagcgcatgtgtgagcctgagctgaataatcagaattaggctcatttgactaaagggggaacatggctgaattgagctggagtttgcattagtggagtttatgggctggactaaaatgtgaactgttccgcatgtgggaagattttgctgccgcaaatcgccgctgttttagtagcaggcgtgtttacaatacaaccggtgtctttacattctcctttgaaaatctcaaattctgaactgttgggagtcaaaagaccaaaaatttcttggtgtgagtgatgaattttcaatggaaaatgtgtttgtgactgtcagcggttcaagtgttgttatttt

SEQ ID NO: 4986 - DNA, 2102 bp, Solanum lycopersicum
ccctttcaaatcaaaatccaaaccctccgccatactcctctttagatatctacacactcatttgctctttctctctagggtctatacttctattcatccacgatgtcgttgaggccgaacgccagaaccgaggttcgccggaaccgttacaaagttgccgttgatgccgaggaaggtcgccggagaagagaggacaatatggttgagattcgtaagaataagagagaggagaacttgcagaagaagcgacgtgaaggccttcaagctaatcagcaattttctgttcctgttcagtccactgtcgaaaagaagctcgagaatttaccagcaatggttgccggtgtttggactgaagatggcaatcttcagcttgaagctactactcagtttcgaaaactgctttccatagaaaggagtcccccaattgaggaggtaattcaagcaggtgttgttcctcggtttgttcaatttcttataagggatgactttccacaacttcagtttgaggcagcatgggctctcacaaatattgcttcggggacatctgaacataccaaggtggtgattgaatctggtgcagtcccaatttttgtgaaacttcttagttctccaagtgatgatgtgcgtgagcaggctgtttgggctcttggaaatgttgctggtgattccccaaaatgccgtgatcttgtccttaactgtggagctttgcttcccttgctgtctcagctgaatccaaatgccaagctctctatgttgagaaatgcaacctggacactttcaaatttctgcagaggcaaaccacagcctgcttttgatcagacgaagcctgcacttccagctcttcaacaactaattcattcaaccgatgaagaagttttgactgatgcttgctgggcactttcatatctctctgatggtacaaatgataaaattcaagctgttattgattctggagtatgcccacgattagtcgagttattacttcacccatctccatcggttttgattcctgctcttcggactgttgggaatattgtgacaggagatgatatgcaaactcagtgtatcatcggccatcaggctttgccctgtcttttgaacttgttgagtggtagtcacaagaagagtattaagaaggaagcttgctggacaatttctaacatcacggctggcaaccgggagcaaattcagtgtgtggttgacgctggtattataggtccccttgttaatttgctacaaaatgcggagtttgaaataaaaaaggaggctgcatgggcaatttcaaatgccacatctggtggttcacatgagcagatcaagtaccttgttagtcaaggttgtatcaagccattgtgtgatcttctcatttgtcctgacccaaggattgtcacagtttgtcttgaagggcttgaaaatattttgaaggttggggaagctgagaagagtttgggccggacatcagatataaatctttatgctcagctgattgatgacgctgaaggtttagaaaaaattgagaatcttcaaagccatgacaatcaagagatctatgaaaaggcagttaagattcttgagacgtactggttggaagaagatgacgagaccatgccacctggtgatgcagcccaacaaggttttcagtttggaggtggtgaggtttctgtgccctctggaggattcagctttaactaaagattctcctggtgatggatcatgcagtatatgtagaaggaaaatctgggtcaatttgagagttgtaaaagttgcaaggttgactttttgggggatggtgggaagtagtgccagtgaaaatggtacttggtcttttcacttgtttcagttagcctgaattgtgaatttgctcgggagatttttagttctattttattcccgctttgctttggctggttgtagtttgttattgattgtttcatttctaaattttgacagtccttggaaccgacttaaaatgatgaccaaagcaattcaccctgtcttggtattgaaatatttgatgtcttgaatctttggtgattttttcctcgtcacttgaaaatgataccatcctgctctataataattttggtgaaaattttgttgta

SEQ ID NO: 4987 - DNA, 2072 bp, Solanum lycopersicum
ccctttcaaatcaaaatccaaaccctccgccatactcctctttagatatctacacactcatttgctctttctctctagggtctatacttctattcatccacgatgtcgttgaggccgaacgccagaaccgaggttcgccggaaccgttacaaagttgccgttgatgccgaggaaggtcgccggagaagagaggacaatatggttgagattcgtaagaataagagagaggagaacttgcagaagaagcgacgtgaaggccttcaagctaatcagcaattttctgttcctgttcagtccactgtcgaaaagaagctcgagaatttaccagcaatggttgccggtgtttggactgaagatggcaatcttcagcttgaagctactactcagtttcgaaaactgctttccatagaaaggagtcccccaattgaggaggtaattcaagcaggtgttgttcctcggtttgttcaatttcttataagggatgactttccacaacttcagtttgaggcagcatgggctctcacaaatattgcttcggggacatctgaacataccaaggtggtgattgaatctggtgcagtcccaatttttgtgaaacttcttagttctccaagtgatgatgtgcgtgagcaggctgtttgggctcttggaaatgttgctggtgattccccaaaatgccgtgatcttgtccttaactgtggagctttgcttcccttgctgtctcagctgaatccaaatgccaagctctctatgttgagaaatgcaacctggacactttcaaatttctgcagaggcaaaccacagcctgcttttgatcagacgaagcctgcacttccagctcttcaacaactaattcattcaaccgatgaagaagttttgactgatgcttgctgggcactttcatatctctctgatggtacaaatgataaaattcaagctgttattgattctggagtatgcccacgattagtcgagttattacttcacccatctccatcggttttgattcctgctcttcggactgttgggaatattgtgacaggagatgatatgcaaactcagtgtatcatcggccatcaggctttgccctgtcttttgaacttgttgagtggtagtcacaagaagagtattaagaaggaagcttgctggacaatttctaacatcacggctggcaaccgggagcaaattcagtgtgtggttgacgctggtattataggtccccttgttaatttgctacaaaatgcggagtttgaaataaaaaaggaggctgcatgggcaatttcaaatgccacatctggtggttcacatgagcagatcaagtaccttgttagtcaaggttgtatcaagccattgtgtgatcttctcatttgtcctgacccaaggattgtcacagtttgtcttgaagggcttgaaaatattttgaaggttggggaagctgagaagagtttgggccggacatcagatataaatctttatgctcagctgattgatgacgctgaaggtttagaaaaaattgagaatcttcaaagccatgacaatcaagagatctatgaaaaggcagttaagattcttgagacgtactggttggaagaagatgacgagaccatgccacctggtgatgcagcccaacaaggttttcagtttggaggtggtgaggtttctgtgccctctggaggattcagctttaactaaagattctcctggtgatggataatgcagtatatgtagaaggaaaatctgggtcaatttgagagttgtaaaagttgcaaggttgactttttgggggatggtgggaagtagtgccagtgaaaatggtacttggtcttttcacttgtttcagttagcctgaattgtgaatttgctcgggagatttttagttctattttattcccgctttgctttggctggttgtagtttgttattgattgtttcatttctaaattttgacagtccttggaaccgacttaaaatgatgaccaaagcaattcaccctgtcttggtattgaaatatttgatgtgattttttcctcgtcacttgaaaatgataccatcctgctctataataattttgg

SEQ ID NO: 4988 - DNA, 2309 bp, Medicago truncatula
ccctgcaatataaacccctttccttcattcctctcttttcaaaccctcactcctttctgcttcgctctttcccttcgattttctctctgaaactgaaactttttcgattctgttccgttcgataaaccgattgtaaaacgatgtcttatcgtcctaacgcaaacgcgagaaccgaggttcgtcggaatcgatacaaggtggcggttgatgcggaagaaggtcggagacggagagaggataacttggttgagatccggaagaatcggcgagaagaaagcttgcagaagaagaggcgtgaaggacttcaacctcagcagatgcctgcatcagttcaatctaatctactcgagaaaaagttggaacacctaccagccttggttacaggaatctggactgatgataataacatgcagtttgaggcaacaactcagtttcggaagttgctttcaattgaacgtagcccaccaattgaggaggttatacaagctggtgtagttcctcgctttattgagttcttgatgagggaagattttccacagctgcagtttgaggcagcatgggctttgacaaatatagcttctggaacatctgaaaacactaaggtagtaattgaggcaggtgctgtaccaatatttgtgaagctccttgcttctcctagtgatgatgtccgtgaacaggccgtgtgggcattgggaaatgttgctggagattcgcctagatgccgtgatcttgttctcggtcatggagctttgcttcctctgttggcgcaattgaatgagcatgctaaactttctatgcttagaaatgccacatggacactctcaaacttctgcaggggaaagccacaacctgcttttgatcaggttaaacctgcacttcctgcacttgccagtctcattcattcaaatgatgaagaagtcttgactgatgcctgttgggcactttcatatctttctgatggtgcaaatgacaaaattcaaggcgtaattgaagctggtgtctgtagccggcttgttgagcttctactccacccatctccttctgtgcttattcctgctctacgcacagttggaaatattgtcactggagatgacttgcagacacaggtcatcatcaaccatcaagttcttcctcctcttacgaatctcttgattaatagttataaaaaaagcatcaagaaggaagcttgctggacaatatcgaacatcacagctgggaacaagcaacagattcaggatgtgatcgatgccaatataattgctcctttggtcaacttgcttcaaaatgctgagtttgatatcaagaaggaagctgcctgggccatctcaaatgctacatcgggtggatctcatgaacaactcaagtacctggtaagtcaagggtgcattaagcccttgtgtgatctactcacatgtcctgatcctaggattgtgacagtttgtcttgaagggcttgaaaacatcttaaaggtaggggaagctgataaaaatgccggcatcactgatggtgttaatcggtatgctgaattgattgacgaagctgagggtttggagaaaattgagaacctccagagtcatgacaacaatgagatttatgaaaaggctgtgaagattctcgagacatactggttggaggaagacgatgaggctatgcctccaggtgatgcttctcaatcagggttcaactttggtggctccgaagttcctgccgtgccttctggtggattcaactttaactagatggttttttggctggtccatcagtgaggttctccagtatggcagttcaacagttgggggggtcaagtcagtgtcgtttcattgttcttaggttctataaggttcagccttggtaaataggccgttactggactggcttgggtttttgaaatggctggttttacatacaacaggggaacagttgggttgtggcttgcttttcttgccacttccgagttaaatattagagtttgcttttggcctagtgatcatttcaagtgatttggctcttctatagaattttatgttaagtttcgttatttttcctgctaagattggagtcagcgtaccacttatgattctaggtattttgggaaataccaaatgatactattctttcatcattaaaattgcaaggaactttgaagtttttttttaccctgtcctgtttttatttttaccgaagtttacctcaattttattattcattaggatctctattcaatatgtacaattatggtttttgggaaaatgacttgccaaaaatagtgtgcaacaattttttttattcataattgattattggctcaa

SEQ ID NO: 4989 - DNA, 2344 bp, Medicago truncatula
ccaagtccactttcatacccaattccactttttaaccctgcaatataaacccctttccttcattcctctcttttcaaaccctcactcctttctgcttcgctctttcccttcgattttctctctgaaactgaaactttttcgattctgttccgttcgataaaccgattgtaaaacgatgtcttatcgtcctaacgcaaacgcgagaaccgaggttcgtcggaatcgatacaaggtggcggttgatgcggaagaaggtcggagacggagagaggataacttggttgagatccggaagaatcggcgagaagaaagcttgcagaagaagaggcgtgaaggacttcaacctcagcagatgcctgcatcagttcaatctaatctactcgagaaaaagttggaacacctaccagccttggttacaggaatctggactgatgataataacatgcagtttgaggcaacaactcagtttcggaagttgctttcaattgaacgtagcccaccaattgaggaggttatacaagctggtgtagttcctcgctttattgagttcttgatgagggaagattttccacagctgcagtttgaggcagcatgggctttgacaaatatagcttctggaacatctgaaaacactaaggtagtaattgaggcaggtgctgtaccaatatttgtgaagctccttgcttctcctagtgatgatgtccgtgaacaggccgtgtgggcattgggaaatgttgctggagattcgcctagatgccgtgatcttgttctcggtcatggagctttgcttcctctgttggcgcaattgaatgagcatgctaaactttctatgcttagaaatgccacatggacactctcaaacttctgcaggggaaagccacaacctgcttttgatcaggttaaacctgcacttcctgcacttgccagtctcattcattcaaatgatgaagaagtcttgactgatgcctgttgggcactttcatatctttctgatggtgcaaatgacaaaattcaaggcgtaattgaagctggtgtctgtagccggcttgttgagcttctactccacccatctccttctgtgcttattcctgctctacgcacagttggaaatattgtcactggagatgacttgcagacacaggtcatcatcaaccatcaagttcttcctcctcttacgaatctcttgattaatagttataaaaaaagcatcaagaaggaagcttgctggacaatatcgaacatcacagctgggaacaagcaacagattcaggatgtgatcgatgccaatataattgctcctttggtcaacttgcttcaaaatgctgagtttgatatcaagaaggaagctgcctgggccatctcaaatgctacatcgggtggatctcatgaacaactcaagtacctggtaagtcaagggtgcattaagcccttgtgtgatctactcacatgtcctgatcctaggattgtgacagtttgtcttgaagggcttgaaaacatcttaaaggtaggggaagctgataaaaatgccggcatcactgatggtgttaatcggtatgctgaattgattgacgaagctgagggtttggagaaaattgagaacctccagagtcatgacaacaatgagatttatgaaaaggctgtgaagattctcgagacatactggttggaggaagacgatgaggctatgcctccaggtgatgcttctcaatcagggttcaactttggtggctccgaagttcctgccgtgccttctggtggattcaactttaactagatggttttttggctggtccatcagtgaggttctccagtatggcagttcaacagttgggggggtcaagtcagtgtcgtttcattgttcttaggttctataaggttcagccttggtaaataggccgttactggactggcttgggtttttgaaatggctggttttacatacaacaggggaacagttgggttgtggcttgcttttcttgccacttccgagttaaatattagagtttgcttttggcctagtgatcatttcaagtgatttggctcttctatagaattttatgttaagtttcgttatttttcctgctaagattggagtcagcgtaccacttatgattctaggtattttgggaaataccaaatgatactattctttcatcattaaaattgcaaggaactttgaagtttttttttaccctgtcctgtttttatttttaccgaagtttacctcaattttattattcattaggatctctattcaatatgtacaattatggtttttgggaaaatgacttgccaaaaatagtgtgcaacaattttttttattcataattgattattggctcaa

SEQ ID NO: 4990 - DNA, 1803 bp, Valeriana officinalis
taatagaaagaagaagccatgtcgttgaggccgaacgcaaggtcagagattcgtcggagcaaatataaggttgccgtcgatgccgaggaaggtcgcagaagaagggaggaccatatggttgagatccggaagaacaagcgtgaggagagtctcattaaaaagcgttgcgaaggtcttcaacctcagcaattcccagcctctcttcacgccaccactgttgagaaaaagttggagagtcttccttccatggttgctggcgtctggtcaactgaaaacaatctgcagctggagtcaactacacagtttcgtaaattgctttctatagagcgaagcccgccgatagaggaagttattcaatctggtgttgtccctcgctttgttgagtttctcatgagggaagattttcctcaactccagtttgaggctgcttgggctttgacaaacattgcttctggaacctcagagaataccaaagtggtaattgatcatggagctgtcccaatctttgtcaagcttctgggtctcctagtgacgatgttcgcgagcaggctgtgtgggcattgggaaatgttgctggtgactcgcctagatgtcgcgatctggttcttagcagtggagctttggttcccctacttgcacaacttaatgagcatgcaaaactttcaatgctgagaaatgccacatggaccttatccaatttctgcaggggaaagccacagccaccttttgagcagacaaggccagcacttccggctcttcaacagcttgttcactcaaatgatgaggaggtgttaactgatgcttgctgggctctgtcgtatctttctgatggtactaacgacaaaattcaagctgttattgaggcaggtgtttgtccacgtcttgttgagcttctcatgcatcagtctccttctgttcttatacctgcacttcgaactgttggaaatattgtgactggagatgattaccagacgcaggctataattaactatggtgctcttccatgcctgctgaacctcttgaccaataatcataaaaagagcatcaaaaaagaagcttgttggaccatctccaacattactgctggaaacaaggaacagattcagtctgtaattgaagctgagttaatatcacccctggtgactctgctacaaactgctgagtttgatatcaagaaagaggctgcttgggcaatttccaatgccacttctggtggtactcatgatcaaatcaagtacttggtgagtcaggggtgtataaagccattgtgcgatctgctagtctgcccagatccaaggatcgtgacagtttgcttagaagggttagagaacatactgaaggttggtgaatcagagaagaacctgggtaacactggagatgttaatgtatatgcgcagctaatagacgatgctgagggtctagagaagatagaaaatttgcagagccacgataacaatgaaatctacgagaaggctgtgaagattctcgagacatactggcttgaggaagaagattcagtcatcaatcctggtgatggtcctcagcccgccttcaactttggtgctaacgatgtgcagcgtcccgatggtggcttcaactttagctgaaggatatatcgaggtggagaaggtttgaggatcaaaggaagcacggtatatgggtcgggtctggtcagggtcaggtcaagtctgctcaattgagagcgggtgaaagtgtgtccggttaaagtctggtccagtgtctgttttggtcgaagggtcgggatgtgccacagtcgatatattatcaaagtggggtacaagt

SEQ ID NO: 4991 - DNA, 2214 bp, Artemisia annua
ccccttattggagatcggcccgcccgcccgcccgtcttcttcttcacactcccaccacaccacactctttataaacacacacacacctgttgtgtcctcttgttcattttcaaccaccccttgcttgaacatcaatcaaacatgtctcttcgaccaaacgctcggacggaggtgcggcgtaaccgctacaaggtagccgtagatgcggacgaaggtaggcgaagaagagaggataacatggtggagattcgtaagaataaaagagaagagaatctgcagaagaagagacgtgaagctgttgctggtggtggtgctgctaatcagtttcccttgcactctaatcttcaatctgcttctactaatgaaaaaaagttagagaacctacctgcgatggttgcgggagtgtggtctaccgataacaatttgcaacttgaggcaaccactcagttccgcaagctgttgtcgatagagcgcagccctcctattgaagaagttattcaatcaggtgtcgttcctcgctttgttgagtttcttgtgagggaggattttcctcaactacagtttgaggcagcttgggctttgactaatattgcttcgggtacatctgaccacacaaaagtggtgattgaacataatgctgttccaatctttgtgaaacttcttgcatctcctagtgatgatgttcgggagcaggctgtatgggcattagggaatgttgctggtgattcacctaagtgccgtgatcttgtacttgggcaaggtgctttgatccctttactagcccagttgaatgagcacgcaaagttgtctatgttgcgaaacgccacatggacactttccaacttctgtagaggcaaaccacaaccttcgtttgatcagacaagacctgcactgccggctctacagcaacttattcattcaaacgatgaagaagtgttgactgatgcttgctgggcactctcgtatctttcagatggtacaaatgataaaatccaagctgtaattgaagcgaatgtatgccccagactagttgagttactaaatcatccttctccttcagtactcatccctgctcttcgcacggttggaaacatagttactggtgatgatatgcaaactcagtatatcatcaatcatcaagcactgccttgtcttttgaacctgttgagcaataatcaacaaaaaaagcattaagaaggaagcttgttggactatatcaaacatcactgctggcaacaaggagcagattcagacagtgatcgaagcaaatattattggacctctagttcatttgcttgggaatgcagaatttgacatcaagaaggaggctgcatgggctatttctaatgccacttctggtggaagccatgatcaaattaagtatcttgttaatcagggatgcattaaaccgctgtgtgacctacttatctgtccagaccctagaattgtgactgtttgtttggaggggcttgagaacatattgaaggttggtgaagctgagaagagtttgggaagatcaggagatgttaatctttatgcccaaatgatcgatgatgctgaaggattggagaaaatcgagaacctacagagtcacgataacaatgagatatatgagaaggcagtaaagcttctcgagacatattggttggaggaagaggatgatgcaatgccacctggtgagggcgcccagcctggtttcaattttggaggtggtgatgtttctgttcccaatggtggcttcaactttaaccaatagaagattttctcgaggttagttgggcatctgaggttttggttcagtattgtagtgtggttgaagtttatggaggggttcagttctcttacaatcgatagtggtgaagtgtttatgaattatgtaaaagcaatatgttatttctctatgcggaggcatttgacatttcaaattgggatttatagaattttcccttattttgttatttcgtttgttatctacttgggaattgccaattccttagatctgcctgttttctggtgtatgcttattaatctatggatgataatacaccatcattgtttctttttatggaaacgaattttgttcatcttcaggtttttgaggattctatttttaactgtcataagtggatcatgactttcttatggtgtatattcactcggaattgggattagtttccacttattagattgaagtcaggttctgatatccaaagc

SEQ ID NO: 4992 - DNA, 2168 bp, Artemisia annua
ctcttctctctctctctctctcatcagggtttcagtttgttaagtttagtgacgtcatcaacacgtaagaaaagcaacagatcatgtcgttgaggccgaacgcgaggacggaggttcgtaggaaccggtacaaagttgcggttgacgcggatgagggacggaggcgtagggaggataatatggttgagattaggaagaataagagggaggagaatttgttgaagaagagacaggtgttgtcgagttcgcaggcggttaatggtggtggtgtgccggctcagccgtctactgtcgagaaaaagttagagagtcttccttctatggtggctggagtatattccaatgaaaataatatgcagctggaggcaactactcagtttcgtaaattgctttctatagaacggagcccaccaattgaagaagttatacaagctggggttgtacctcgctttgtcgaatttttaatgagagaggatttcccacagcttcagtttgaggctgcttgggcactcacaaacattgcctcaggaacatctgacaatacaaaggtcgtaattgatcacggggcagtcccaatttttgttaagcttctagcttctccaagtgacgatgtgcgcgagcaggctgtttgggcattgggaaacgttgctggtgattctcctagatgccgtgatcttgtccttggacatggcgctttgattcccttactgtctcagttaaatgagcatgctaagctttctatgctgagaaacgcaacttggacgttatccaacttttgtcgaggaaaaccacaacctccatttgagcagacaaggccagctctgccagcccttgagcgacttgttcattcaaatgatgaagaagtgttgacagatgcatgctgggctctttcgtatctgtctgatggtaccaatgacaaaattcaggctgtgatcgatgctggtgtttgccaacgtcttgttgagctgcttctccacccatctccttcggtactcattcctgcccttagaactgttgggaacattgtgactggcgatgatctccaaactcagcatattatagagcgtggtgcacttccatgcctactgtccttgttgaccaataaccacaagaagagcattaaaaaagaagcatgctggacaatatcaaacatcactgctggaaacaaagaacaaatacagactgtgattgaggctgggttaattgctccgttggtcaatttgcttcagaatgctgaattcgatattaaaaaagaggctgcatgggcgatatcaaatgccacctctggtggtaccaatgagcaaatcaagtatttggtgagtcaagggtgtataaaaccattgtgtgatctcctaatatgccccgatccaaggattgtgaccgtctctctagaagggcttgagaacattcttaaggttggcgaagtggagaagaacataggaaacagcggtgaagttaatttctatgctcagttgattgatgatgccgaggggctggaaaagattgagaatttgcagtctcacgacaataatgaaatttatgagaaggctgttaagattcttgagacatattggttagaggaagaagatgaagcagcagtggttgatggtgctcaggctggtttcaactttggcggaaacaatgttcaagttccatctggtggattcaattttaacagctgaaggattttgggggcaagatgaagtacgttggtgggtcgaagtcaaagtccggtcaagtccggttgagtcgttgggtcaggtcaggtcgggtcaaagcatctcaagtagtatggtcaggtgacggtcttgtcttaaagagatgcaaaaggtgggtcagttggttccaacatacgaaagggttggccgaggtctttatttagtgagtcgtcgcctcaagcagttggaggatggttgtgtcattttaaatcaaattctaagaatatgttgtgagtctattttttcggtcatgtgtttgtatctttcattcttctaaacacagttgtcatagcattacttttgctagtgtaaacatttaaggaagaaagaagaatataatatttgtccatctgtttgtgaatttagtatgttttaattgtttaatactcaattgtctttatgttaaccctgcacattatttctgagtaaattgtggagtatttatggaaa

SEQ ID NO: 4993 - DNA, 2272 bp, Theobroma cacao
catttccctctcttcggcttttttgcttttaactactctgcaggacaatttctcaatccaaaactgtctagggtttttccttctctcgatccttcgtaaaactctcgattttcttcgagcattgtccttcctctagggtttcctgaagaacagcaaccgccatgtctttgagaccgagcaccagaaccgaggtccgccgtaacaggtacaaggtggcggtagacgcggaggaagggcgccgtagaagagaagacaacatggtggagatccggaaaagcaagcgcgaagagagtttacagaagaagcgccgagaaggcctccaagctcagcagttcgctgcttctatgcagtcctctaacgccgaaaagaaattggagagtcttccgtcgctggttgccggcgtttggtctgacaacggcacagcccagctggaggggactactcagttccgaaaattgctttcaattgagcggagtcccccaattgaggaagtgatacaatccggtgtcgttccacgctttgtcgagtttctcacgagggaagattttccacagcttcagtttgaggcagcttgggcacttacaaatattgcctctggaacctcggagaatacaaaggtagttattgatcacggggctgttcccatttttgtaaagcttcttggttcctcaagtgatgatgttcgcgagcaggccgtgtgggcattggggaatgttgctggtgattctcccaggtgtcgtgatcttgttctcagtcatggagctttgatgccgcttttagcacaattgaatgaacatgctaagctgtcaatgctgagaaatgccacttggacattatcaaatttctgcaggggcaagccacagcctccttttgatcaggtgaggccagctcttcctgcgcttgaacgtcttgttcattcaaatgatgaagaagttctgactgatacctgttgggctctctcatatctgtctgatggtacaaatgacaaaattcaagctgtgattgaggtgggagtttgcccacgactcgttgagctcttgcttaatccgtctccttcagtgctgatccctgctctccgtacagttggaaatattgtgacaggagatgatttacagactcagtgtattattgaccatggtgcattagcatgccttctgagcctgttgacccataatcataaaaagagcataaaaaaagaagcttgctggactatctcaaacattacagctggaaacaaggaacagattcaggctgtgatcaatgctgggataattgagcccctggtcaacctacttcaaaatgctgaatttgatataaagaaagaagcagcatgggcaatttcaaatgctacttctggtggcgctcatcagcaaatcaagtatctgattagtcaggaatgcataaaacctttgtgtgatctccttacatgccctgatccaagaattataaccgtctgtctagaagggttggaaaatattttgaaggttggtgaagctgagaaggttgcaggtgttaaagactttaacttttgcgcccgaatgatagaagatgctgagggattagaaaagattgaaaatctacagagtcacgataataatgagatctatgagaaggcagtcaagattcttgagacttactggttggaggaggaggaggaagaggaggagacactacctcctggtgatggtactcagcaaagtttccagtttggagcaaatgggcttcaggtcccatctggtggatttaacttcagctgaagggctttatagctggttggatagaacaggcagtttgctggggttatgattgatagttggggtcaaagtttggtcaggtttggtcagggcacattgacgtgtctagttatatagtctgtccagtgtccactgtggtcaaggagttttttgatggtcagtattgctgtgtaatgatgtgaatagtgttggttattgagtatcgataaacctcattctatggtctactgcgagaagaaaagaaagaaattaccagtatatctttgcatatgtgtgtgtatttgtcatctaaggatcatcatgcttcttgttccatagaattcatctctgcttctgtttttggaagggcaaaacttacttttgggaatgggccagcggatctggggaccttatagcttgagtagaatgggccaatctctgttgggagatcaatgaggaatctagtcttcaaaggaatttgaccttttgaatttgccctttgcttttaagcttttagataataacaaagaaaaaccttt

SEQ ID NO: 4994 - DNA, 1862 bp, Ambrosia trifida
acacacacaatcactctcttaaaaaccctaatatatagggtttgtttattatcaccaccatgtcgctgagacctagcgacagaaccgaccttcgccggaaccggtacaaagtcgccgtcgacgccgatgaagggcggcggaggagagaagacaacatggttgagatccgtaagaatcgaagagaagagagcttgcagaagaagcgacgtgaaggacttgctgctaatcagtttcctgttcctgttcagtccgcttccgttggtgaaaagaagttagaaaatctacctgcaatggttgcggggctttactcagatgatagcagtatgcagctagaggctactacccagtttcgtaaactgttatcaatagaacgcagccctcccattgaagaagttattaaaactggtgttgttccccgctttgttcagtttcttatgagggaggaatacgcccaactacagtttgagtcagcttgggctttgactaatatcgcttctgggacatctgaacacacaaaagtggtgattgatcatggtgctgttcctatatttgtgaaacttctttcatcttctagtgatgatgttcgggaacaggctgtatgggctctgggtaatgttgctggtgattcccctaaatgccgtgaccttgtacttgctgaagatgcgttgcagtctttgctgttactgttaaatgcgaatgctaagctgtctatgttacgaaatgccacatggaccctttcaaatttctgtaggggcaagccacaacctgcatttgaacagacaaaacctgcgcttccagctcttcaacaacttattcattcaaatgatgaagaagttttgactgatgcttgttgggcgctttcgtatctttcagacggtacaaatgataaaatccaagctgtaatagaatcgaatgtatgtcccagattggtcgagttactaaatcacccatcacctacagtactcattcctgctcttcgtacagttggcaacattgtcaccggtgatgatatgcaaactcagtatatcattgaccatcaagctctgccctgtctgttgaatctgttgtccaataatcacaaaaaagagcattaagaaggaagcttgttggactatatcaaacatcactgctggcaataaggagcagattcagacggtgattgcagcaaatctcatcggaccccttgttcacttacttcagaatgcagaatttgacataaaaaaggaggctgcatgggccatctcaaatgctacttctggtggaagccatgatcaaattaagtaccttgttagtcagggatgtattaaacctttatgcgacctacttgtgtgtccagaccctagaattgtgacagtttgtctagaggggctcgagaacattctgaaagtgggtgaagctgagaagaatttgggaaggtctggggacacaaatctttatgcacaaatgattgatgatgctgaaggattggagaaaattgagaacctacaaagtcatgataacaatgagatctatgagaaagcagttaaacttcttgaaacatattggttggaggaagaggagggcgatgctatgccacctggcgaaattgctcagcctggttttaattttggtggtgctgatgttactgttcctaatggtggctttaacttcaactgattcaaggtcggtcttgttgaagtcggggaggttaacttagtgttgcaggcatttatctgttttcatgaggttcgttattgtagtgtggttgaagtttatggagtgattcagagtttttttacaatgaatttcactaaaatgttgatgaatcatgtaaaagtaatagtggtatttctcttttgggactacttgaattgggattttat

SEQ ID NO: 4995 - DNA, 2239 bp, Trigonella foenum-graecum
tttgaattttcaattcccaaatcgcgttttcaccttcgattgtttccaaccctaaccctaattcgaaacgatgtcgctcagacccaatgcaagaaccgaggttcgtcgcacccattacaagaatgccgtcgacgccgacgaaggtcgccggagaagagaggataccatggtcgagatccgtaaagttaagcgtgaagagagtctcttgaagaaacgtcgtgaaggtcttcaaaatcaacagatgtttgcgaatcctcttcaatcttcctccattgttgagaaaaagttggagagtcttcctgcaatggttgctggggtttgctcgaatgataataaccaacaactcgaagcaactacacaatttcggaaactgctttctattgagcgaagccctccgattgaggaagttattcaatccggtgttgttcctcggtttgtggaatttctagttagggaggattttcctcaacttcagtttgaggctgcttgggcactcacaaacatagcatctggaacttctgagaacactaaagtggtaattgatcatggggccgtgccaatatttgtcaagctacttagttcacctagtgacgatgttcgggagcaggctgtttgggctttgggaaacgttgctggtgattcacctaggtgccgtgatcttgttctcggaaatggtgccctgatcccgctgttatcccagttgaatgaccaggctaagctttcaatgctgagaaatgccacatggaccctgtcaaacttttgcaggggcaagccacaacctccatttgatcaggtgcggccagcacttccagctcttgagcgcttggtttttcaaatgatgaagaagtcttgacagacgcatgctgggcactctcatatctttctgatggaacaaatgacaaaatccaagctgtgatcgaggcaggtgtatgtggcagactggtgcagctccttctgcacccatctccatcagtgctgatccctgcacttcgcactgtgggaaatattgtaaccggagatgatgtgcagactcaggctattatcggtcatggttcactcccctgccttttgagcctgttgacccataatcacaagaaaagtattaagaaagaagcttgctggactatatcaaacattacagctggaaacagagagcagatacaggctgttatcgaagccggtctgattgttcccctgatcaatcttcttcaaaatgccgagtttgacattaaaaaagaagctgcatgggcactctctaatgctacatccggcggtacccatgagcaaatcaagtacttggtgagccagggctgcatcaagcctctgtgtgatttgcttgtttgccccgatccaagaattgttactgtctgtttggaaggtcttgagaatattctgaagattggagaagcggagaaaagctttggtaactcgggagatgacaacgtgtatgctcagatgatagatgaggctgagggattggaaaagattgaaaacttgcagagtcatgacaacaatgaaatttatgagaaggctgttaaaattcttgagacatattggttggaagatgaagatgaaacactacctccaggcgatggttctcaacctggttttaattttggaggcaatgaccttccggtcccatctggtggtttcaacttcggttaaagacttctattgagtgggtaaaatgcctcagttgtctttactttttccctagggggttataatcgtagtttacatccaagtccaacttaattattgctatgttgtctaaaccaattgctttccaataattgtaggaaggaacttggttggacggagcaggtcactgttggtgttgagtcgggttggggggggggggtcggtccttgtacttcatggtgtctggtgtcagtctggtctagtgtctgcaatgaagtactggggtgggtcagtctaaactgccatgtccaaataagaaggggggtggtaggttcagctagcaacataatgtgagcaatgtcttacacaagaaatatatttgctggggagaaagtatgttgcagtagcgaggacctgttttgtgtggcaattggggagggttttctttgaaacggctttgagtctgattatttatcgagtcgtagtttgtattggtaatttataccaagttagtattttatttgagtgaatacagtgttgaaaaacaaattttatggtgtattctagtaaaaaaaagtagcgttactttttgtggttg

SEQ ID NO: 4996 - DNA, 1696 bp, Manihot esculenta
ttaatcatgtcgttgaggcccagcgctagaaccgaggttcgccggaaccgttacaaggtcgcggtcgacgccgatgaaggtcggcggaggagagaggacaacatggtggagatccgaaagagcaagcgcgaagagagcttgcagaagaagcgccgtgaaggccttcaggctcagcagttccctcccactgtcatttcttctaccatggaaaagaagttagaaagtttgccttcaatggtcgctggcgtttggtctgatgatggcagcttgcagctggaagccaccactcagtttcggaaactgctttcaattgaacgaagtcctccaattgaggaagtcatacaatctggggttgttcctcgatttgttgagtttcttgtgagggaagattttcctcaactccagtttgaggctgcttgggccctcacaaacattgcctctggaacttcagagaacactagggtggtaattgatcagggtgcagttccaatatttgtaaagcttcttgcttctcccagtgatgatgttcgagagcaggctgtgtgggcattgggaaatattgctggtgactccccaaaatgtcgtgatcttgttctcagccatggagcactacttcccctgttggctcagctgaatgagcacgcaaagctctcaatgctgaggaacgcaacctggacactatcaaacttctgcaggggcaagccacagcctccatttgaacaggtgagaccagcacttccagcacttgaacgtcttgtacattcaactgatgaagaagttttaactgatgcctgttgggcacaatcatatctttctgacggtacaaatgacaaaatccaagctgtgattgaggcaggtgtctgtccccgacttattgagctcctcctccatccatctccatcagttcttgttcctgcccttcgtactgttggaaatattgtgactggggatgacatccagacacagtgtgtaataaacaatggtgcactgccatatcttctaagcctgttgactcataatcataaaaagagcattaagaaagaagcttgctggaccatctcaaatattacagctggaaacaaccaacaaattcaggcaagctgtaattgatgctggcttaatcggccccctggttaacttgcttcaaaatgctgagtttgacataaagaaagaagctgcatgggcaatttcaaatgctacttctggtggtactcaagaccaactcaagtacttggtgagtcaagggtgcataaaacctttatgtgatctccttgtctgtcctgatccaaggattgtcactgtatgtctcgaagggttagagaacattctgaaggttggagaagctgaaaagaatttgggaagcagtggagattataatatgtatgcccagatgatagatgatgctgagggtttagaaaagattgaaaatctacagagtcatgacaataatgagatttatgagaaggcagtgaaggttcttgagacatattggttagaggaagatgatgagtctttacctccaggtgatggttcccagcaaggctttcagtttggtggaaatgatccctctgctccatctggtggattcaactttagctaaaggtatatggcacttataagaatgaatatgtgcatataatagaatgactttgtgcatatatactcatctttaaattattacctataaattatgaag

SEQ ID NO: 4997 - DNA, 2816 bp, Citrus sinensis
  misc_feature (6)..(6): n is a, c, g, or t
  misc_feature (49)..(49): n is a, c, g, or t
cagatnatcaatttcattcgaataaaaatccaaaatccgcctcatcgtnatctgtcgtctcgtctctcgcactcttttcctcagtacatcgttgctgctctctttcctttccctcttttctttcttgcaaaaccaaccgatcagattcagcggctatctcaaagcattttagtgtttccgattactagattcgattagaatttctaaacacacacgcacaaaaagaaagaaagaaaaaacgacatgtcgcttagaccgaacgcaagaaccgaggttcgcaggagcaaatacaaggtagccgtagatgcggaagagggacggaggaggagagaagacaatatggtggagatccgaaagaacaagagagaagaaagcttgctcaagaagcgacgcgagggacttcaagctcaccaaccacttaccaactccgccgctctcgataacaagaagttagaaagtcttccagctatggttgcaggcgtttggtctgatgatagaaacatacagctcgacgcaaccactcagttccggaagttactctcaatagaacgcagtcctccaattaatgaagttatacaatccggtgttgttcctcgctttatagagtttctttcaagggatgactttccacagcttcagtttgaggctgcctgggctcttacaaatattgcttctggaacatcagaaaacaccagagtggtgattgatcatggggctgtccccatatttgtcagacttctaagttctcccaccgatgatgttcgtgagcaggctgtttgggcattgggaaatgttgctggtgactcacctaaatgccgtgatcttgttcttagtaatggggccttgatgccattgctggcacaattcaatgagcatgccaagctttctatgttgagaaatgcaacatggacattatcgaacttctgcaggggcaaaccacagcctttgtttgagcagacaaggcctgcccttccagctctggagcgtcttatacattcaaatgatgatgaagtgctcacagatgcttgctgggcactatcttatctttcagatggtaccaatgacaaaatccaagctgttattgaggcaggtgtttgcccccgcctagttgaacttttacgtcatccatctccatcagtgctcatcccggctcttcgcacagttggaaatattgtcactggtgatgatatgcagactcagtgtataataaaccatcaagctctgccatgccttttggacctgttaacacaaaattataagaagagcatcaagaaggaagcttgttggaccatttcaaacatcactgctggaaatgtaaatcagatacaggccataattgaagctggtatcatagggccccttgttaatctgcttctaaatgctgagtttgagatcaagaaagaggctgcatgggctatttcaaatgcgacatctggtggcagtaatgagcaaattaagttcttggtgagccaagggtgcatcaagccactatgtgatctactaaactgtccggaccctagaattgtaacagtttgcctggaagggcttgagaacattttgaaggctggggaagctgagaagaatatgggtaacacgggtggtgtaaacttgtttgcccaagctattgatgatgcggaggggttggaaaagattgaaaaccttcagagtcatgacaacactgagatatacgagaaggcagtgaagattcttgagacatattgggtggaggaggatgaagacgagcctttacccccaggtgatgctacccaagctggatttggctttgcaggcaatggacttcctgttccatctggtggattcaactttggttgaaggaaaacaattggatgtggaatgaagttcagagtccaggtctggtgtctatgatcatcaatttcatgtggggggaggctccttttgctgttctttgatctagttttggtccagattcaaaattggttgaagataggctgagtaatgtgtcattttcaagggtcaagtaaaagagtggtgaacaaagatggggaaattaaattacacagtatagtctcttttcgttttcttttagtagtcttttttttttcagtgtcctagttcctgaaagcaagagtggggcatgctgctgccgatttaaacttgtgctgtttactggtttatgactaagagcaatgacagaaaatagatatatttctgttctcttagaggtgttttcttcttcttttctttcttagtgctggcatgattttgtatttgaccaagataagcatattttttagtttgaagaaggaattttggttgtgtattatgcaaaatatactaggattaatgaagtgtattgtattgtttcttgatatctttcaatctttcattaacatgttcttattactttttaattgtacaaagacggggagactgataccgattccataaacaatgggtttaaagacaacttgaggtcaatatgggaccatttcttgtcatgggggggagtggtcaccgattacaatcctactgttgagttttaggggggggcgcatggaatgttttttttgtggtgcccaaattattgttttggggggctctctttcatactgcgaggagagaaaaacggggggggcatcaaagtaattaatgcttgtaaaaactcccctttttcagcgtgggatgaaaaaaaaaagggcccccccccccaccccctcccactaattaaacccaaagaatgaatggaggaacccctcctaatccggacaaattaaacggggggggggagggaaggtcgggacctccgggaaactccaaattaaaaccagaccatc

SEQ ID NO: 4998 - DNA, 2347 bp, Citrus clementina
cagatcatcaatttcattcgaataaaaatccaaaatccgcctcatcgtcatctgtcgtctcgtctctcgcactcttttcctcagtacatcgttgctgctctctttcctttccctcttttctttcttgcaaaaccaaccgatcagattcagcggctatctcaaagcattttagtgtttccgattactagattcgattagaatttctaaacacacacgcacaaaaagaaagaaagaaaaaacgacatgtcgcttagaccgaacgcaagaaccgaggttcgcaggagcaaatacaaggtagccgtagatgcggaagagggacggaggaggagagaagacaatatggtggagatccgaaagaacaagagagaagaaagcttgctcaagaagcgacgcgagggacttcaagctcaccaaccacttaccaactccgccgctctcgataacaagaagttagaaagtcttccagctatggttgcaggcgtttggtctgatgatagaaacatacagctcgacgcaaccactcagttccggaagttactctcaatagaacgcagtcctccaattaatgaagttatacaatccggtgttgttcctcgctttatagagtttctttcaagggatgactttccacagcttcagtttgaggctgcctgggctcttacaaatattgcttctggaacatcagaaaacaccagagtggtgattgatcatggggctgtccccatatttgtcagacttctaagttctcccaccgatgatgttcgtgagcaggctgtttgggcattgggaaatgttgctggtgactcacctaaatgccgtgatcttgttcttagtaatggggccttgatgccattgctggcacaattcaatgagcatgccaagctttctatgttgagaaatgcaacatggacattatcgaacttctgcaggggcaaaccacagcctttgtttgagcagacaaggcctgcccttccagctctggagcgtcttatacattcaaatgatgatgaagtgctcacagatgcttgctgggcactatcttatctttcagatggtaccaatgacaaaatccaagctgttattgaggcaggtgtttgcccccgcctagttgaacttttacgtcatccatctccatcagtgctcatcccggctcttcgcacagttggaaatattgtcactggtgatgatatgcagactcagtgtataataaaccatcaagctctgccatgccttttggacctgttaacacaaaattataagaagagcatcaagaaggaagcttgttggaccatttcaaacatcactgctggaaatgtaaatcagatacaggccataattgaagctggtatcatagggccccttgttaatctgcttctaaatgctgagtttgagatcaagaaagaggctgcatgggctatttcaaatgcgacatctggtggcagtaatgagcaaattaagttcttggtgagccaagggtgcatcaagccactatgtgatctactaaactgtccggaccctagaattgtaacagtttgcctggaagggcttgagaacattttgaaggctggggaagctgagaagaatatgggtaacacaggtggtgtaaacttgtttgcccaagctattgatgatgcggaggggttggaaaagattgaaaaccttcagagtcatgacaacactgagatatacgagaaggcagtgaagattcttgagacatattgggtggaggaggatgaagacgagcctttacccccaggtgatgctacccaagctggatttggctttgcaggcaatggacttcctgttccatctggtggattcaactttggttgaaggaaaacaattggatgtggaatgaagttcagagtccaggtctggtgtctatgatcatcaatttcatgtggggggaggctccttttgctgttctttgatctagttttggtccagattcaaaattggttgaagataggctgagtaatgtgtcattttcaagggtcaagtaaaagagtggtgaacaaagatggggaaattacacagtatagtctcttttcgttttcttttagtagtcttttttttttcagtgtcctagttcctgaaagcaagagtggggcatgctgctgccgatttaaacttgtgctgtttactggtttatgactaagagcaatgacagaaaatagatatatttctgttctcttagaggtgttttcttcttcttttctttcttagtgctggcatgattttgtatttgaccaagataagcatattttttagtttgaagaaggaattttggttgtgtattatgcaaaatatactaggattaatgaagtgtattgtattgtttcggtaa

SEQ ID NO: 4999 - DNA, 2757 bp, Citrus clementina
ctcattttccctctcttgctttttctcagccttgactctcactccaaatccctaattttcaatttaatcacaagttagggtttttttccaaagccaaaacgatgtcgctgaggccgaacgccagagccgaggttcgtcgaaaccgttacaaggttgccgtcgacgccgatgaaggtcgacgacggagagaagataacatggtggagatcagaaagaataagcgcgaagaaagcttgctcaagaagcgacgcgaaggtctccaatctcagcaatttcctcctcctgctcctgcatccaatctgaatctccaaactaagttggaaagtttgcccgccatggttgctggggtttggtcagacgacagtagcttgcagctggaagcaactactcagtttcgaaaactgctttcaatcgagaggagtccaccaattgaggaagtcatacaatctggtgttgttccgcgttttgttgagtttcttatgagggaagactatccgcaacttcagtttgaggctgcctgggctcttacaaacattgcttctggaacttcagagaacactaaggtggtgattgaccatggtgctgttccaatatttgtgaagttacttgcttctccaagtgatgatgttcgtgagcaggctgtttgggcattgggaaatgtcgctggtgactctcctagatgccgtgatcttgtgctcagccaaggagctttgattccattgctggcacagttaaatgagcgtgctaagctttcaatgctaagaaatgccacatggactttgtctaatttctgcagggggaagccccagccaccatttgaccaggtgagaccagctcttccagcacttgcacagcttgttcattcaaatgatgaagaggtcttgactgatgcctgctgggcactctcctatctttctgatggaacgaatgacaaaattcaagctgtgattgaggcaggtgtttgtccacgacttgttgagctccttggtcatccatcaccctcagtgctcattcctgcccttcgtacagttggaaatattgtgacgggagatgatttccagactcagtgtataattacctatggtgcactgccctaccttttgggcctgttgacccatagtcataaaaagagcatcaagaaggaggcctgctggactatttcaaatattacagctgggaacagggaccagattcaggcagtaattgatgctggcttagttggtccccttgtcaatctgcttcaaaatgctgaatttgatataaagaaggaggctgcttgggcaatttcaaatgccacctcgggtggtactcatgagcaaatcaagtacctggtgagagaagggtgtataaaacctttgtgtgatctctttgtatgccctgatccacggattgtcactgtttgcttagaaggattagagaacattttgaaggtcggggaagctgaaaagaatatgggtactgccactgcagatgttaatcaatatgcccagttggttgaggaggctgaggggttagaaaagattgaaaatctacaaagtcatgacaacaatgagatctatgagaaggcagtaaaaattcttgagacatgctggttggaagaggacgatgagacaatagctgcaggtgatggtcctcagccaggtttcccatatgcggggaatgaggttcaagttccgtctggtggattcaatttcagctgaaaatcaattggctcgttttctggtgggagggatacatagtttgtcggatggagcagaagtttgtgttggggtgggtttgaatgttgacgacgtatgtcggggtcaagttgggtcgggtcagtgcgcctttgcatgtctggttacaggtttggtccagtgtctattgtggttgaaaaggtgccaactaaggtcggtctatacttacagtgtccaataaagtgaggctggatggattaactacaatatgatggcatgtgtttttgccttggaaatgcttcaagaggaatgcaagaagtgtatatccagggactgatctgaagtggtcgtggtggtcgtggtagtcggggcattgtcgagtctacaatttgtcccatgagtcgtgtgtgtaaccatagtctctctacggcttggcatatttgtttcattgtggtgggtgaataactgaaaatgtagagtaccaaaaacctcttgattgggtgtattacgagtaattagcagtatctttcttaaatgtgcgaaatcctcatgttcttactttcatctctacaatcatgttttcgcaagcgcatgtgtgagcctgagctgaataatcagaattaggctcatttgactaaagggggaacatggctgaattgagctggagtttgcattagtggagtttatgggctggactaaaatgtgaactgttccgcatgtgggaagattttactgccgcaaatcgccgctgttttagtagcaggcgtgtttacaatacaaccggtgtctttacattctcctttgaaaatctcaaattctgaactgttgggagtcaaagaccaaaaatttcttggtgtgagtgatgaattttcaatggaaaatgtgtttgtgactgtcaacggttcaagtgttgttattttctttgatttagtgatttcaattcataatacttgtgatagaattagaaaattgccgtacttcaaatttcaaatggcgtgcaatttttttttcttttttttttataggaatgaaaacaggcgagtaatgttgacattgggtaatcttgtactcattatggagg

SEQ ID NO: 5000 - DNA, 2350 bp, Citrus sinensis
cagatcatcaatttcattcgaataaaaatccaaaatccgcctcatcgtcatctgtcgtctcgtctctcgcactcttttcctcagtacatcgttgctgctctctttcctttccctcttttctttcttgcaaaaccaaccgatcagattcaaccgctatctcaaagcattttattgtttccgattactagattcgattagaatttctaaacacacacgcacaaaaagaaagaaagaaaaaacgacatgtcgcttagaccgaacgcaagaaccgaggttcgcaggagcaaatacaaggtagccgtagatgcggaagagggacggaggaggagagaagacaatatggtggagatccgaaagaacaagagagaagaaagcttgctcaagaagcgacgcgagggacttcaagctcaccaaccacttaccaactccgccgctctcgataacaagaagttagaaagtcttccagctatggttgcaggcgtttggtctgatgatagaaacatacagctcgacgcaaccactcagttccggaagttactctcaatagaacgcagtcctccaattaatgaagttatacaatccggtgttgttcctcgctttatagagtttctttcaagggatgactttccacagcttcagtttgaggctgcctgggctcttacaaatattgcttctggaacatcagaaaacaccagagtggtgattgatcatggggctgtccccatatttgtcagacttctaagttctcccaccgatgatgttcgtgagcaggctgtttgggcattgggaaatgttgctggtgactcacctaaatgccgtgatcttgttcttagtaatggggccttgatgccattgctggcacaattcaatgagcatgccaagctttctatgttgagaaatgcaacatggacattatcgaacttctgcaggggcaaaccacagcctttgtttgagcagacaaggcctgcccttccagctctggagcgtcttatacattcaaatgatgatgaagtgctcacagatgcttgctgggcactatcttatctttcagatggtaccaatgacaaaatccaagctgttattgaggcaggtgtttgcccccgcctagttgaacttttacgtcatccatctccatcagtgctcatcccggctcttcgcacagttggaaatattgtcactggtgatgatatgcagactcagtgtataataaaccatcaagctctgccatgccttttggacctgttaacacaaaattataagaagagcatcaagaaggaagcttgttggaccatttcaaacatcactgctggaaatgtaaatcagatacaggccataattgaagctggtatcatagggccccttgttaatctgcttctaaatgctgagtttgagatcaagaaagaggctgcatgggctatttcaaatgcgacatctggtggcagtaatgagcaaattaagttcttggtgagccaagggtgcatcaagccactatgtgatctactaaactgtccggaccctagaattgtaacagtttgcctggaagggcttgagaacattttgaaggctggggaagctgagaagaatatgggtaacacaggtggtgtaaacttgtttgcccaagctattgatgatgcggaggggttggaaaagattgaaaaccttcagagtcatgacaacactgagatatacgagaaggcagtgaagattcttgagacatattgggtggaggaggatgaagacgagcctttacccccaggtgatgctacccaagctggatttggctttgcaggcaatggacttcctgttccatctggtggattcaactttggttgaaggaaaacaattggatgtggaatgaagttcagagtccaggtctggtgtctatgatcatctatttcatgtggagggaggctccttttgctgttctttgatctagttttggtccagattcaaaattggttgaagataggctgagtaatatgtcattttcaagggtcaagtaaaagagtggtgaacaaagaatggggaaattaaattacacattatagtctcttttcgttttcttttagtattttttttttcagtgtcctagttcctgaaagcaagagtggggcatgctgctgccgatttaaacttgtgctgtttactggtttacgactaagagcaatgactgaaaatagatatatttctgttctcttagaggtgttttcttcttcttttctttcttagtgctggcatgattttgtatttgaccaagataagcatattttttagtttgaagaaggaattttggttgtgtattatgcaaaatatactaggattaatgaagtgtattgtattgtttcggtaa

SEQ ID NO: 5001 - DNA, 2244 bp, Fragaria vesca
ccgactctcaacgttccttcccttgctgccctctaaaaccccactctctctctctctcttagggtttcggagtcttttttgaagcaccgaaacgatgtcgttgaggccaaactcgaaggcggagggtcgccggaacaagtacaaggtggcggtggacgcggaggaggggcggcggcgcagggaggataacatggtggagatcaggaagaatcgcagggaggagagcctccagaagaagcgccgcgaggggcttccgccgcagcaggcgccgcctcagtcgccggcgctcgagaggaagctggagcatttaccgtcgatggtggctggtgtttggagtgaagagcccaccctgcagctcgaggcaactactcagtttaggaagttgctttcaattgagcgcagccctcctattgaggaagttattcaatctggtgttgttcctcgatttgtggagtttcttatgagggaggattttccacaacttcagttcgaggcagcttgggctctcacaaacattgcgtctgggacgtcagagaacacaaaggtggttattgaacgtggcgctgttcctatctttgtcaaactactgagttctccaagtgatgatgttcgtgagcaggctgtttgggcattgggaaatgttgctggtgattccccaaaatgccgggatcttgtacttggcaatggggctttgattccattgttatcccaattgaatgagcatgcaaagctgtctatgttgagaaatgctacctggactttgtcaaacttttgcaggggcaagccacagcctccttttgatgaggttaagccagcacttccagctttagcacgtctgattcactcaaatgatgaagaagtattgacggatgcatgttgggctctttcatacctttccgatggtactaatgacaaaattcaagcagttattgagtctggagtatgccctaggcttgtcgagctgctgcttcatccatctccctctgtactaattcctgctctccgcacggttggaaatattgttactggtgatgatatgcaaactcaggtgatcatccaacatcaagctcttccttgtctgcttacccttctgaccaacaatcataaaaagagcattaagaaggaagcttgctggacgatttcaaatatcacagctggaaacaaagatcagattcaggctgttgttgacgctaatttaattggtccacttgttcaactgctttcaagtgccgagtttgatataaagaaagaagctgcctgggcagtatcaaatgcgacatctggtggttctcatgatcagataaaaattcttgtaaatcacgggtgtatcaagccgttgtgtgatcttcttatctgccctgatccaagaatagttacagtttgtttggaaggcctggagaacatcttgaaggttggagaagctgagaagaatttgggcatgacaggaggtgtaaatctctttgctcaggcaattgatgaggctgaggggttagaaaagattgagaatctacagactcatgacaatgctgaaatttatgagaaggcagtgaagcttcttgagacctattggttggaggacgatgatggtgatgaaacaatgccaccgggtgatgctgcaactgttcctactggtggattcaactttggaggaaacgctccaactgtcccgtctggtggattcaacttcagttagaggtcatatatgctgtttccacacatcatatatacagctcatggtgtttggatctggaatggtgtcatgatgttttatatttgtatgccatcttatcaattgcagaaattatcctcattatgcactcaagtccttgagtattgcaaggcaatagtccagtcaggtcaggtcaagcgtctacttaaggtcgggtcgtctttagggttgatttttggggtggctggttcaggtgtattgaactacaggtttaaattgggatatactactatatgaagaacatctgcattctgcaacaagatcacagtccgggttttctttttgtttttttggcgaagcaaatgtcaagagtcttattagtgatatgggtgaaaatatgattcacacaggtggttttgaaactccgaaactcggtttaaatttgttcctttagtcagtccaagatttctattccattttcattttatgctgtgtgttcattacaactcaatctctctccctgttttggttccaaatttgttggtcaaatatattttaatttccaaatggtatat

SEQ ID NO: 5002 - DNA, 2007 bp, Papaver somniferum
gtaaaagccagcaaagatgtctcttaggccaaacgcgaggacggaggtccgaaggaatcgatacaaagtagcagtagatgcagatgaaggaagaagaagaagagaagataatatggttgagatccgtaagaataaacgagaggaatctttacaaaagaagagaagagaaggtatgcaagctcaacaatttccaacttctgctattcaaggtgccggcactggtgttgaaaagaagcttgaaagtctgccttcgatgattgcgggagtatggtcagatgaaagagagttacagcttgaggcgactacacagtttcggaaactactatcaattgaacgaagtcctccgatcgaggaagttattcaatcgggtgttgttcctaaatttgtggaatttctaatgagagaagattacccacagctacagtttgaggcagcttgggctctcacaaacattgcttcgggaacttcagataacactagggttgtaattgagagtggggcagttcctatttttgtcaaacttcttggatctccaagtgacgatgttcgcgaacaggctgtctgggcacttgggaatgttgctggtgattcccccaaatgccgagatcttgttcttggacaaggggctttgattccattgcttcaacagttgaatgagcatgccaaactttctatgcttaggaatgccacatggactttatcaaacttctgcaggggcaagcctcagcctccttttgaacagacaagacctgctctaccagcactcgagcgtctcattcattcaacggatgaggaagtcctgacagatgcttgttgggccttatcatatttgtctgatggtacaaatgacaaaatccaggctgttatcgaagctaatgtctgtccacgtcttgtggagcttctaatgcatccttccccgtcagtgctcattcctgcccttcgcacggttggaaatattgttactggtgatgatatgcagacacagatcattatcaaccatcaatcacttccttgccttctgaacttgcttacgaacaatcacaagaaaagcatcaagaaggaagcttgctggaccatttcaaacattacagcagggaacaaggatcagatacaggctgtcgttgcagctgaaatcataggccctctgatacatctgcttcaaactgctgagtttgatataaagaaagaggctgcatgggctatctcaaatgctacttctggtggtacccatgaacaaatcaagtatctggtgggccagggttgcatcagaccgctatgtgatctccttgtttgtcctgacccaagaattgttacagtttgtttagaaggtttagagaatatcttaaaggttggggaagctgagaagaacttgggtactactggtggtgtaaatgtgtatgcacagttaattgatgaatctgaagggttagagaagattgaaaatctgcagagtcatgataacacagagatttatgagaaggcagtgaagattcttgagacttattggatggaagaggatgatgagccattgccccctggtgatgcagcagaagctgctggcccatctgggttccagtttggggggagtgagcttccagctggtggattcaacttcagctgaaggtaacacgtccactaaaatgtgtttcatcttcattacgaagtgtgtttttctcttgcatatttcaagcagaatgtcactatcagcaagcctcttatcacaatatctgtgataaaagtaatttatctggattgtttttaggtaatttaaacagaagttgttttgtaggcttccccatcagataaactaggtattgagtcattcattttcatgcagggagttccttgagcccttctagagagagagaatttgtttattttgtttttgtcgaggtccgatattaccatgtcaaacttatttgttgaaagaaaacaaacataaaagagtatgattttatttgctgtttatcaaaacattgttgatgcattcaccggtgaacccttttc

SEQ ID NO: 5003 - DNA, 1565 bp, Cynara scolymus
  misc_feature (1158)..(1158): n is a, c, g, or t
  misc_feature (1176)..(1176): n is a, c, g, or t
  misc_feature (1179)..(1179): n is a, c, g, or t
  misc_feature (1192)..(1192): n is a, c, g, or t
  misc_feature (1224)..(1224): n is a, c, g, or t
  misc_feature (1251)..(1251): n is a, c, g, or t
  misc_feature (1275)..(1275): n is a, c, g, or t
  misc_feature (1288)..(1288): n is a, c, g, or t
  misc_feature (1295)..(1295): n is a, c, g, or t
  misc_feature (1314)..(1314): n is a, c, g, or t
  misc_feature (1320)..(1320): n is a, c, g, or t
  misc_feature (1329)..(1330): n is a, c, g, or t
  misc_feature (1344)..(1344): n is a, c, g, or t
  misc_feature (1356)..(1356): n is a, c, g, or t
  misc_feature (1359)..(1359): n is a, c, g, or t
  misc_feature (1363)..(1363): n is a, c, g, or t
  misc_feature (1374)..(1374): n is a, c, g, or t
  misc_feature (1392)..(1392): n is a, c, g, or t
  misc_feature (1395)..(1395): n is a, c, g, or t
  misc_feature (1399)..(1399): n is a, c, g, or t
  misc_feature (1416)..(1416): n is a, c, g, or t
  misc_feature (1431)..(1431): n is a, c, g, or t
  misc_feature (1459)..(1459): n is a, c, g, or t
tttgtgtaaccttcctcgctctagacacgtttcttggttttttgcttgctaggagtagcaaccatgtcgttgaggcctagcgcgaggacggaggttcgccggaatcgctacaaggtggcggtcgatgccgaagagggacggcgtaggagagaagacaacatggttgagatccgtaagaataagagagaagagagtttgcagaagaagagacgcgaagcactcacgggtagtcagttttctgtgcctgttcaatctgcttccgccgccgaaaagaagttggaaaatctacctgcaatggttgcaggagtttggtctgatgataacaatatgcagcttgaggccactactcagttccgtaagctgttatcaatagaacgcagccctcccattgaggaagttattcaatctggtgttgttcctcgttttgttgagtttcttgtgagggaggatttcccgcaactacagtttgaggcagcttgggcgttgactaatattgcttctgggacatctgagcacacaaaagtagtgatagatcatggcgctgtcccgatatttgtaaaacttctagcatctccaagtgatgatgttcgagagcaggctgtatgggcgctagggaatgttgctggtgattcccctaaatgtcgtgaccttgtacttggacaaggtgctttgattcctttgttggctcagttaaatgagcatgccaaactatctatgttgcgcaatgctacgtggacactttccaatttttgtagaggcaagccgcaaccctcttttgatcagaccagacctgcacttcctgctcttcagcaacttatccattcgaatgatgaagaagttctgaccgatgcttgttgggcactctcatatctttcagatggtaccaatgataaaatccaagctgtaatagaagcaaatgtatgtccaagactggttgagttactcaatcatccttcgccttctgtcctcatccctgctcttcgtacggttgggaacattgttactggtgatgatatgcaaactcagtatatcattaatcatcaagcactgccctgtcttctgaacctgttgagcaataatcacaaaaagagcatcaagaaagaagcttgctggactatatcgaacatcactgctggcaacaaggagcagattcagacngtcatcgaagcaaatatnatnggccctcttgttnatttgcttcagaatgcagaatttgacatcaanaaggaggctgcatgggctatctcaaangctacttctggtggaagccatgancaaattaagtatntagttantcagggatgtatcaaaccnttgtgngacctactnntctgtccagacccnagaattgtgacngtntgtntagaggggctngagaacatactaaaggtnggngaanctgagaagaatttgggncgatcaggagatgtnaatctttttgcacaaatgattgatgatnttgaaggattggagaaaattgagaacctacagagtcacgataacaatgagatatatgagaaagcggtgaagcttcttgagacatattggttggaggaagaggatga

SEQ ID NO: 5004 - DNA, 2170 bp, Solanum tuberosum
cggggctgcaggaaataactcccgatccatgcccatcttcctaacattcaataaaaccttttgattatatgtatatgtatatatataaaatatataaggcctctctttttccattccctttaaatagacgggaaaactaaaccctccgccatactcctcttagatacacaattataatatctacacactcatttgctctctctctctctctctctttgctagggtttatactattcatccaggatgtcgttgaggccgaacgccagaaccgaggttcgccggaaccgttacaaagttgccgtcgatgccgaggaaggtcgccggagaagagaggataatatggttgagattcgtaagaataagagagaggagaacttgcagaagaagcgacgtgaaggccttcaagctaatcagcaatttgctgttcctgttcaggccaccgttgaaaagaagctggagaatttaccagcaatggttgccggtgtttggactgaagatggcaatcttcagcttgaagctactactcagtttcgaaagctgctttccatagaaaggagtcccccaattgaggaggtaattcaagcaggtgttgttcctcggtttgttcaatttcttatgagggatgactttccacaacttcagtttgaggcagcatgggctctcacaaatattgcttcggggacatctgagcataccaaggtggtgattgaatctggtgcagtcccaatttttgtgaaacttcttagttctccaagtgatgatgtgcgagagcaggctgtgtgggctcttggaaatgttgctggtgattccccaaaatgccgtgatcttgtccttaactgtggagctttgcttcccttgctgtctcagctgaatccaaatgccaagctctctatgttgagaaatgcaacttggacactttcaaatttctgcagaggcaaaccacagcctgcttttgatcagacgaagcctgcacttccagctcttcaacaactaattcattcaaccgatgaagaagttttgactgatgcttgctgggcactttcatatctctctgatggtacaaatgataaaattcaagctgttattgattctggagtatgcccacgattagtcgagttattacttcacccatctccatcggttttgattcccgctcttcggactgttgggaatattgtgacaggagatgatatgcaaactcagtgtatcatcggccatcaggctttgccctgtcttttgaacttgttgaatggtagtcacaagaagagtattaagaaggaagcttgctggacaatttctaacatcacggctggcaaccgggagcaaattcagtgtgtggttgacgctggtattataggtccccttgttaatttgctacaaaatgcggagtttgaaataaaaaaggaggctgcatgggcaatttcaaatgccacatctggtggttcacatgagcagatcaagtaccttgttagtcaaggttgtatcaaaccattgtgtgatctcctcatttgtcctgacccaaggattgtcacagtttgtcttgaagggcttgaaaatattttgaaggttggggaagctgagaagaatttgggccggacatcagatataaatctttatgctcagctgattgatgatgctgaaggtttagaaaaaattgagaatcttcaaagccatgacaatcaagagatttatgaaaaggcagttaagattcttgagacgtactggttggaagaagatgatgagacgatgccacctggtgatgcaccccaacaaggttttcagtttggaggtggcgaggtctctgtgccctctgggggattcagcttcaactaaagattctcttggtgatggatgatgcagtatatgtaagggaaagctggctcaatttaagagttgtaaaagttgcaaggttgactttttggggatggtgggaagtattgccagtgaaaatggtacttggtcttttcacttgttgcagttagcctgaattgtgaatttgctcgggagatttttagttctattttattcctgtctgttttcccgctttgctttagctggttgtagtttgttattgattgtttcacttttaaattttgagctgggaattttgacattccttggaacctcttttatgggcggcttaatatgatgactaaagcaattcaccttt

SEQ ID NO: 5005 - DNA, 2260 bp, Solanum phureja
aaataactcccgatccatgcccatcttcctaacattcaataaaacctttttattatatgtatatatatatatataaaatatataagcctctctttttccattccctttcaaatcaaaatccaaaccctccgccatactcctcttagatacacaattataatatctacacactcatttgctctctctctctctctctctctctctctctttgctagggtttatactattcatccaggatgtcgttgaggccgaacgccagaaccgaggttcgccggaaccgttacaaagttgccgtcgatgccgaggaaggtcgccggagaagagaggataatatggttgagattcgtaagaataagagagaggagaacttgcagaagaagcgacgtgaaggccttcaagctaatcagcaatttgctgttcctgttcaggccaccgttgaaaagaagctggagaatttaccagcaatggttgccggtgtttggactgaagatggcaatcttcagcttgaagctactactcagtttcgaaagctgctttccatagaaaggagtcccccaattgaggaggtaattcaagcaggtgttgttcctcggtttgttcaatttcttatgagggatgactttccacaacttcagtttgaggcagcatgggctctcacaaatattgcttcggggacatctgagcataccaaggtggtgattgaatctggtgcagtcccaatttttgtgaaacttcttagttctccaagtgatgatgtgcgagagcaggctgtgtgggctcttggaaatgttgctggtgattccccaaaatgccgtgatcttgtccttaactgtggagctttgcttcccttgctgtctcagctgaatccaaatgccaagctctctatgttgagaaatgcaacttggacactttcaaatttctgcagaggcaaaccacagcctgcttttgatcagacgaagcctgcacttccagctcttcaacaactaattcattcaaccgatgaagaagttttgactgatgcttgctgggcactttcatatctctctgatggtacaaatgataaaattcaagctgttattgattctggagtatgcccacgattagtcgagttattacttcacccatctccatcggttttgattcccgctcttcggactgttgggaatattgtgacaggagatgatatgcaaactcagtgtatcatcggccatcaggctttgccctgtcttttgaacttgttgaatggtagtcacaagaagagtattaagaaggaagcttgttggacaatttctaacatcacggctggcaaccgggagcaaattcagtgtgtggttgacgctggtattataggtccccttgttaatttgctacaaaatgcggagtttgaaataaaaaaggaggctgcatgggcaatttcaaatgccacatctggtggttcacatgagcagatcaagtaccttgttagtcaaggttgtatcaaaccattgtgtgatctcctcatttgtcctgacccaaggattgtcacagtttgtcttgaagggcttgaaaatattttgaaggttggggaagctgagaagaatttgggccggacatcagatataaatctttatgctcagctgattgatgatgctgaaggtttagaaaaaattgagaatcttcaaagccatgacaatcaagagatttatgaaaaggcagttaagattcttgagacgtactggttggaagaagatgatgagacgatgccacctggtgatgcaccccaacaaggttttcagtttggaggtggcgaggtctctgtgccctccgggggattcagcttcaactaaagattctcttggtgatggatgatgcagtaaatgtaagggaaagctggctcaatttaagagttgtaaaagttgcaaggttgactttttggggatggtgggaagtattgccagtgaaaatggtacttggtcttttcacttgttgcagttagcctgaattgtgaatttgctcgggagatttttagttctattttattcccgctttgctttagctggttgtagtttgttattgattgtttcacttttaaattttgagctgggaattttgacattccttggaacctcttttatgggcggcttaatatgatgactaaagcaattcaccttttcttggtgttgaaatattgatgtcttgaatctttggtgatttatccttgtcacttggaaagatgataaaagtttgttgtatttgagttaccgaccatcctgttctataa

SEQ ID NO: 5006 - DNA, 1989 bp, Glycine max
cttccctctgcaaccaaacgatgtcgctcaggccaaatgccagaaccgaggttcgccgcaaccgttacaaggtcgccgttgacgccgacgagggccgccggagaagagaggacaacatgagtttgctcaagaagcgtcgcgaaggcctccaagctcaccaacagcttcccgctcctcttcagaactccactgtcgacaaaaatttagagagtcttcctgcaatggttgctggagtttggtcgaatgataatagtcttcaacttgaagccaccacgcaatttcgcaagctgctttcgattgaacggagccctccgattgaggaagttattcaagctggtgttgttccacgttttgttgagtttcttgttagagaggatttccctcaacttcagtttgaggctgcgtgggctctcacaaacattgcatctgggacttctgagaacactaaggtggtaattgatcacggggcagttcctatatttgtcaagctactcagttcacccagtgatgatgttcgggagcaggcagtgtgggctttgggaaatgttgctggtgactcccctaggtgtagagatctggtgctcagccatggtgctctcgtcccactgttggcccagttgaatgagcatgcaaaactttcaatgctgagaaatgccacatggacattatctaacttttgcaggggtaagccacagcctccgtttgagcaggtgagaccagcacttcctgcactcgagcgtttggttttttccaatgatgaagaagttttgacagatgcttgctgggcattatcatatctctctgatggcacaaatgacaaaatccaagcagttattgaagcaggtgtatgtcccagattgatgcagcttctcatgcacccatctccctcggtgctgattcctgctcttcgtacagtgggaaatattgtgactggagatgacatgcagactcagtgtattatcaatcatggtgcacttccttgccttttgaacctgttgacaaataatcataaaaaaagcatcaagaaagaagcttgttggaccatatcaaacattactgctggaaataaagaacagatacagactgttattgaagctggtctggttgcaccccttgtcaatcttcttcaaagtgccgagtttgacattaaaaaagaagcttcttgggcaatctcaaatgctacatctggtggaactcatgaccagatcaagtatttggtgagtcagggttgcgtaaagcctctttgtgatctgcttgtttgcccggacccaagaattgtcactgtctgtttagaaggcctagagaatattctgaaggttggagaagctgagaagagcctaggtaacactggagatgttaatgtgtacgcacaaatgatagatgaagctgagggattggagaagattgaaaacctacagagtcatgacaacaatgaaatatatgaaaaggttgttaaaattcttgaaacatattggttggaagaagaagatgagacactaccttcaggaaatggtgctcaacctggtttcaatttcggaaacaatgagcttcccgtcccatctggtggattcaacttcagctgaagaccttttcctgagaagggacttgttggacgaagtaggggtttgtgccgggtgggcgtgtgtgttgggataaacgtctggagagtcaaccattgcaccttgtgtctgcttacagtctggcatagggtccttcgtgttaatgaggtgcctgggagggtcagtttacgcttccaaatccaagaagggactggtggatttaacagcagcataatgaccttttcagctgtgtttggttgtactaaaaatatataatgctggtggaaggttgcagtggcgatggtttttctttaatgcggcttttagtgctgttttttattgatttgggtcagtgtttgatttgggtaaatatatcatttccaaaccaattttatggtctattccaaattccaatcgaaggattagttct

SEQ ID NO: 5007 - DNA, 2325 bp, Gossypium hirsutum
aactctctaatcggcctctcctcgctctatcattttctcaaacaaccaatcgactctcccagaaatagtacatcgactgtgaattaatcggcgattccatcagattgaaagtaaaataaataaataaataaataaagaatcgacgatgtctctaagaccgaacgcgagggcggaggtccgtcggaacaggtacaaggtggcggttgatgcggaggaaggccgacggaggagagaagacaacatggtcgagatccgaaagaacaagagagaggaaaaccttcttaagaaacgccgcgaaggacttctctctcaacaacaacagccgcagcaacagcagctgctctcttccgccgccgggtccgagaaaaagttagaaagtcttcccgccatggttgcgggtgtttggtcagatgacaggaatatgcagcttgaggcaactactcaattcagaaagctgctatcaatagaacgtagtcctccgatcaacgaagttgtacagtcaggtgttattcctcgctttgttgagttccttgcaagggatgacttcccacagcttcagtttgaggcagcttgggctctcacaaatattgcttcagggacttcagataacaccagggttgtgattgatcatggagctgtccctatatttgttaaactcctaggttctccaactgatgatgttcgtgaacaggctgtttgggcattaggaaatgttgctggagactctcctaagtgtcgcgacctggtccttggccatggggcattgatgccactgttggcacaattcaatgatcatgcaaagctctctatgttgcgaaatgctacttggactttatccaacttttgtcggggcaaaccacagccttcatttgagcagacaagaccagctttgccgactcttgaacgccttattcattcaaatgatgaggaagtccttacagatgcatgctgggccctatcatatctctcagatggtactaacgataaaatccaagctgttattgattcaggtgtctgcccccgacttgttgagcttttgcttcatccatccccaactgtcctaattcctgcacttcgcactgttggaaatattgttacaggggatgatatgcagactcagtgtataataaaccaccaagcccttccatgccttctgaacctgttgacaagtaactataaaaagagtatcaagaaggaagcttgctggaccatctcaaacatcactgcaggaaatgtagatcagatacaggctgtaatcagcgctggcatttttgcgcctctagtccatctacttcaaaatgcagagtttgaaatcaagaaagaagctgcttgggcaatttcaaatgctacctccggcggcacccatgaacagataaagttcctggtgagccaaggttgcattaagccattgtgcgatcttctaaactgtccagacccaagaattgtgacagtttgtttagaaggccttgagaacattctgaaggttggggtagctgagaaaaatttgggtcacaccagagaggtcaatctctatgcccagttaattgatgatgctgaggggttggaaaagattgaaaacctccagagtcatgacaacaatgaaatctatgagaaggcggtaaagattcttgaaacatattgggtggaagaagaagatgagccattaccccctggtgatgcttctcaatctgggttccaattcggaggcaatcaacttcctgttccttctggtggattcaatttcagttgaaggacacatggttggagtagtaggaaaggggattaaggtcgggtattttatctcggtgtttggtttcggtattcacatacagttgaagtgatgccaaagtgtgtgattaagaagtcatctcaataaagacgggtgaatgacacaccatcatggtaaaattgttcgaggagagagtgtctggtaaaaccgtttaaatacttattttacttctccatacggtaattaaaattcttttgcagcatcctagttactggatgcaagggtgagtttatttttctttatatatatgatatacatatatgtttgtctttgttttcactttagtgggtagtggtggtttctgatcataaagagccaccaatatcagctttgagaagggattatttatctttttcatgtaatgtctgatttcgttagaaacaaaaacaaaaacgacgcatggtttccctctttaaaattttggggtgtgtcttaaactttgagttcatatattggaaaccccagccgtgtgaagttcaaaatttccgaatagcaattaaaaggtttcaagccacttatttgaatgaaaaaaaaag

SEQ ID NO: 5008 - DNA, 4225 bp, Malus domestica
ataggaaataaacacaaagcacaaaccccactcccaaactcccccaactctctctctctctcttctttctctctcctctgctcgctaaaaccctttcgctctctctcttctagggtttcggattcttaatttggactgaaacgatgtcgttgaggccgaacgcgagggcggaggtccgccggaacaggtacaaggtggctgtggacgcggaggaggggcggcgtcggagggaggacaatatggtggagatcaggaagaaccgcagagaagagagcctccagaagaagcgccgcgaggggcttcaaacccagcaattgccctccagtcttcactccgccggtctggataagaagctagagcatctaccatccatggttgctggtgtttggggtgatgagggcactatgcagcttgaggcaacaacccagtttaggaagttgctttcaattgaacgtagccctccgattgaggaagtcatacaagcgggtgtcgttcctcgctttgttgagtttctaatgagggaggattttccacaacttcagtttgaggctgcttgggctcttacaaatattgcttctgggacatctgataatacaagggtggtaattgatcatggagctgttccgatatttgtgaaactgctcagttctccgagtgatgatgttcgtgagcaggctgtttgggcattgggaaatgttgctggtgattcccctagatgccgtgatcttgtacttggtaatggggctttgcttccattgctttcacagcttaatgagaatgcaaagctctctatgctgagaaacgcaacctggacactgtcaaatttttgcaggggcaaaccacagcctccatttgaacaggttaagcctgcccttcctgctcttgcgcgtttgattcattcaaacgatgaagaagtcttgactgatgcttgttgggctctttcatacctttctgatggtacaaatgacaaaatccaagccgttattgaatctggagtgtgcccccggcttgttgagcttttaatgcatccatctccatcagttctcattcctgctctccgcacagttggaaatattgttactggagatgatatgcaaactcaggttatcatccaacatcaagctcttccttgcctgctaaatcttttgactaacaattacaaaaagagcatcaagaaggaagcttgctggactatttcaaatatcacagccggaaacaaggaacagatccgggctgtagttgaggctaatataatcggccctcttgttaatctgcttcaaaatgctgagtttgatataaagaaagaggctgcatgggcaatctcaaatgctacatctggtggttctcatgagcagataaagtttctagttagtcaagggtgtatcaagccgctgtgtgatcttcttgtttgcccagatcctagaattgttacagtttgtttagaaggcctggagaacattttgaaggttggtgaagccgagaagaacttgggtactactggaggtgtgaatctctatgctcaggcgattgaagatgctgatggtttggagaaaattgagtctctgcagagtcatgacaatacagagatttatgagaaggcagtaaagatgctcgagacatattggttggaggacgatgatgaaacaatgccaccaggtgatgcagctccaactacgttcaactttggagggaatgacgttccaactgtcccatctggtggattcaacttcggctagaggtgatgcacctttcacaaattacataattttttgttttggaatgtggacggtgttaatgatgtttcaaattgtaatcttgtatcaattgcagaaacattcctcagcaaggcaataatccagtcaggtcaggtcaggtcaggtcaagcgtcatgttatgttcgagtcctgttgtagggttgaatgttgtcgggggtggctggctcaggtgtttgaaccagctggtttaaatcggttcaggcttccatgggctttgatcatagggacatcaccaacacagattaaaggaaagaaccggagttattttttttggagtcgttatttccggtggtcggatggggttgcagacggcgttttctcgcactggcatgaagcaattatgcatatgcactttgatgcggattcgaccttctctaactgccatcaactttttatggtaattcaggatatgaacgtgaagaatgtgaagaacaagaagtgctgcactgactgcaaagccactgagacgcccttgtggaggagtggcccggctgggcccaagtcactgtgcaatgcttgtgggatcagatacaggaagaaaattcctactgtgagtctgtgcaagggaccaaagaggtggaagaaagacaaaacatatgcggcagcagcaccaccagtacaatcaccaccccagccaccacaaacactgctgcttctgcttctgccaccaccaccacgagcaccactgccagaaaagccaaaattggtggcagtggtggtgagaaaaattggcaagcgtgtacgagagatagaagacaaattagacatgaaggaaacttatcactttcgatgcaacattcaccttaaattctgtgacattaatgagataaaaatcgttggaaaaagggttagggcagtgaggaatttgaactttcaaggcaggcaatacttctcaaagaaaccggatcgagcacgcgatccgcaagtgttgccattgccgtcggtactcgcaatccctacccacgttcttcataactacacccacacgactcattttccatttcttccccatctctttctctcttctctttctccctatccctacaaaatcttcatcttcgacgtttctgctaatcaattcaaatgatttctaataccaggtaaaagccaattgctttttatggtgggaattaatctcctggtgtaatcttgcctgttcttgattcttgcgttcagatgagaactttgtcgatgtgcttttcatctttatcgcaagtgcctagatcatgcagtgtttatagtttagctcatttttggagtgaaggttttcccaatttgagcaggacttgtggatacaattgtaactctaagctacatgattccagaatttatgcggttgatggaggaaacagtaggaaatggactagaagatctctgaccacaaaaacagaaggaagaaacaaaagccccataaaacttagccgtgaaattttagatgtaacggtttcaacaagcgctgcattaaatataaataaaatggaaacaagtcaataccaacagactcaacccttagactttcgacaggcaattgctcagaataaagacttagccgacttagtgacagttattgttttcgatattgagactactgggtttagcagagagaaagatcgaatcatagagattgcacttcaagatcttgaagggggtgaaaacagtactttccagacactggtaaaccctgaacgcagtgttctaaattcacatgttcatggaattacaaccgatatggtcaacaggcctgatgttccaaggttcaaggacctcttaccaatcttagtcaagtatgtcaaaagccgtcaaaaaccgggaggttgtgtaatgttggttgctcacaatgctcgtacttttgatgtacccttcattagaagtgaattccttcgctgttccgtagatattccttcaacttggctgttcagggataccatgcctttgggacgtgaagcaatgaagtctgaaggatcatcttcaagaagtatatcgttgcaagcccttcgtgagcacttccagattccattggatggtacagctcacagagccatggccgacgtgaaagtgctgtcagcagttttacaaaggctgacttgtattctgaaactcccactttccagccttgttggagaagctttcttagcgtcggaaactggcactgcaaagaaaaagggttccagataggcatgcttctggtcattactgaaatacattctcgtaaccaatcatcaaatgtggtctggtggcgtgggattcctctcgcagagcttcaggtcggagctgtagattgctcgaggatcctaacggtacctgttagggtttggtcgaaaaagaaaacagctgatcattgtaactgtaatacattgttgtttctaataatttatgcccagaatttatctgtattggattcacttaaaaaacttatataaatacaccaaataaccccatttcatgtggaa

SEQ ID NO: 5009 - DNA, 2207 bp, Helianthus annuus
atcattcatatttccgttttttaactttaaaccactctacaagaacaaattcatcctccctcttctctctccgtacattcttcagggtaattgattaggaattgatcatgtcgctgaggcctagcgcgcgtacggaggtgcggcggaaccggtacaaggtggcggttgacgcggatgaaggacggaggcggagggaggataatatggttgagatccggaagaataagagagaggagaacttgttgaagaagcggcagttgttgtcgtcgtcgcagtcgttggctgctggtgtgcctgttcaagcgtctacggttgagaagaagctggaaagtctcccttctatggttgctggagtttactccaatgataataatatgcagctggaggcaactactcagtttcgtaaattgctttccatagaacggagcccaccaattgaggaagttatacaatcgggggttgtacctcgctttgtcgagttcttgatgagggaagattttccacagcttcagtttgaggctgcttgggcactcacaaacatcgcatctggaacctctgataatacaaaggtcgtaattgaacacggggcggtcccaatatttgttaagcttctagcttctccaagcgatgatgtacgcgagcaggctgtttgggcgttgggaaatgttgctggtgattctccccgatgccgtgatctcgttctcggtcatggtgctttgatgcccttacttgctcagttaaacgagaatgctaagctttctatgctcagaaacgccacatggacgttatcaaatttttgtcgaggaaaaccacagcctccatttgagcagacaaggcctgctcttccggcccttcagcgtcttattcattcaaatgatgaagaggtgttgacagatgcatgctgggctctctcttatctttctgatggtaccaatgacaaaatacaagctgtgattgatgctggtgtttgccaacgtcttgttgagcttctccttcatccatctccttcggtgctcatccctgcgcttcgaactgttgggaatattgtcacaggcgatgatctccaaactcagcatataatcgaatgcggtgtgcttccttgcttgttgagcttgttgacccataaccacaagaagagtatcaaaaaggaagcttgctggacaatctcaaacatcactgctggaaacaaagaacagatacggacggttatcgaggctggattaatagctccgctagtcaatctactccagactgctgaattcgatattaaaaaagaggccgcgtgggcaatatcaaatgccacttctggtggtaccaatgagcaaatcaagtatttggtgaatcaaggctgtataaaaccgttgtgcgatctcctcgtatgtcccgatccaagaatcgtgaccgtctctctagaagggcttgagaacattcttaaagtaggtgaggtggaaaagcaagcgggtaactcgggtgacgttaatttcttcgcccagttgattgatgatgcggatgggttagagaagattgagaatttgcaaagtcatgataataatgagatttatgaaaaggcggttaagattctcgagacgtattggcttgatgaggatgatgaaaatgtggctgatggtggtcaggctggttttgacttcggtggaaataacgttcaagttccgtctggtggatttaattttaacagctgaagggttttcaaggtatgatgaagtacgttggtggcgtcaaaggtcaagtcctgttaggtcgggttaagtcatcgggtcaggtcaagtcgggtcgggtcagagcatctcgtgtcgtcaggttacagaatggtcgagtcactggttattgttttgaagagatgcaaaaggtgggtctgttggttccagtatacgaaggggttgaccaaggattttatttagcgagtttatcggtaaattgtttggttgttacttcaagcagctggaggtggtcatttcgttttagtgagggtttaagagttacaaatatacacggagtctttattaatttcgggtttttatctttgatatttttggacacgtatgtttttatactctgtcggggcattcgttttactagtgtcttatgttttattgttgagtcggacgtgttcatgttttaccgtttatggaaatgtcacaacacttcttggatacatgttttcttaatttgttagttgcatgattttt

SEQ ID NO: 5010 - DNA, 2381 bp, Gossypium raimondii
caaattgcaccacaaaaataataaataatttcaaactaattatttaaaaaaagaaatcctctataaaccatatcactctctaatcggcctctcctcgctctatcattttctcaaacaaccaatcgactctcccagaaatagtacatcgactgtgaattaatcggcgattccatcagattgaaagtaaaaataaataaataaataaagaatcgacgatgtctctaagaccgaacgcgagggcggaggtccgtcggaacaggtacaaggtggcggttgatgcggaggaaggccgacggaggagagaagacaacatggtcgagatccgaaagaacaagagagaggaaaaccttcttaagaaacgccgcgaaggacttctctctcaacaacaacagccgcagcaacagcagctgctctcttccgccgccgggtccgagaaaaagttagaaagtcttcccgccatggttgcgggtgtttggtcagatgacaggaatatgcagcttgaggcaactactcaattcagaaagctgctatcaatagaacgtagtcctccgatcaacgaagttgtacagtcaggtgttattcctcgctttgttgagttccttgcaagggatgacttcccacagcttcagtttgaggcagcttgggctctcacaaatattgcttcagggacatcagataacaccagggttgtgattgatcatggagctgtccctatatttgttaaactcctaggttctccaactgatgatgttcgtgaacaggctgtttgggcattaggaaatgttgctggagactctcctaagtgtcgcgacctggtccttggccatggggcattgatgccactgttggcacaattcaatgatcatgcaaagctctctatgttgcgaaatgctacttggactttatccaacttttgtcggggcaaaccacagccttcatttgagcagacaagaccagctttgccgactcttgaacgccttattcattcaaatgatgaggaagtccttacagatgcatgctgggccctatcatatctctcagatggtactaatgataaaatccaagctgttattgattcaggtgtctgcccccgacttgttgagcttttgcttcatccatccccaactgtcctaattcctgcacttcgcactgttggaaatattgttacaggggatgatatgcagactcagtgtataataaaccaccaatcccttccatgccttctgaacctgttgacaagtaactataaaaagagtatcaagaaggaagcttgctggaccatctcaaacatcactgcaggaaatgtagatcagatacaggctgtaatcagcgctggcatttttgcccctctagtccatctacttcaaaacgcagagtttgaaatcaagaaagaagctgcttgggcaatttcaaatgctacctccggcggcacccacgaacagataaagttcctggtgagccaaggttgcattaagccattgtgcgatcttctaaactgtccagacccaagaattgtgacagtttgtttagaaggccttgagaacattctgaaggttggggtagctgagaaaaatttgggtcacaccagagaggtcaatctctatgcccagttaattgatgatgctgaggggttggaaaagattgaaaacctccagagtcatgacaacaatgaaatctatgagaaggcggtaaagattcttgaaacatattgggtggaagaagaagatgagccattaccccctggtgatgcttctcaatctgggttccaattcggaggcaatcaacttcctgttccttctggtggattcaatttcagttgaaggacacatggttggagtagtaggaaaggggattaaggtcgggtattttatctcggtgtttggtttcggtattcacatacagttgaagtgatgccaaagtgtgtgattaagaagtcatctcaataaagacgggtgaatgacacaccatcatggtaaaattgttcgaggagagagtgtctggtaaaaccgtttaaatacttattttacttctccatacggtaattaaaattctttcacagcatccttgttactggatgcaagggtgagtttatttttctttatatatattatatacatatatgtttgtctttgttttcactgtagtgggtagttgtggtttctgatcataaagagccaccaatatcagttttgagaagggattatttatctttttcatgtaatgtctgatttcgttagaaacaaaaacaaaaacgacgcatggtttccctcttcgcttggggtgtgtcttaaactttgagttcatatattggaaaccccagccgtgtgaagttaaaaaaattccgaatagcaattaaaaggtttcaagcaacttatttgaat

SEQ ID NO: 5011 - DNA, 2164 bp, Gossypium hirsutum
cctcgctctatcattttctcaaacaaccaatcgactctcccagaaatagtacatcgactgtgaattaatcggcgattccatcagattgaaagtaaaataaataaataaataaataaagaatcgacgatgtctctaagaccgaacgcgagggcggaggtccgtcggaacaggtacaaggtggcggttgatgcggaggaaggccgacggaggagagaagacaaaatggtcgagatccgaaagaacaagagagaggaaaaccttcttaagaaacgccgcgaaggacttctctctcaacaacaacagccgcagcaacagcagctgctctcttccgccgccgggtccgagaaaaagttagaaagtcttcccgccatggttgcgggtgtttggtcagatgacaggaatatgcagcttgaggcaacaactcaattcagaaagctgctatcaatagaacgtagtcctccgatcaacgaagttgtacagtcaggtgttattcctcgctttgttgagttccttgcaagggatgactttccgcagcttcagtttgaggcagcttgggctcttacaaatattgcttcagggacatcagataacaccagggttgtgattgatcatggagctgtccctatatttgttaaactcctaggttctccaactgatgatgttcgtgaacaggctgtttgggcattaggaaatgttgctggagactctcctaagtgtcgtgacctggtccttggccatggggcattgatgccactgttggcacaattcaatgatcatgcaaagctctctatgttgcgaaatgctacttggactttatccaacttttgtcggggcaaaccacagccttcatttgagcagacaagaccagctttgccgactcttgaacgccttattcattcaaatgatgaggaagtccttacagatgcatgctgggccctatcatatctctcagatggtactaacgataaaatccaagctgttattgattcaggtgtctgcccccgacttgttgagcttttgcttcatccatccccaactgtcctaattcctgcacttcgcactgttggaaatattgttacaggggatgatatgcagactcagtgtataataaaccaccaatcccttccatgccttctgaacctgttgacaagtaactataaaaagagtatcaagaaggaagcttgctggaccatctcaaacatcactgcaggaaatgtagatcagatacaggctgtaatcagcgctggcatttttgcccctctagtccatctacttcaaaacgcagagtttgaaatcaagaaagaagctgcttgggcaatttcaaatgctacctccggcggcacccacgaacagataaagttcctggtgagccaaggttgcattaagccattgtgcgatcttctaaactgtccagacccaagaattgtgacagtttgtttagaaggccttgagaacattctgaaggttggggaagctgagaaaaatttgggtcacaccggagaggtcaatctctatgcccagttaattgatgatgctgaggggttggaaaagattgaaaacctccagagtcatgacaacaatgaaatctatgagaaggcggtaaagattcttgaaacatattgggtggaagaagaagatgagccattaccccctggtgatgcttctcaatctgggttccaattcggaggcaatcaacttcctgttccttctggtggattcaatttcagttgaaggacacatggttggagtagtaggaaaggggattaaggtcgggtattttatctcggtgtttggtttcggtattcacatacagttgaagtgatgccaaagtgtgtgattaagaagtcatctcaataaagacgggtgaatgacacaccatcatggtaaaattgttcgaggagagagtgtctggtaaaaccgtttaaatacttattttacttctccatacggtaattaaaattcttttgcagcatcctagttactggatgcaagggtgagtttatttttctttatatatatgatatacatatatgtttgtctttgttttcactttagtgggtagtggtggtttctgatcataaagagccaccaatatcagctttgagaagggattatttatctttttcatgtaatgtctgatttcgttagaaacaaaaacacaaaa

SEQ ID NO: 5012 - DNA, 2650 bp, Oryza sativa
cccccgccccgttccccaattcgtttcgaaatcgaattccaaatcgaaatcgaaatcgaatcgattcgtccgtgcgtgcgtgcgtgcgcgactcgctctcacacacttcgcctccaccgacctctctctctctcactcgctagggtttcgaggcgacgacgatgtcgctgcggccgagcgagcgggcggaggtgcggcggagcaggtacaaggtggcggtggacgcggacgaggggcggaggcggagggaggacaacatggtggagatccgcaagagccggcgcgaggagagcctcctgaagaagcgccgcgacggcctccccgccgccgccgcggccgccgcggcggcgtccccgctgctcgcccactcctccgcgctccagcagaagttggaggggttgccggcgatggtgcaggcggtgcagtccgacgacagcgccgtgcagctggaggccaccacgcagttccggaagctgctctccatcgagcggagtcctccaattgaggaggtgatcaacacaggggtggtgcctcgctttattgccttcctccaacgtgaggattatccccaactccagtttgaggctgcatgggcactcactaacattgcatcaggcacatcagataacaccaaagtggtagttgagtctggtgctgtgcccatctttgtcaaactgcttagctcccccagtgaggatgtccgtgagcaggctgtatgggctctgggaaatgtggctggtgactcaccaaaatgccgtgacctggtgcttgcaagtggtgggttatacccattgttgcaacagcttaatgagcacgccaagctctcaatgctcaggaatgccacatggacactgtcaaacttctgccgtgggaagcctcagcctaattttgagcaggtcaaaccagcgctttctgcactgcagcgcctcatccattctcaggacgaggaggtcctgactgatgcctgctgggctctttcttatttgtctgatggaactaatgataagatccaagctgtgatagaatcaggagtgttcccaaggcttgtggaacttctcatgcatccttcggcttcagtgctcattccagctttgcgcacggtgggtaacatcgtcactggggatgacatgcagactcagtgtgtcatcgatcatcaagctcttccatgtctcttgaacctcttgaccaacaatcataagaaaagcatcaagaaagaagcatgctggactatctcaaacatcactgctggcaatagggaacagattcaggctgtgatcaatgcaaacataattgctcctctagtacatctgctgcaaactgctgaatttgacatcaagaaagaggctgcgtgggcaatctcaaatgccacttctggtggaacacatgatcagattaagtaccttgttgcccagggttgcatcaagccactctgtgatctgcttgtttgcccagatcccaggatcgtgacagtttgcttggaaggtcttgagaacatcttgaaggttggagaggcagaaaagaaccttggggcaggggatgtcaattcctatgctcagatgattgatgatgctgagggactggagaagattgagaaccttcagagccatgacaacactgaaatatatgagaaggcagttaaaatgctcgagtcctactggttggaggaggaagatgatgccatgccctcaggtgacaacgctcaaaacggcttcaactttggaaaccagcagcccaatgttccatcgggtggattcaactttggctgaagatacctatctggaatgatgtaccactgttccttagctacttgcttggggctagtcagagttgggggagtcttgtcgttggagtcttggttgggtcctggcggtctggtctcaggcagtcgtaatgtcagtcccagtccttgggcttgcatcatcgccagtggtgcagcttggtcagtggtcagtcttgaaggtcatccagttggatttacttgggctctgtctcacctgtggtgggagcatgggggagagggcgtccagagccgcaggtgttgtcgggagagagttaccagttggcttttgcctcctatatagcatgaatgaattatattatcatctgttttgaggtaaaaagaaccttgaaagatagggtttattcatggttgtgtcagtttttgtcaagtctctatgtgctgtattaacatgtcagaagagtattggcacaacttataaacatcaaatagcaactgggtttttggtggagtcccatgctggtctgtctattcattggtttgttgttgtaatgtttttaatgtcatggttttgtcgcgtcaaagtttgtcggtggttgtttgcgtacttgctgttgttgttgtcgttgtcgttttgagattcatgttgttatgtctgtcttctgtctagaaaactgaaaactcaggagaaccgcctagggaaaaagaccgcctattttggcgatgagttttggttgagttcttggtgtcatgtgtggagtgtaaaagggaagatgatggttcctagttttaccccctggaacccggtttatgattgtatgattattacgttatgaaccatatgcacatgataaaaggaagagaagggagctgtcccacttcatatttccctatggagatgatttgcactgg

SEQ ID NO: 5013 - DNA, 2632 bp, Oryza sativa
cccccgccccgttccccaattcgtttcgaaatcgaattccaaatcgaaatcgaaatcgaatcgattcgtccgtgcgtgcgtgcgtgcgcgactcgctctcacacacttcgcctccaccgacctctctctctctcactcgctagggtttcgaggcgacgacgatgtcgctgcggccgagcgagcgggcggaggtgcggcggagcaggtacaaggtggcggtggacgcggacgaggggcggaggcggagggaggacaacatggtggagatccgcaagagccggcgcgaggagagcctcctgaagaagcgccgcgacggcctccccgccgccgccgcggccgccgcggcggcgtccccgctgctcgcccactcctccgcgctccagcagaagttggaggggttgccggcgatggtgcaggcggtgcagtccgacgacagcgccgtgcagctggaggccaccacgcagttccggaagctgctctccatcgagcggagtcctccaattgaggaggtgatcaacacaggggtggtgcctcgctttattgccttcctccaacgtgaggattatccccaactccagtttgaggctgcatgggcactcactaacattgcatcaggcacatcagataacaccaaagtggtagttgagtctggtgctgtgcccatctttgtcaaactgcttagctcccccagtgaggatgtccgtgagcaggctgtatgggctctgggaaatgtggctggtgactcaccaaaatgccgtgacctggtgcttgcaagtggtgggttatacccattgttgcaacagcttaatgagcacgccaagctctcaatgctcaggaatgccacatggacactgtcaaacttctgccgtgggaagcctcagcctaattttgagcaggtcaaaccagcgctttctgcactgcagcgcctcatccattctcaggacgaggaggtcctgactgatgcctgctgggctctttcttatttgtctgatggaactaatgataagatccaagctgtgatagaatcaggagtgttcccaaggcttgtggaacttctcatgcatccttcggcttcagtgctcattccagctttgcgcacggtgggtaacatcgtcactggggatgacatgcagactcagtgtgtcatcgatcatcaagctcttccatgtctcttgaacctcttgaccaacaatcataagaaaagcatcaagaaagaagcatgctggactatctcaaacatcactgctggcaatagggaacagattcaggctgtgatcaatgcaaacataattgctcctctagtacatctgctgcaaactgctgaatttgacatcaagaaagaggctgcgtgggcaatctcaaatgccacttctggtggaacacatgatcagattaagtaccttgttgcccagggttgcatcaagccactctgtgatctgcttgtttgcccagatcccaggatcgtgacagtttgcttggaaggtcttgagaacatcttgaaggttggagaggcagaaaagaaccttggggcaggggatgtcaattcctatgctcagatgattgatgatgctgagggactggagaagattgagaaccttcagagccatgacaacactgaaatatatgagaaggcagttaaaatgctcgagtcctactggttggaggaggaagatgatgccatgccctcaggtgacaacgctcaaaacggcttcaactttggaaaccagcagcccaatgttccatcgggtggattcaactttggctgaagatacctatctggaatgatgtaccactgttccttagctacttgcttggggctagtcagagttgggggagtcttgtcgttggagtcttggttgggtcctggcggtctggtctcaggcagtcgtaatgtcagtcccagtccttgggcttgcatcatcgccagtggtgcagcttggtcagtggtcagtcttgaaggtcatccagttggatttacttgggctctgtctcacctgtggtgggagcatgggggagagggcgtccagagccgcaggtgttgtcgggagagagttaccagttggcttttgcctcctatatagcatgaatgaattatattatcatctgttttgaggtaaaaagaaccttgaaagatagggtttattcatggttgtgtcagtttttgtcaagtctctatgtgctgtattaacatgtcagaagagtattggcacaacttataaacatcaaatagcaactgggtttttggtggagtcccatgctggtctgtctattcattggtttgttgttgtaatgtttttaatgtcatggttttgtcgcgtcaaagtttgtcggtggttgtttgcgtacttgctgttgttgttgtcgttgtcgttttgagattcatgttgttatgtctgtcttctgtctagaaaactgaaaactcaggagaaccgcctagggaaaaagaccgcctattttggcgatgagttttggttgagttcttggtgtcatgtgtggagtgtaaaagggaagatgatggttcctagttttaccccctggaacccggtttatgattgtatgattattacgttatgaaccatatgcacatgataaaaggaagagaagggagctgtcccacttcatatttccctat

SEQ ID NO: 5014 - DNA, 2242 bp, Trigonella foenum-graecum
tttgcttcgctctttcatttcaattttctctctgtaactgaaacccccttcgattcggttcaatctctcagttcctaatacgataaaccggtttcccctccgattgtaaaacatgtcgtatcgtcctaactcaaacgcgagaaccgatgttcgtcggaatcgctacaaggtggcggttgatgcggaagaaggtcggagacggagagaggataacttggttgagatccggaagaatcgcagggaagaaagcttgcagaagaagaggcgtgagggacttcaacctcaacagatgcctgcatcagttcaatctaatctacttgagaaaaagttggagcacctaccagccttggttacaggaatttggaccgatgataataacatgcagttcgaggcaacaactcagtttcggaagttgctttcaatcgaacgtagtccaccaattgaggaggttatacaagctggtgtagttccgcgctttattgagttcttgatgagggaagattttccacagctgcagtttgaggcagcttgggctttgacaaatatagcttctggaacatctgaaaacactaaggtagtaattgaggcaggtgctgtcccaatttttgtgaagctccttgcttctcctagtgatgatgtccgtgaacaggccgtgtgggcgttgggaaatgttgctggagattcgcctaaatgccgtgatcttgttctcggtcatggagctttgcttcctctgctggctcaattgaatgagcatgccaaactttctatgctcagaaacgctacatggacactctcaaacttctgcagggggaagccacaacctgcttttgaacaggttaaacctgcacttcctgcacttgcaagtctcatccattcaaatgacgaagaagtcttgactgatgcctgttgggcactttcatatctttctgatggtgcaaatgacaaaattcagggcgtaattgatgctggtgtctgtagccggcttgttgagcttctactccacccatctccttctgtgcttatacctgctcttcgtaccgtcggaaatattgtaactggagatgacatgcagacacaggttatcatcaaccatcaagttcttccttgtcttatgagtctcttgactaataattataaaaaaagcatcaagaaggaagcttgctggacaatatcaaacatcacagctgggaataagcaacagattcaggatgtgattgaggccaatataattggtcctttggtccacttgcttcaaaatgctgagtttgatatcaagaaggaagctgcctgggccatctcaaatgctacatctggtggatcgcatgaacaactcaagtacctggtcagtcaagggtgcattaagcccttgtgtgatcttctcatatgtcctgatcctaggatcgtgacagtttgtcttgaaggacttgaaaacatattaaaggtaggggaagctgataaaaatgtcagcaacactgatggtgtgaatttgtatgctcaaatgattgatgatgccgaaggtttggagaaaattgagaacctccagagtcatgacaacactgagatttatgaaaaggccgtgaagattcttgagacatactggttggaggaagatgacgaggctatgcctccaggggatgcatctcaatcagggttcaactttggtggctctgaagttcccgctgtgccttctggtggattcaactttaactagatgaatttgtgttttattaaggttttttggctggtccatcattgaagacttccagcatggcagttcaacagttgggggttcaagtcagtgtcgtttcattgttctttggttctataaggttcagccttggtaaataggccgttactggaccggcttgggtttttgaaatggctggttttacatacaacagggggacagttgtgttgtggcttgcttttcttgccacttccgagttaaatattagagtttgcttttggcctagtgatcatttcaagtgatttggctcttctatagaattttatgtgttaagtttcgttatttttcctgctaagattggagtcagtaagtaccacttatgattctaggtattttgagaaataccaagtgatactattcttttatctttatagttgcaaggaactttggagttttctttaccctgtccttgtttttactaaaatttaccattcattaggcttatctgagatttgatatttgagaaataccaagtgatactattcattaggcttc

SEQ ID NO: 5015 - DNA, 2112 bp, Tropaeolum majus
aaaaatctcttaaaaaccccacacagagaaaaagaacacacatttctccatcttccctctagggttttcattgaatttgtatcctctcttccagatcgcggtttagcctacttctgaatcgcaatcctttatagtcgtggtgttcaattgtttgtgaaacagttctgtttctagttccaaggcttcgtcttttgggttgggaacttctgaaaccatgtctttgaggcctaacgccaggactgaggttcggaggagccgatacaaggtagcggtcgacgcagatgaaggaaggagacggagagaggataatatggtggagattaggaaaaatcgaagggaggagagtttgcagaagaagcgtcgtgaggggatccaagcccaacctatgcctgcgtctcttcagtctaattctgctgagaagttggaacatctcccgtctatggttgcaggtgtttggtcggatgaaaataatcttcaacttgaggcgacaagtcaatttagaaaattgctgtcaattgaaaggagccctcctattgaggaagtcatccaagctggcgttgttcctcgctttgtggagttcctaatgagggaagattttccacaacttcagtttgaggcagcttgggctcttacgaatattgcatctggtacgtctgagaacactaaggttgtaattgatcatggagctgtaccaatttttgccaaacttcttggttctccaagtgatgatgttcgcgagcaggctgtctgggctctaggaaatgttgctggagattctcccaaatgtcgggatcttgtacttgggcatggggcactgcttcctttattgtctcaactgaatgagaatgcgaagctttctatgctgagaaatgccacctggacactttcaaatttttgcaggggtaaaccacaacctgcatttgatcaggttaagcctgctcttccagcacttgcccagcttattcattcaaatgatgaagaggtcctgaccgacgcatgctgggcgttgtcatatctttctgatggtacaaatgataaaattcaagctgttattgaagctggtgtttttccgcgactaattgagcttttggtccacccttcgccttcagtactcattcctgctcttcgcactgtcggaaatattgtcactggtgatgatatgcagactcagtatgtcatcaactatcaagcactacctgcccttctaaacctgttgaccagtaactgtaaaaagagcatcaagaaagaagcttgttggacaatctcaaatatcacagctggaaacaaggatcagatccagtcagtaatcgagtcaaatctcattgctccacttgctcatctgttgcaaaatgccgagtttgatattaagaaagaagctgcctgggctatctcaaatgctacatctggtggtacccatgaccaaatcaagttcctcgtgagtcagggttgtatcaaaccactgtgtgatcttctcatctgccctgaccctagaattgttacagtttgcttagagggccttgaaaacatcttgaaggtaggggaagctgacaagaatttgggaaacactggagatgttaatctctttgcccaagtgattgaagatgtagacgggctggagaaaattgagaatttacagtctcacgataatagtgagatttacgaaaagtccgtgaagcttcttgagacatactgggtggaggaagacgaagaggaaacaacagtgcccggtgatggtaatgcgcaatctggtttcagctttggaggcggtgatggtccagcagttccctctggtggattcaatttcaactagagctgcaacatatgaaaaatcttggtgttgggtgcagttcaagcgagtcctagtgtttgaggccggaaatttcgatgtgggtcggtcttatatgttgcagcaaggcaaagatgggatatataaagttgtaagatgagattattttaagcaaaaagttaaatttcagagagccatgcagaaattgcctctcattaagtctagaaaagtgtgtggtgtcagtaatggttttgtagtcccaaaaaaaacccgttttgaataccttggtttcgtctcattggttcgttttcaagtgtttttctctt

SEQ ID NO: 5016 - DNA, 1971 bp, Orobanche aegyptiaca
ctcactcatttctgccgaatttcgttgtttttgtttttttctctcagcgatatacgaagagttacaatgtcgctgagacctaatgctcgcgccgaggttcgccgcaacaagtacaaggtggccgtggacgccgaggagggacggcggcgtagggaggacaacatggtcgagattcggaagaaccgccgtgaagagagcctccaaaagaagcgccgtgagggcatccagcagtttggggtccccgtcgaagccacaaccggcatcgagaaaaaggtgcagttagaaaatctaccatcaatggtagctagtgtttggactgatgatggcaacactcaacttgaggcaaccacccaattccggaaattactttccatagaacgaagcccaccaattcaggaggtgatacaagctggtgttgttcctcgttttgttgaatttttgacgagggaagacttcccacaacttcagtttgaggcagcttgggctctcacaaatattgcttcggggacatccgagcacactaaggtggtaatcgatcatggagctgtcccgatatttgtgcagcttcttggttctccgagtgatgacgttcgtgaacaggctgtatgggctttaggtaatgtcgctggtgattccccaaaatgtcgtgaccttgtacttagtcatggagccttgggacctttgctagctcagttgaatgaacatgccaagttatctatgctcagaaatgctacctggacgctgtcaaacttttgcagaggcaagccacaacctgtttttgatcagacgaggcctgcacttccagttcttcggcaacttatccactcaaatgatgaagaagttttgactgatgcatgttgggcactctcttatctttctgatggaaccaatgacaaaattcaagctgtgattgactgtggagtatgcccccgcttagtcgagttgttgcttcatccatcaccttccgttcttatccctgcacttcggactgttggaaatattgtcactggagatgatatacaaactcagtatatcatcagctataacgcactaccctgtcttctgaacctcatgagcggtgctcataagaagagcattaaaaaggaagcttgctggactatttccaacatcacagctggaaacagggaccaaattcaggccgtgattgaagcaaacattatcggtccactagtcgaactgctacaaaatgctgaattcgaggtcaaaaaggaggctgcttgggccatatcgaatgcaacatctggcggcactcacgaacaaatcaagtaccttgtaagtcagcaatgcataaagcctttatgcgatctgctcgtctgccccgacccgagaatcgtcaccgtctgtctcgaaggtctcgagaacattctaaaaatcggtgaagccgacaagaatctgggcctgacgggagacaccaacatttatgctcaaatgattgacgatgctgaggggctcgagaaaatcgagaaccttcagagccacgacaataacgagatttacgagaaggctgtcaagatgctcgagagttactggttggaggaagatgaggatgatcagccgggcccacccggagatggggcggcccaacagaacttccaattcggagggggtgatgcctccgtccctaccggtggtttcagcttcacctgaaggtgtgtgttgtcggggattgggtgatgataatttttatctactgttttgtctttgggtaaaatctgtctgtatcattgaaactggatgataccttttctttttcgtttttattattattttttttaattttaatggctgggtaattttggctctaccaaaaaagtttattacctggcttgtgtcttcttgttgtgggatatggatttttcattgtttgatgttgtcatgattttgtttattcatttttgttcgagtgtctgtcggaggttttgtttatccagattttgagtcgattggatc

SEQ ID NO: 5017 - DNA, 1895 bp, Ambrosia trifida
ccagtgtgtatatcatatactaccatcactactctttaaaaacccttaatttcttagggtttgtttatttatcaccaccatgtcgctgagacctagcgacagaaccgaccttcgccggaaccggtacaaagtcgccgtcgacgccgatgaagggcggaggaggagagaggacaatatggttgagatccgtaagaatcggagagaggagagtttgcagaagaagcgacgtgaaggactcgctgctaatcagtttcctgttcctgttcagtccgcttccgttagtgaaaagaagttagaaaacctacctgcaatggttgcggggctttactcagatgatagcagtatgcagctagaggctactacccagtttcgtaaactgttatcaatagaacgcagccctcccattgaagaagttattaaaactggcgttgttcctcgctttgttcagtttcttatgagggaggaatatccccaactacagtttgagtcagcttgggctttgactaatatcgcttctgggacatctgaacacacaaaagtggtgattgagcatggtgctgttcctatatttgtgaaacttcttgcatcttctagtgaagatgttcgggaacaggctgtatgggctctgggtaatgttgctggtgattcccctaaatgccgtgaccttgtacttgttgaaggtgctttgcagtctttgctgtccctattaaatgcgaatgctaagctgtctatgttacgaaatgccacatggacactttcaaatttctgtagaggcaagccacaacctgcatttgaacagacaaaacctgcacttccagctcttcaacaacttattcattcaaatgatgaagaagttttgactgatgcttgttgggcgctttcgtatctttcagacggtacaaatgataaaattcaagctgtaatagaagcgaatgtatgtccgagattggtcgagttactaaatcacccatcacctacagtactcattcctgctcttcgtacagttggcaacattgtcaccggtgatgatatgcaaactcagtatatcattgaccatcaagctctgccctgtctgttgaatctgttgtccaataatcacaaaaagagcattaagaaggaagcttgttggactatatcaaacatcactgctggcaataaggagcagattcagacggtgattgcagcaaatctcatcggaccccttgttcacttacttcagaatgcagaatttgacataaaaaaggaggctgcatgggccatctcaaatgctacttctggtggaagccatgatcaaattaagtaccttgttagtcagggatgtattaaacctttatgcgacctacttgtgtgtccagaccctagaattgtgacagtttgtctagaggggctcgagaacattctgaaagtgggtgaatctgagaagaatttgggaaggtccggggacacaaatctatatgcacaaatgattgatgatgctgaaggattggagaaaattgagaacctacaaagtcatgataacaatgagatctatgagaaggcagttaagcttcttgaaacatattgggtggaggaagaggacgacgatgtaatgccacctggcgaaattgctcagcctggttttaatttgtggcggtgatgttactgttcctaatggtggctttaacttcaactaattcaaggtcggtcttgttgaagtcgggaggttaacttagtgttgcaggcatttatctgtttcatgcggttcgttattgtagtgtggttgaagtttatggagtgattcagtagtttttttttacaatgaatttcactaaaatgttgatgaatcatgtaaaagtaatatggtattctcttttgggacacttgaattgggatttatagaatttcccttcttttgc

SEQ ID NO: 5018 - DNA, 2252 bp, Arabidopsis thaliana
ttaccaaaatgtttttgtaaaccaacgaaattcaatctttctctctgtgccttttttcctcttttctcgttcccctctacttcatttagggtttatcatcctctaccaatccgccgattctatacatacacttttcatatatatacatacatcgtctccactctcgttggctcatttttcattcaccgccacgaagcaagaggagattcgtattagccaccatgtctttgagacctaacgctaagactgaggttcgccggaaccgctacaaagtggcggtggatgctgaggaaggaagacggaggagagaggacaacatggtcgagatccgtaagagtaagcgtgaagaaagcttacagaagaagcgtcgtgaaggccttcaagctaatcagctacctcaattcgctccttcttctgttcctgcttcatcaactgttgagaagaagttggagagtttgcctgctatggttggtggtgtttggtcagatgatagaagtttacagcttgaagcgactactcagttccggaaattgctttctattgagcgtagtcctccgattgaagaagtgattgatgctggtgttgtgcctcggtttgtggaatttctcactagagaggattatccacagcttcagtttgaggctgcttgggcattgacaaacattgcttctgggacttcagagaatacaaaggtggtcattgaacatggtgctgttccgatttttgttcaactattggcttctcagagtgatgatgtccgtgagcaggctgtgtgggcattagggaatgttgctggtgattctccacggtgcagagatcttgtccttggtcaaggagctttgataccattactctctcagttgaatgagcatgctaaactctcgatgctgagaaatgctacttggaccctctctaatttctgcaggggcaagccacagcctccctttgaccaggtccgtccagcactcccagcccttgaacgcctgattcattcgactgatgaggaagtgttaacggatgcatgttgggctctctcttacctttccgatggcacaaatgacaaaatccaatctgtcattgaggcaggtgttgttcctcgactcgtcgagcttctccagcatcaatcaccatctgtgcttattcctgcccttcgtagtattggtaacattgtcactggagatgatctgcagacacagtgtgtaattagtcatggtgcacttcttagccttttgagccttctgactcacaatcataagaagagcatcaaaaaggaagcttgctggacaatctcaaatatcactgctggaaacagggaccagattcaggctgtgtgtgaagctggtttgatttgccctcttgtcaatctgcttcaaaatgcggagtttgatataaagaaagaagctgcgtgggcaatatcaaatgccacttcaggtggttctcctgaccaaatcaagtacatggtggaacagggagtcgtgaaaccactgtgtgatcttttggtgtgccctgatccaaggattatcactgtgtgtctggaaggattggagaacattttgaaagttggggaagctgaaaaggtcacaggaaataccggggatgtaaacttttatgcacagctgatcgatgatgctgagggattagaaaagattgagaatctgcagagtcatgacaacagcgaaatctatgagaaggcagtgaagattcttgaaacgtactggttggaagaggaagatgaaactttaccacctggtgatccctctgcacaaggcttccagtttggaggaggtaatgatgcagccgtaccaccaggtggattcaacttccagtgaaggagctgaacatgacgatttgaagagtcgaaggagcttaaagagtttgggggcactggttaaaaagggtatgattagagagtctggtcttctgtgtaaaagtcagatggggtgccttacttagtctggcctggtccggtcagatccagtggttggtgggtttgagtcatggaataagcttgttgggggggagttgggtaggagtcatcaagggatatttatttttgggaaagggtttataagtttttaaagtgtgatctgatgagaatgtgtctctctgggtttttgttacatttgtactacacaacactgcaaagtcaaacataaaaaagttggtcaaactttatttggtcttattggtgacataaaagcccaattggttcgtctctttattgtttatagtaaatgtttttttttataatc

SEQ ID NO: 5019 - DNA, 2238 bp, Arabidopsis lyrata
accaacgaaattcaatctttctctctctgtgctttttcctcttttctcgttcccctctacttcgtttagggtttatcatcctctttctatccgccgattctctacatacactttttgatatatatacatacatagtctccactcttgttggctcatttcagtgactttcatcattcaccggcacgaagcaagaagaggagattcgtattagctaaccatgtctttgagacctaacgctaagactgaggttcgccggaaccgctacaaagtagcggtggatgctgaggaaggaagacggaggagagaggacaacatggttgagatccgtaaaagtaagcgtgaagaaagcttacagaagaagcgtcgtgaaggtcttcaagctaatcagctacctcaattcgctccttcttctgttcctgcttcttcaactgttgagaagaagttggagagtctgccttcaatggttggaggtgtttggtcagatgatagaagtctacagcttgaagcgactactcagttccggaaattgctttctattgagcgtagtcctccgattgaagaggtgattgatgctggtgttgtgcctcggtttgtggaatttctcactagagaggattatccacagcttcagtttgaggctgcttgggcattgacgaacattgcgtctgggacttcagagaatactaaggtggtcattgaacatggtgctgttccgatttttgttcagctgttggcttctcagagtgatgatgtccgtgagcaggctgtttgggcattagggaatgttgctggtgattctccacggtgcagagatcttgtccttggtcaaggagctttgataccattactctctcagttgaatgagcatgctaaactctcaatgctgagaaatgctacttggaccctctcaaatttctgcaggggcaagccacagcctccctttgaccaggtccgtccagcacttccagcccttgaacgcctgattcattcgactgatgaggaagtgttaacggatgcatgttgggctctctcttacctttccgatggcacaaatgacaaaatccaatctgtcattgaggcaggtgttgttcctcgactcgtcgagcttctccagcatcaatcaccatctgtgcttattcctgcgcttcgtagtattggtaacattgtcactggagatgatctgcagacacagtgtgtaattagtcatggtgcacttcttagccttttgagccttctgactcacaatcataagaagagcatcaaaaaggaagcttgctggacaatctcaaatatcactgctggaaacagggaccagattcaggctgtttgtgaagctggtttgatttgccctcttgtcaatctgcttcaaaatgctgagtttgatattaagaaagaagctgcatgggcaatatccaatgccacttcgggcggttctcccgaccagatcaagtacatggtggaacaaggagtcgtgaaaccactgtgtgatcttttggtgtgccctgatccaaggattatcaccgtgtgtctggaaggattggagaacattttgaaagtcggggaagctgaaaaggtgaccggaaataccggggatgtaaacttttatgcacagttgatcgatgatgctgagggattagaaaagattgagaatctgcagagtcatgacaacagcgaaatctatgagaaggcagtgaagattcttgaaacgtactggttggaagaggaagatgaaactctaccacctggtgatccctctgcacaaggcttccagttcggaggaggtaatgatgcagccgtaccaccaggtggattcaacttcaaatgaaggagctgagcatgatgagtgtgaagagtcgaagcagcttaaagagtttgggggcactggttagaaagggtctgattagagagtctggtcttctgtgtaaaagtcagatggggtgccttacttagtctggcccggtccggtctgatccagtggttggtgggtttgagtcatgaaataagcttgtttggggggagttgggtaggagtcatcaagggatatttatttttgggaaagggtttatatgttttttatgtgtgatgagaatgtgtctctctgggtttttgttacatttgtactatacaacactgcaaagtcaaacataaaaaagttggtcaaactttatttggtcttattggtgacataaaagcccaattggttcgtccttttattgtttatagtattttttttttttt

SEQ ID NO: 5020 - DNA, 2527 bp, Brassica napus
ggggcccccccccccccaatttcagctgcggtccggtccggaatcccgggccgaccccgcgcccgaggaaatccataattttcctcttttctcgtaccctccacttcgtctagggtttacgctctctctctatccgccgatcctatacatacactttttttcacatatacacacacacaaagtctctcggcggcttatctgctagtgactttcattcacccgcgcagagcaagaagaagaagaagaagaagaagattccgatttgttgtagccatgtctctgagacccaacgccaggaccgaggttcgccgtaaccgctacaaagtggcggtggacgcagaggaaggacgcaggaggagagaagacaacatggtggagatccgcaagaccaagcgtgaagagagcttgctgaagaagcgtcgcgagggtcttcaagccacgcagctgcctcaagtcacttctgctgcttcgtccgtcgagaaaaagttggagagcttgccttctatggtcggtggagtttggtcagatgataggagcttgcagcttgaagcgactactcagttccgtaaattgctttccatagagcgtagtcctccgatagaagaggtgattggtgctggtgttgtgccaaggtttgtggactttctcatgagggaggattatccacagcttcagtttgaagctgcttgggcactgacgaacattgcttctgggacttctgagcatacgaaggttgtcattcaacatgatgctgttcccatttttgttcagctcttggcttcccagagtgatgatgtccgtgagcaggctgtttgggcattagggaacgttgctggtgattctccacagtgcagagatcttgtactgagtaagggagctttgttaccgctgctctctcagttgaatgagcatgctaaactctccatgctcagaaatgctacttggaccctctctaatttctgcaggggcaagccacagcctccttttgaccaggtccgtccagcacttccagcccttgagcgcctgattcattcgactgatgaggaagtgttaacggatgcctgttgggctctctcctatctttctgatggcaccaacgacaaaatccaatctgtcatcgaggcaggtgttgttcctcgacttgtcgagcttctccagcatccgtcaccgtctgtgcttatacccgctcttcggagtattggtaacatcgtcactggagatgatgcgcagacgcagtgtgtaattagtcatggtgcactcctttgtcttctgagccttctgactcagaaccataagaagagcattaaaaaggaagcatgctggacaatctcaaacatcactgctggaaacagggaccagattcaggctgtatgtgaagctggtttgattgctcctctcgtcaatctgcttcaaaatgctgagttcgatataaagaaagaagctgcatgggcagtctcaaatgccacttcgggcggttctgctgaccagatcaagtacatggtggatcagggagtcgtgaaaccactgtgcgatcttttggtatgcccggatccaaggattatcaccgtgtgtctagaaggactagagaacattctgaaagtcggggaagctgagaaggtgacgggaaacacaggggatgcaaactattatgcacagctaatcgatgatgctgagggactagaaaagattgagaatctgcagagtcatgacaacagcgagatttatgagaaggcagtgaagattcttgaaacatactggttggaggaggaagacgagactttaccacctggtgatgaatctgctcagggattccagtttgggggtagcgatgcagccgcacctccaggtggattcaacttcaagtgaaggagctaagcatgatgattgaagagtcaaaggaggtcaagagtcttgggggcactggttttaaatggggtctgattagagtctggtcttgtgtttaaaagtcagatggggtgccttggtctgtcctgatcttgtatggtcaggtggtgggattgagtcataaaataagctttgttggggagttgggtaaggagtcaatgagagggggtatattttatgaactctaaatgggaaaatttgggtggtctggttttgttgtttggtgtctctctgggggctttgttatattagttactacacaacactcattgcaaagtcaaaaaacataaaaaagttggtcaaacattttctggtcttattggtggcaaaaaaagcccacttggtgcgtctctttattttgttaatatttttttatgtatctgttttccagtgcggtccaagtcatgttgggctattgttgtctgcataagcacgcttttctgtatgttatattactaatgtctttttttttttcaaagtattatgtcccataaatcgatgttattaatgcttatcgtcaacttcgattaagtaggggttaaatatgtattccaatattttttgttcaaagtggaaagtctgggattataggcattattaaaaagatcctacttttaagtgt

SEQ ID NO: 5021 - DNA, 2460 bp, Cicer arietinum
cccccgattatagtaaccttttctccgatcaaagtaactttttccctcatcttcaaattcaaaccagtggcatttccgcaattcgcatccgatccaggtccactttcggctccaaatcccacacttcaaccatcctatataaacccctccatcattcctctttttcaaactcttcaaaccaaaaccctctctcactccatttttacttagcactctcaattttctctctgcaactgaaattccctccgcgtcaggtccgttggttcaattattcaattcaaatccgattaaccgttgattccaccgattctaaaacgatgtcgtatcgaccaaccgcaaacgcgaggaccgatgtccgtcgcaatcggtacaaagtggccgttgatgccgaagaaggtcgcagacggagagaggatactatggttgagatccgaaagaaccgtagggaagagagcttgcagaagaagagacgcgagggacttgctcagcagatgcctgcatcagctcaatctacgctaatagagaaaaagttggaacacctaccatccttggttacaggtatttggactgatgataataacatgcagttcgaggcaactactcagtttcggaagctgctttcaatcgaacgtagcccaccaattgaggaggttatacaagctggtgtcgttcctcgctttgttgagtttttgatgagggaagatttcccacagctgcagtttgaggctgcttgggctttgacaaatatagcttctggaacatctgaaaacactaaggtagtaattgatcacggtgctgtcccaatttttgtccagctccttgcttctcctagcgatgatgtccgtgaacaggctgtgtgggcattaggaaatgttgctggagattcacctaggtgccgtgatcttgttctcagtcatggagctttgcttcctctgttggcacaattgaatgagcacgccaaactttctatgctcagaaacgctacttggacactttcaaacttctgcagggggaagccacagcctgcttttgaacaggttaaacctgcacttcctgcacttgccagtctcatccattcaaatgacgaagaagtcttaactgatgcttgttgggcactttcatatctttctgatggtactaatgacaaaattcaaggcgtaattgatgctggtgtctgtagccggcttgttgagcttctactgcacccatctccttctgttcttattcctgctcttcgaacagttggaaatattgtcacaggagacgacatgcagacacaggttatcatcaaccatcaagttcttcccagtcttctgaatctcttgactaataattataaaaaaagcatcaagaaggaagcatgttggacaatatcgaacatcacagctgggaataaacaacagattcaggctgtgattgatgctaatatatttggtcctttggtccacttgcttcaaaatgctgagtttgatatcaagaaggaagctgcctgggccatctcaaatgctacatcgggtggttctcatgaacaattaaaatacctggtaagtcaagggtgtattaagcccttgtgtgatcttctcatatgtcctgatcctaggattgtgacagtttgtctggaagggctggaaaacattttgaaggtaggtgaagctgataaaaatgttagcaacactgatggtgtgaatctgtatgcccaaatgattgatgatgctgaggggttggagaaaattgagaacctccagagtcatgacaacactgagatttatgaaaaggcggtgaagattctcgagacatactggttggaggatgaggacgagactatgcctccaggggatgcttctcaatcagggttcaactttggtggctctgaagttccttctgtgcccactggtggattcaacttcaactagaaggatttttggctgttctatctgtgaaatcctccggtgtgacagttcaacggtgggggaagtcagcgttgtttcattatccttaggttctataaggttcagctttggtaaataggccgatacctgaccggcttaggtttttgaaatggctggttttttacatacatcagggggacagttgggttgtggcttgtttcttgccacttcagagttaaatatttgagtttgctttcggccaagtgatcatttcaagtgatttggctcttttatataatttcattttatgtcaagttttgttatttttcctgcatagatagattggagtcagcaagtaccacttatgattctgagtattttggcaaatattacatgatgacactattctttcttcattttagttgggcaaggaactgcggagtttttcttttaccctgtcccattgtttcgttgaagtttaccctaaagtttcaatgtgttacaaatctggtttgggcaagtcttaccaaaaatagcgtgcagcaatttttgtattcgaacaaaaattata

SEQ ID NO: 5022 - DNA, 2344 bp, Eutrema halophilum
ttaccaaatgtatttgtaaaccaaggaaattcaatctctgtatcttttttttttgttcctcttttctcgttcccactccacctcgtctagggtttatcctctatctatatccgccgattctatacatacacctttctcttttcttcataaataattaatacacagtctcttgtcggctcatatcatcttagtgactttcttcgttcaccgtcacgaagcgaggagaggatatttgcttgtagccatgtctctgagacccaacgcgaggaccgaggttcgccggaaccgctacaaagtggcggtggacgccgaggaaggacgacggaggagagaggacaacatggtggagatccgtaagaacaagcgtgaagagagcttgcagaagaagcgtcgcgagggtcttcaagccacccagcaacctcaattcgctccttcctccgtcactggtgcttcatccgtcgagaaaaagttggagagtttgccttctatggttggcggagtctggtcagaggacagaaacttgcagcttgaagctactactcagttccggaaactgctttctatagagcgtagtcctccaatcgaggaagtgatagatgctggtgttgtgccaaggtttgtggaatttctcatgagggaggattatccacagctccagtttgaagctgcttgggcactgacgaacattgcctctgggacttcagagaatacaaaggtcgtcattgaacatggtgctgttccaatttttgtcaaactcttggcttctcagagtgatgatgtccgtgagcaggctgtttgggcattaggcaatgttgctggtgattctccacggtgtagagatcttgtcctaagtcagggagctttgctaccattgctttctcagttgaatgagcatgctaaactctcgatgcttagaaatgctacttggaccctctcaaacttctgcagggggaagccacagcctccttttgaccaggttcgtccagcacttccagcccttgaacgcctgattcattcgactgatgaggaagtgttaaccgatgcctgttgggccctctcttatctttctgatggcacaaatgacaaaatccaatctgtcattgaggcaggtgttgttcctcgacttgtcgagcttctccggcatccatcgccatctgttcttattcctgctcttcgtagtattggtaacatcgtcactggagatgatgcacagacccagtgtgtaattagtcatggtgctctccttagccttttgagccttctgactcacaaccataaaaagagcataaaaaaggaagcttgctggacgatctcaaatatcactgctggaaatagggaccagattcaggctgtatgtgaagctggtttgatttgccctcttgtcaatctgcttcaaaatgcagagtttgatataaagaaagaagctgcatgggcaatatcaaatgccacttcgggaggttctcctgaccaaatcaagtacatggtggaacagggagtcgtcaaaccactgtgtgaccttctgatatgccctgatccaaggattatcaccgtgtgtctagaaggattggagaacattctaaaagtcggggaagctgaaaaggtcactggaaataccggggatgtaaacttctacgcacagttaatcgatgatgctgaaggtttagagaagattgagaatctgcagagtcatgacaacagcgaaatctatgagaaggcagtgaagattctcgaaacatactggttggaagaggaagatgaggctttaccacctggtgatggttctgctcagggcttccagtttggtggtaatgatgcagccgcaccgccaggtggattcaacttcacgtgaaggagctaaacatgatgattggagagtcgaaggaggtttaaagagtttgggggcactggtcaaatgggtctttaattagagtctggtcttctgtgtaaaagtcagatggagtgcctttgtctggccgggtctaggtctggattcagtggttggggtgggtttgagtcatgaaataaaccgggagttgggtaggagtcatccgaggggattttataaaaaactacaatgggaaatttgggaagggttttatagttttaaagcgtgatgagaaatttgtgggttttgttacatttgtactacacaacactgcaaagtcaaaaacatataaaagttggtcaaacgttatttggttttattggtgacaaaaaaaagcccaattggtgcgtctctttatttttttttaatatatgttctcagtgcggtccaattcattttgggctattgttgtctgcatatgcacgcgtatcgataatatatctatgttctttcttttca

SEQ ID NO: 5023 - DNA, 2471 bp, Brassica rapa
atcaatgaaagaatgaataaagcagaggaaattcaataattttcctcttttctcgtacccctccacttcgtctagggtttaccctctctctctctctatccgccgatcctatacatacactttttcacatatacacacacacaaagtctctcgtcggctcatctgctattgactttcattcacccgcgcagagcaagaagaagaagaagaattgtagccatgtctctgagacccaacgccaggaccgaggttcgccgtaaccgctacaaagtggcggtggacgcagaggaaggacgcaggaggagggaagacaacatggtggagatccgtaagaccaagcgcgaagagagcttgctgaagaagcgtcgcgagggtcttcaagccacgcagctgcctcaagtcacttctgctgcttcatccgtcgagaaaaagttggagagcttgccttctatggttggtggagtctggtcagatgataggagcttgcagcttgaagccactactcagttccgtaaattgctttctatagagcgtagtcctccgatagaagaggtgattgatgctggtgttgtgccaaggtttgtggagtttctcatgagggaggattatccacagcttcagtttgaagctgcttgggcactgacgaacattgcttctgggacttctgagcatacgaaggttgtcattcaacatgatgctgttcccatttttgttcagctcctggcttcccagagtgatgatgtccgtgagcaggctgtttgggcattagggaacgttgctggtgattctccacagtgcagagatcttgtactgagtaagggagctttgttaccattgctctctcagttgaatgagcatgctaaactctccatgctcagaaatgctacttggaccctctctaatttctgcaggggcaagccacagcctccttttgaccaggttcgtccagcacttccagcccttgagcgcctgattcattcgactgatgaggaagtgttaacggatgcctgttgggctctctcttatctttctgatggcacaaatgacaaaatccaatctgtcatcgaggcaggtgttgttcctcgacttgtcgagcttctccagcatccgtcaccgtctgtgcttatacccgctcttcgtagtattggtaacatcgtcactggagacgatgcgcagacgcagtgtgtaattagtcatggtgcactcctttgtcttctgagtcttctgactcagaatcataagaagagcattaaaaaggaagcatgctggacaatctcaaacatcactgctggaaacagggaccagattcaggctgtatgtgaagctggtttgatcggccctctcatcaatctgcttcaaaatgctgagttcgatataaagaaagaagctgcatgggcagtctcaaatgccacttcgggcggttctgctgaccagatcaagtacatggtggatcagggagtcgtgaaaccactgtgcgatcttttggtatgcccggatccaaggattatcaccgtgtgtctagaaggactagagaacattctgaaagtcggggaagctgagaaggtgacgggaaacacaggggatgcaaactattatgcacagctaatcgatgatgctgagggactagagaagattgagaatctgcagagtcatgacaacagcgagatatatgagaaggcagtgaagattcttgaaacatactggttggaggaggaagacgagactttaccaccgggtgatgaatctgctcagggattccagtttgggggtagcgatgcagccgcacctccaggtggattcaacttcaagtgaaggagctaagcatgatgattgaagagtcaaaggaggtcaagagtcttgggggcactggttttaaatggggtctgatttgagtctggtcttgtgtttaaaagtcagatgggggtgccttggtcggtcctgatcttgtctggtcagatggtgggattgagtcataaaataagctttgttgggggagttgggtaggagtcaatgagagggggaatattttatgaactctaaatgggaaaatttgggtggtctagttatgttgtttggtgagtctctgggggctttgttatattagttactacacaacagtcattgcaaagtcaaaaaacataaaaaagttggtcaaacattttctggtcttattggtggtggcaaagaaagcccacttggtgcgtctctttattttgttaatatttttttatctatctgttttcctgtgcggtccaagtcatgttgggctattgttgtctacatatgcacgcttttctatatattatatattactaatgtcttttcttttcaaagtattatgtcccataaatcgatgttattaatgcttatcgtcaacttcgattaagtaggggttatatatattccaatatttttgttcaaagtggaaagtctgggattataggcattattaaaaagatcctacttttaag

SEQ ID NO: 5024 - DNA, 1605 bp, Tabernaemontana elegans
tcctcaacggagctctccctgtgaggcactccaggttttgattgattgactgtggagaagggaccaacagagcaggaaagatgtcgctgagaccgaatgaaaggacggaggtacgtcggaacaggtataaggtggcggtggatgctgaagaagggaggcggaggagggaggaccaaatggtggagatccgcaaaagcaagcgtgaggaaaatctgctgaagaagagacgagaaggtcttcaaatttcagtattaccattctccacgaccaccccggctaataatgtggagaaaaagttagagagccttctttctatggttactggggtttgttcaaatgatagtagtttgcagctggaggcaactactcagttccggaaactgctttcaatagagcgaagccctcctattgaggaggttatacaatctggagttgtacctcgctttgttgagttccttatgagggaggattttcctcagctccagtttgaggctgcttgggctcttacaaacattgcttctggaacctcggagaacaccaaggtggtgattgatcatggagctgtacccatatttgttaagcttctgggatctccaagtgatgatgttcgtgagcaggctgtatgggctttgggaaatgttgctggtgattccccaaggtgtcgtgaccttgtcctcagccatggagctttaattcctttgctgtctcaattgaatgagcatgccaagctgtcaatgctaagaaatgccacttggactctgtccaacttctgcagggggaaaccacaacctccatttgagcaggtgaggccagcacttccagcacttcaacgtcttgttacttcaactgatgaagaagtgttaactgatgcatgctgggctctttcgtacctctctgatggtacaaatgacaaaattcaagctgtaattgaggcaggtgtctgtcaccgacttgttgagctcctcctacatccatctccgtctgtgcttattcctgcacttcgcacagttggaaacattgtcacaggagatgatgttcaaacccagtttatcattgatgaaggagctcttaattccttgctgagcctgttgactcataatcacaaaaagagcatcaagaaagaagcgtgctggacaatttctaacatcactgctggaaacaaagagcagatacaggctgtgattgatgctcaactaattggccctctagtcaatctgcttcaaactgctgaatttgatataaagaaagaggcagcctgggctatttcaaatgctacttctggtggaactcatgatcaaattaagtacttggtttctcagggctgtataaagcctttgtgcgatcttcttgtgtgccctgatccaaggatcgttactgtctgtttagaagggctagaaaatatattgaaggttggggaagtagagaagagccttggcaacagtggagatgtcaattattatgcccaattaattgatgaagctgagggcttggaaaagattgagaacttgcaaagtcatgacaacactgaaatatatgaaaaagcagttaaaatactggagacatattggttggaggaagaggatgatgcagcattagttactggtg

SEQ ID NO: 5025 - DNA, 1823 bp, Saccharum officinarum
gccaccacacagttccgcaagttgctctctatagagaggagcccccccattgaagaagttatcaaatcaggtgtagttccaagatttgtgcagtttctcaccagagaggatttcccccagctgcagttcgaagcagcatgggctctcacaaatattgcttctggcacttcagaaaatacaaaggttgttattgatcatggggctgttcctatatttgtgaagcttcttgggtctgctagtgatgatgttcgtgagcaggctgtgtgggctttgggcaatgtagctggtgattctccgaagtgccgcgaccttgttcttgccaatggtgcgttgatgcctctgctagcccagttgaatgagcatgctaagctctccatgttgaggaatgccacctggactttgtctaacttctgcaggggaaagccacagccatcatttgatcagactaagcctgctctgccagcacttgcacgacttatccattccaacgatgaggaagttctcactgatgcatgctgggctttgtcatacttatctgatggcactaatgataagatccaagctgtgattgaagctggtgtttgcccccggcttgtggagctcctcctccatccatcaccttcagtgcttatacctgctctacgaactgttgggaacattgtcactggagatgatatgcaaactcagtgtatcattgatcatcaagctcttcctcgcctcctgaatctattgacacagaaccacaagaaaagcattaagaaagaggcatgctggacgatttcaaatattactgctggaaacaaagatcagatacaggctgtcataagtgctggcattatcggtcctttgttgcaactgcttcaaacagcagagtttgatatcaagaaggaggctgcttgggccatctcaaatgctacctctggtggttcccatgagcaaatcaagtacttggtggcagagggctgcatcaagccattgtgtgaccttcttgtttgtcctgatccgagaattgtaacagtttgtctggagggtcttgagaatattcttaaagtaggggagcacgacaagaccatgggtggtgcaacagctgatggcaatctctttgctcagatgattgatgaagcggaaggcctggaaaagatcgagaacctacagagccacgataataatgaaatctatgaaaaggctgtgaagcttcttgaggcatactggatggaggaggaagatgacgcaatggctactgctggggaagctgctcccgctgtttttgacttcagccaaggtggcaaccctcccgctggtggtggtttgaacttcaactgaatacagtctttaaccaaaagggcgttaattgatgggcttggcattggcttgtcttgacaatgtaatgtggtcgattccatgtgtgggataatggtttgtgctgggtccaataagctcaagattccgagggagatgggttagagattattcccaagcgagtcatggatatcaatattgcagggtctgtaacaggattataatcgttgaacatcagagtcctggtttttttagaaggctactttctagggtttgtgtcatttagttgtgtgttatatctggctactgtatagcctgagtccaatggtctgcaaggccgaaagacattcttgagtggtttggttttgaggttcctcaggaatggtctgtgttgtaggttgtccggagctgtaaacgtttaatggtttgagtatattgctcggccttgctttactacggttaatccaacctgttgaggctatataaatggcttccaaaaagctgtttgcaaaaaaaaaaaaaaa

SEQ ID NO: 5026 - DNA, 2111 bp, Zostera marina
aacccaaaatctagggtttttttcgtttctttctagcccgccgcatcttccatccgtttccttcgtctcgatcgggaaagtcaccgatccataagcagtcatgtcgctcagacctagtgcaaggaccgaggttcgtcggaataggtacaaagttacggtggacgccgatgaaggaaggagaaggagagaggacaatatggttgagatccggaagaccagaagggaggagagtctcctgaagaagcggagagagggcatgaattcccagcaacagttacttccctcccttagctcttccaacatggagaaaaagttggagagtcttccggttatgatctcgggcgtgtattccgacgatcataatctgcaggttgaagcgaccacacagtttagaaaactcttgtcgatagaacgtagtccaccaattcaagaagtcatccaagctggtgttgttccacgattcattgagtttcttatgagagaggatgttccccaattgcagtttgaagcagcttgggcacttactaatattgcatctggaacatcagatcatacaaaggttgttattgatcacggggctgttccaatttttgtgaaactactcggttcccccagtgatgatgttcgggagcaggctgtttgggcgttgggaaatgttgctggtgactctccaaaatgcagggatttgttctgaacaatggggcactacttcctctgttgtcacagttaaatgatcaggcaaagctttctatgatgaggaatgcaacatggactttgtcaaatttctgtagggggaaaccacagcctccatttgaacagacaaagcctgctcttcccgctcttcagctcctcattcattctaacgatgaggaagtccttactgatgcttgttgggcactctcttatctttctgatgggacaaatgacaaaattcaggctgtcattgaagctggagtttgccctcgtcttgttgagcttttactacatccttcaccgtcagttttaatacctgcgctaagaactgttggaaatattgttactggagatgatattcaaactcagtatatcatcaataataatgcacttccatgtcttcacaatcttttgactcaaaaccataagaaaagcattaagaaagaagcttgctggactatttctaacattacggctggaaataaggaccagatacaggctgttattgatgcccacttaatttccccccttgttcatttacttgcaactggtgaatttgatatcaagaaagaggcagcctgggcactctcaaatgctacatctggtggtaataatgatcagatcaagtttcttgtaaatcaaggatgtattaagccattgtgtgatctgattgtctgttccgattctcgaattatcaccgtgtgcttagaaggacttgaaaatattctgaagataggtgaagttgagaaaaatatgggaggaactgagggtgtgaacatctatgcacaaatgattgatgaagctgagggtctggagaagatagagcatctgcagaaccatgataacactgaaatctatgagaagtctgttaaaattctagagacgtattgggtagaagaggaagatgatgcaatgccttctggggatgccacccaagctggattcgactttggaaacaatgttgcaacagctcctgctggtggattcaactttggctgaaggctcacagtcgtttgcttgagggggttggtctttccattgcatgtagcaatgtcgttgtttcatgtcggtcggtcctgtcagtctgtcagtcagtcagtcctgttggttcacttatgcgttgtgctggtgggcgaacaataaacctaggctgtgccctgtcattgatctaagtattgaagggagcctattatctggtctttggtttctcatcactagtctattgaaaatttatattattaacgaactaggatgggatgagtcatgagtcaggttttgtgtgtgtttgttttatacacacgggattttttttgcttctcttcaggtaacgagtctattgtctgtctcatgtatagaacgggaagtcttttttatcagtttttttaatcaatgattcttagtaatttaaaattgcgttc

SEQ ID NO: 5027 - DNA, 2363 bp, Ricinus communis
caggggttgcaattggaagtagaaaaccaaaaaaccctctctctataaacaccatcccctcatttcaatcccaccctgcaaatataaattccaaaaacccttcttccctcctctctttctttttctctctctaaaaaacgccaagtactcctctctctctatctctttcctaaaaaatcagtcgttggttttctgtattcgattagagacgatgtcgttgaggccgagcgcgaggacggaggtgaggaggaacaagtacaaagtggcggtggatgcggaggaagggaggaggaggagagaagaaaatataattgagatccgtaagaataagagagaagagaacttacagaagaagcgacgtgaaggacttcaagctgctcaacagcaacaacttacttcttccttcgctaatgccactattgataagaagttggaaagtcttcctgcaatggttgcaggtgtttggtcagaagacaagaatgcacagctcgaggcaaccactcatttccgaaagctgctctcaatagaacggagtcccccaatcaatgaagttgtacaatccggcgttgttcctcgtttcattgagttcctcgcaagggatgattttccacaactccagtttgaggctgcgtgggctcttacaaatattgcctctggcacatccgaaaataccaaggttgtaattgatcatggggctgtccctatttttattaagcttttaagttcgccaactgatgatgtcagggaacaggctgtctgggcattaggaaatattgctggtgattcacctaagtgtcgcgattttgtccttggccatggggccttgatgccattgcttgcacagttcaatgaacatgcaaagctttctatgttgagaaatgcaacttggacgttatctaacttttgcaggggaaagccacaaccttcatttgagcagacaaagcctgctctcccagctcttgaacgccttatacattcaaatgacgaggaagttcttacagatgcatgctgggcattgtcttatctctcagacggaaccaatgacaaaatccaagctgttattgaggcaggtgtctgccctcgacttgttgaacttttacttcatccatctccaacggtgctgattcctgctctacgtacagttggaaatattgttactggtgatgatatgcagacacagtgtatgataaaccatcaagcgcttccatgtcttttgaacctcctgacacataattataagaagagcatcaagaaagaagcttgctggacaatctcaaacattacagctggaaatgtaaatcaaattcaggctataattgatgccgatctcatcggtcctctcattcaactacttcagattgctgaatttgagattaagaaagaggctgcttgggcaatttcaaatgctacttctggtggcacccatgaacaaatcaagtacttggtgagccaggggtgcatcaaaccattgtgtgatctcctaatctgccctgaccccaggatagtgacagtttgcttggaagggcttgagaacattctgaaggttggcgaagctgagaaaaatttgggcaacactggagatgcaaatttgtatgcccaaatgattgatgaagctgagggattagaaaagattgagaatcttcagagtcatgacaacaatgacatatatgagaaagcagtgaagattctcgagacgtactggctggaggaggatgaagacgaagcattggctccagctgatgcttcccaatcaggatttcactttggaggcaatgaagttcctgcgccttctggtggatttaagtttggttaagaatattagatgactggtggaatgaagctgagagtccaggttcctgttttggttggatggtgcaagcattttatcatttctcctaatttggtccacatccagatgcaattgaataaagcaggttatcacgccaagagtttcatcaaatggttaatacttgtcgcagatcattgacattgctggtggagattacacaaacaatagagtccttttgttttctttttttaaaatcttctgtcatttttttttttttttttcctctagtttttgattccatggatggacatgtgaggctgcccatcgcaacctgcatgcattattccttgtttactcaattataggaatagaggctaaaagtgctaaaatactctgcttcccagaggtcgttgaacgacaaatttggatctcaaaattttgtctttcttgattggaaaggtgtatcaaagttttagtttggagtacaataatttttttggttggtctattattgtgaatgtcaaaacaatatctggttcttgaataattacgtatcctaattgcttcaaagaat

SEQ ID NO: 5028 - DNA, 2594 bp, Gossypium raimondii
gagcggtagtagatttaacaatatttggagcgagaccgctagattactatccttccgtttttaagtctttcctaactctccgctggcccttttctttctcatttttgctttgaactttaaaatacttctccacaaagaaaaaattcccatcaactccagattttttcacttcttccgatcctcaataaaaatctccattttttttcttttagctttgtgcttccctaggatttgtttttttcaaaggcaagcagccgccactatgtcgttgagaccgagcacgagaaccgaggcccgccgcaaccgctacaaggtggcggttgacgccgaggaaggccgtcgtagaagggaagacaacatggtcgagatccgtaaaagcaagcgcgaagagagtttactaaagaaacgccgcgaaggcctacaagctcaacaattcgctgcttctcttcactcctctaatgtcgaaaagaagctggagagtcttccttcgatggttgctggcgtttggtctgataacggtgctgcacagctggaggcgactactcagtttcgaaaattgctttcgattgagcgaagtcctccaattgaggaagttatacagtcaggcgtcgttccccgttttgttgagttccttggtagggaagattttccacagcttcagtttgaggctgcttgggcgcttacgaatattgcttctggaacctcagacaatacaaaggtagtaattgatcttggtgctgttccgatttttgtaaagcttcttgcttcaccaagtgatgatgtccgcgagcaggctgtgtgggcattggggaatattgctggtgattcccctagatgccgtgatcttgttctcagtcatggagctttgatgcctctattagcacagttaaatgaacatgctaagctgtcaatgctgagaaatgcgacttggacattatcaaatttctgtaggggcaagccacagcctccatttgagcaggtgacaccagctctacctgcgcttgagcgtcttgttcattcaaatgatgaagaagttctgactgatgcctgttgggctctctcgtatctgtctgatggtacaaatgacaaaattcaagctgtgattcaagcaggagtttgcccacgccttgtcgagctcctgctcaatccatctccttcagtgctcattcctgctcttcgtactgttggaaatattgtgactggagatgatttacagactcagtgtattattgatcatggtgcattagcatgccttatgaacctattgaccaataattataaaaagagtatcaagaaggaagcatgctggactatctcaaacattacagctggaaacaaggaacagattcaggctgtgatcaatgctggattaattgggcccctggtcaacctacttcaaaatgctgaattcgatgtaaagaaagaagcagcatgggcaatttcaaatgctacttcgggtggtgcccatgagcaaatcaagtatatggtcagtcaaggatgcataaaaccactgtgtgatctccttgcatgccctgatccaagaattataatggtctgtctagaggggctggagaactttttgaaggttggtgaagctgagaaggccacaggtgctgtagaatttaacttctgcgcccaactgatagaagatgctgatggtttagagaagattgaaaatctacagactcatgataatagtgagatatatgagaaggcagtcaagattctcgagacttactggctggaggaggatgaagagacgctacctcctgctgacggtactcagcaaagttttcagtttggggagaatgggcttcaagttccatccggtggattcaacttcagttgaagggtttatagaataaacagttcgtaatgcgggttacgactgatacttgggtttggtcagggcaccatgatgtgtctggttacataaaagtctgtccagagtccactgttgtgaagaaggtgcttgggtaagtctattgagacctggtttccggtacagaggggaataggtaccattgtgaccagaaaagttgtgggcaaggtattttgcttgtcttaaaccaaaaaaattacatgtgaaatagtacaatgcaaggccttgggaggtgtttcttaagcttgtcactgtttatacagcgcccctttagtgtaaacgggcatgctagtttaccaggtttcggtatttgcctcacagttgttttgagtccagagtttttcgggttttagaaggtcagtatttgttgtctcgtaccataacgtgatatgatagtgtgattaatagtacacgagtggtaaatgggttaaaatttctatagaagtacgatacacatcaaatgtgataaaatgtgtcatgttaagattcgtattacgttcaaaaccatattttattttccatttatattttaatttatttaaaataaaaacagctgtgataaaaattaaaattttgtttaaaatatttaagttctgtaccaactagtgtgtgctagtacaaaaattgtatttgaagtacattgaaattttgactggaatagagtttgaattatttgatactgatttaaaataaaaatcgtacgttgtatcga

SEQ ID NO: 5029 - DNA, 1675 bp, Manihot esculenta
tctattgccgatcatgtcgctgaggccgagcgcaaggacagaggtacggaggaacaagtacaaggtggcggtggacgcggaggaggggaggaggaggagagaggacaacatggtggagatccggaaaaataagagggaagagagcttgcagaagaagcgacgcgagggactgcaggcccagcagcagcaactcacctccttctccaattcctctactaccgataagaagttagaaagtcttccagcaatggttgcaggtgtttggtcagaagataggaactcacagcttgaggcaaccactcattttcgaaagctgctctcaatagaacgtagtcctccaatcaatgaagttgtacagtctggtgttgttccacgtttcattgagttccttgcaagggatgactttccacagcttcagtttgaggcagcatgggctctcacaaatattgcctccggaacatcagaaaacaccaaagttgtaattgatcatggggctgtgccaatatttattaagcttttaagttcacccactgacgatgtcagggaacaggctgtctgggctctaggaaatattgctggtgactcacctaagtgtcgcgatcttgtccttggctgtggggctttgatgccattgcttgcacagttcaatgaacatgcaaagctttctatgttgagaaatgcaacctggacgttgtctaacttctgcaggggcaagccacaacctttatttgagcagacaaagcctgctcttccagctcttgagcgtcttatacattcgaatgatgaggaagtcctgacagatgcatgctgggcactgtcttatctctcagatggaaccaatgacaaaatccaagctgttattgaggcaggggtctgccccaggcttgttgaacttttgcttcattcatctccaacagtgctcattcctgcattacgtacagttggaaatattgtcactggtgatgacatgcagactcagtgtatgataaaccaccagactcttccatgccttttgaacctcctgacccataattataaaaagagcatcaagaaggaagcatgctggacaatctcaaacatcacagctggaaacataaatcaagtacaggccataattgaagctggtatcattgcgcctcttgtgcaactgcttcagaatgctgaatttgaaatcaagaaagaggctgcttgggcaatttcaaatgctacttctggtggtacccatgaacaaatcaaattcttggtgaaccaggggtgtatcaaaccattatgtgatctcctaatatgtccagaccccagaatcatcacagtttgcttggaaggacttgagaacatcctaaaggttggagaagctgaaaaaaatttaggcaatactggagatgcgaatctgtatgcccaaatgattgatgatgcagagggattggaaaaggttgagaaccttcagagtcatgacaacaatgacatatacgagaaagcagtgaagattcttgagacatattggctggatgaggaggatgatgatgaagcaacacatcagggtgatgctcccgtagatggatataactttggaggaagtgaatttactgttccttctggtggatttaaatttagttgaggatataaagtctggtggaatgaagctgagagtcctggttcacgttttggttgggtggtg

SEQ ID NO: 5030 - DNA, 859 bp, Sorghum bicolor
caaaaagtctccttcctcggtgttcctctttctcctaccgcttgctggcttcccagcttccgctccaatggcgtctcttctcttcgtcccacgccccacccggagcgcatgcgcgaagaccggacccagtgccactcacaagcctaggcgcgtctccatcacctgcgggccgcgcgacaaccgcgggccactccagcgcggccgctccctctccacggaggccatcctggcgatccaatccctaaagcgcctgacctccgcggaccgctcgccggcagctgccaccgccgccgccgccaccgccctgggccgcctcctcaaggcggacctcgtggccgccatggccgagctccagcggcagggccactggtccctggccctcgccgtgcttcacgtcgcccgtgcggagccctggtaccgcccggacccggcgctctacgccaccttcgtctcctccgcgccaacctcctcgccctccggcgaggccgaggccgccgtggacgcgctcgtggaggcgttcctggaggagaaggcgcgcggcggcgggttcgtggacggggaggaggacgtgtacaagctcacgaggctgctgcgcgcgctggtggccaaggccaggggccgcgcggcgtggaaggtatatgaggcggccgtgaggaagggaggcctcgacgtcgacgagtacgtgtacagggtgatggcgcgggggatgaagcggctggggctccacgaggaggcggcggaggtggaggccgacttcgccgagtgggaggccacggtctcgccgcccgccagggacgtgctcgacgaaatgcgagcgagagacgagagcaagacgactgcctctgccacttagtccgcc

SEQ ID NO: 5031 - DNA, 1831 bp, Sorghum bicolor
tttcatccctactagccattttcatgggatctatcaaaaaatcagtcttcatataaagggcttgttttggtaggtctccaattcgagctaaaacaactttaggccttgtttagttcacctcaaaaaccaaaaacttttcaagattcttcatgacattgaatcttgtggcacatgaatgaagcactaaatatagacaaaaataaaaactaattgtacagtttacctataaatctaaaaacgaaagtgctacagttccgaataccaaaaagtttccggaactaaacaaggccttagttgtagctttgcttgtgaagcagattcacttgagaggtaaaagctgttttttttttgttgtttggtagtttagaaagggtaaaatatccataataccctcattccttttcctttttccttttttctcttttcttttttttctttccctataccttatccggtccctcgcgttgcaaccgcacggccccgcacgcgttcgctcgcgtcttcaacctctggaagccgagctcctatcccgccgccgcctgcgcctggaagcgctcccggccacgggccaccggaggcgccgcggctccctcctccgcgcgccctccgtcccgcacctccccgcgctcctccgcccggaagccggcgtccgacggacccgcgccgcccgcccccgacggcctcgcgcacagagctccggcgacctcgcgcccgcacggctcggtcggggcaaaaacgcccatcgccctgcgcggggcccacggcaaccgagcggagctgggagaagctcgtccacacggaggtgtacgggcacttaagcgtgacaaaaagtctccttcctcggtgttcctctttctcctaccgcttgctggcttcccagcttccgctccaatggcgtctcttctcttcgtcccacgccccacccggagcgcatgcgcgaagaccggacccagtgccactcacaagcctaggcgcgtctccatcacctgcgggccgcgcgacaaccgcgggccactccagcgcggccgctccctctccacggaggccatcctggcgatccaatccctaaagcgcctgacctccgcggaccgctcgccggcagctgccaccgccgccgccgccaccgccctgggccgcctcctcaaggcggacctcgtggccgccatggccgagctccagcggcagggccactggtccctggccctcgccgtgcttcacgtcgcccgtgcggagccctggtaccgcccggacccggcgctctacgccaccttcgtctcctccgcgccaacctcctcgccctccggcgaggccgaggccgccgtggacgcgctcgtggaggcgttcctggaggagaaggcgcgcggcggcgggttcgtggacggggaggaggacgtgtacaagctcacgaggctgctgcgcgcgctggtggccaaggccaggggccgcgcggcgtggaaggtatatgaggcggccgtgaggaagggaggcctcgacgtcgacgagtacgtgtacagggtgatggcgcgggggatgaagcggctggggctccacgaggaggcggcggaggtggaggccgacttcgccgagtgggaggccacggtctcgccgcccgccagggacgtgctcgacgaaatgcgagcgagagacgagagcaagacgactgcctctgccacttagtccgccagggatttttcttttttatggttttgtttagatttgagaagtttttgtattttgacactgtagcatttttgtttttatttgataaatattgtctaattatggagtcactaagtttaaagatctatatttaatgctacatgcatgagtc

SEQ ID NO: 5032 - DNA, 1028 bp, Setaria italica
cctcgcttccgtccactccaatggcgtccctcctcttcgtcccgcgccccacgccgggctcgcgcccagcgccggcgcccacggcgcggcccaggacggtctcaatcatcacctgcggcccgcgggacaaccggggcccgctccagcgggggcggtccctctccacggaggccatcctgggcatccaatccctgaagcgcctcaccgccgcggaccgctcccctgcggcggcctccgcggcggccgcgtccgcgctcggccgcctcctcaaggccgacctcgtggccgccatggccgagctccagcgccagggccactggtccctcgccctcgccgcgctccacgtcgcgcgcggcgagccctggtaccgcccggacccggcgctctacgccaccttcgtctcctccgcgccggcggcggcggcctccggcggcgacgacgaagcgggcgccgccgtggacgcgctcgtggaggcgttcctggaggagaaggcgcgcggcggcgggttcgtggacggggaggaggacgtgtacaagctcaccaggctgctgcgcgcgctggtggcgagggacaggggacgcgcggcgtggaaggtgtacgaggcggcggtcagggagggaggcctcgacgtggacgagtacgtgtacagggtgatggcgagggggatgaggaggctggggctcgacgaggaggccgcgttggcggaggcggacctcgccgagtgggaggccaccatctcgccgcccgccagggacgtgctcgacgaaatgcgcgcgagggacaagagcaagacgaaagcctccgcgtcgtagcttctgatgactcgtgtttagttcagcttcaaattagtactagcgatttttgatctagaaagataaaagtgttctactgctgtaactatggtgaactgttgagttggtgagaaatcacaccaccgctaggctgcttgttcagtttgtccatattttgttcagcaacagtttgttcatattttaagttacctgggcaaatggcccgcaagacacggg

SEQ ID NO: 5033 - DNA, 3003 bp, Setaria italica
cagaggggagacgacgggaagaaaaactcgaagacgcagccgacgagctccgccgccggagctcagagatggacgacggaagcgcctccgcctcgccgtcctccgcttctccgcaccagcaccaccgcgacgcaatcaagtcctcagtgcacaattcagcatctagccggaggagggaacatgctattgcagtagggaaggaaagaagggaagccttgatgcgtgcaaagcgtgtatgtcgggctcctctttctggcaatgatgagactgtgatggaagagggcgatatggtcattgatgagaagaaggcagatcttgaggcacagacagctcaagctgttgaagaactgaaatctgctttatctacccagggaaaaggggctcagaagaagaagatagaggtgcttcgtgctttaagacgattattgtcacagtctgaagtacctcctgttgaagcagcaattaaagctggagcgatccctcttctagtgcaatatctgtcatttggatcatcagatgaacagttgctagaggcagcttggtgccttacaaatatagcagcaggggaaccagaagaaactaagtctttattgcctgctctaccattgctcattgctcaccttggtgagaagagctccacccttgttgctgagcaatgtgcatgggccattggtaatgttgctggtgaaggagcagacctgagaagcaaattacttgctcaaggtgctttgtggcctcttgcccgtttaatgctgtcaaacaagggttctacagcaaggactgcggcttgggcattgtcaaatcttatcaaggggcctgatcccaaggctgcgaatgagcttattagcattgatggtgtgctgaatgcaatcataaggaacttggagaaagcggatgaagagctagcaactgaggtggcgtgggtagttgtttatctttcagcactttcagaaaaagctaccagcctaatagtaagaagttctgtgccacaattgttgattggacgcctcctagcatcagagaacttgcaattgctcattccggtacttcgcagtttaggaaatcttgtagctggtgatggatacatggttgattcagtcctaactgttggaaacagtatcacagatcaagccttatcgagtcttataaagtgtttgaagagtgacaatagggttctcaaaaaggaggcatcatgggccatgtcaaatattgcagcaggcagtttcgagcacaagaaattgatttttgccagtgaggcaatgactttgctgatgcacctccttacgactgcacaattcgacatccgcagggaagcggcatacaccctgggcaatatgtgtgttgtcccagcaggaaatgctgcgcctccaaacataattgtggatcatttggtcgctatcgtaaatggtggagcccttcctggatttataaatttggtgagatctgctgatatagaaagtgcgagacttgggcttcaattcctcgaactggtgatgagggggtaccccaatgggcaaggtccgaagctcgtggagagcgaggacggcatcgaggctatggagaggtttcagttccatgagaacgagctgatgaggaatatggccaacgggttggtcgacaaatactttggcgaagactatggcctcgagtgagttcctggtgccatgcatacatctgcgtaaacttgaagctcttgatgggttgaaaatgtgaattgtgaaatgtactctcacggtcctcgaacagaaggatgtgctgatcagatcggtggccatgtaacttagcccttgataccaatgcatcggatgctgtagttggaaaatgtgagtgcgtgaagcgtgaactgactatgaactaaggatatgctagtaaactgtcgatatgcatcgctttggcatgttgtacgatatccaagtgctgaaataaaaatgacctgctgtttcccgtgtcttgcgggccatttgcccagtttaacttaaaatatgaacaaactgttgctgaacaaaatatggacaaactgaacaagcagcctagcggtggtgtgatttctcaccaactcaacagttcaccatagttacagtagtagaacacttttatctttctagatcaaaaatcgccagtactagtttgaagctgatttaaacacaagtcaccagaagctacgacgcggaggctttcgtcttgctcttgtccctcgcgcgcatttcgtcgagcacgtccctggcgggcggcgagatggtggcctcccactcggcgaggtccgcctccgccaacgtggcctcctcgtcgagccccagcctcctcatccccctcgccatcaccctgtacacgtactcgtccacgtcgaggcctccctccctgaccgccgcctcgtacaccttccacgccgcgcgtcccctgtccctcgccaccagcgcgcgcagcagcctggtgagcttgtacacgtcctcctccccgtccacgaacccgccgccgcgcgccttctcctccaggaacgcctccacgagcgcgtccacggcggcgcccgcttcgtcgtcgccgccggaggccgccgccgccggcgcggaggagacgaaggtggcgtagagcgccgggtccgggcggtaccagggctcgccgcgcgcgacgtggagcgcggcgagggcgagggaccagtggccctggcgctggagctcggccatggcggccacgaggtcggccttgaggaggcggccgagcgcggacgcggccgccgcggaggccgccgcaggggagcggtccgcggcggtgaggcgcttcagggattggatgcccaggatggcctccgtggagagggaccgcccccgctggagcgggccccggttgtcccgcgggccgcaggtgatgattgagaccgtcctgggccgcgccgtgggcgccggcgctgggcgcgagcccggcgtggggcgcgggacgaagaggagggacgccattggagtggacggaagcgaggaagcggaaggggaagagaggagaggagatggg

SEQ ID NO: 5034 - DNA, 864 bp, Setaria italica
caaaatcccatcagaaacccatctcctctcctctcttccccttccgcttcctcgcttccgtccactccaatggcgtccctcctcttcgtcccgcgccccacgccgggctcgcgcccagcgccggcgcccacggcgcggcccaggacggtctcaatcatcacctgcggcccgcgggacaaccggggcccgctccagcgggggcggtccctctccacggaggccatcctgggcatccaatccctgaagcgcctcaccgccgcggaccgctcccctgcggcggcctccgcggcggccgcgtccgcgctcggccgcctcctcaaggccgacctcgtggccgccatggccgagctccagcgccagggccactggtccctcgccctcgccgcgctccacgtcgcgcgcggcgagccctggtaccgcccggacccggcgctctacgccaccttcgtctcctccgcgccggcggcggcggcctccggcggcgacgacgaagcgggcgccgccgtggacgcgctcgtggaggcgttcctggaggagaaggcgcgcggcggcgggttcgtggacggggaggaggacgtgtacaagctcaccaggctgctgcgcgcgctggtggcgagggacaggggacgcgcggcgtggaaggtgtacgaggcggcggtcagggagggaggcctcgacgtggacgagtacgtgtacagggtgatggcgagggggatgaggaggctggggctcgacgaggaggccacgttggcggaggcggacctcgccgagtgggaggccaccatctcgccgcccgccagggacgtgctcgacgaaatgcgcgcgagggacaagagcaagacgaaagcctccgcgtcgtagctt

SEQ ID NO: 5035 - DNA, 1236 bp, Zea mays
cgaaccacatggcccaaaaaccctgaactgagcccgccgccgcttctccagtccgcacgaagcgcaccacaaaaaacgacggcaacgccggagtacaagaacctcaccttggaccacatcctgggcgacccctcaatccccaccgcagccgccataacgttaatagccggtatcccctcaccatccgatccgaccccgcgcctccgccgcggggtccttatccgccgcctcgccgccgaccccgtctccaatcctctctcgaaaccctccacctcctggcctcgctcccgccctgcgcctcccccatcgcagccgcccacatcgccgtcgcggcattcctcgcggcctccgcgcccgacttcgacgccgtcgccagggctctcttcgcgcgccccgacggccgcgcgcgccaagcggtccacggcggaggttcccccgcgctcgcatccgacgatgccatcgtcacagtggaccagttcgaggctgccgtcgggaagtcctcttctcagaccattctcaggggcctgtggggcaaccgggccgccgtggaggagcgggtccaggagctcctcgccgctgaatgggccgcgattggcccgtcgaggctcgaggcgttggctatgcggatcgtcggggatggggccgtcgagacatgggctgccgcagatgaggccatgcgtgccaacttgcgcatcttggctggggaagaaaaaacgcgcgagattctcgacaaacttgaaaaatctacctgcagcacaaatccaatttcaacaccagctgttgagaaggttatgaatgcgctcaaagcaagctgtgctgacctccacagcattgtggaggatccccttccagctgcaaaggcagttgcagatgagttattggctgcgaggatggaaaaaagagttagcttgaatgctgaagtaggaggtcagccaacaacttgtggcgctgcaggtccgagtattcataatgacaaagacaacggtccaggtataggcaaacctcacagccttatggagcgaaacgcaacagcacgaacctctcagtgggaggagtcacatggtcttgatggttcggaaccaccatcaccaccgagaccgcgcttgcctagcccaaggagactaccaccttctcctttgccaccgcctgaacaaaacactaagcggagaagacagagtgagctgtcgaagagaaacttagaaaggtgtgagagtatgtactgtctgatgtcagtgt

SEQ ID NO: 5036 - DNA, 8323 bp, Triticum aestivum
aagatgaaagatgtacaatccaatttctcgattcaatagaagcccaaagaggtgcatatggtacccaaataagaataggatagatatgtcaaaagcaggtctgattacacctattcctaatcctaaatagaatgtaaggacgtagggatttctatgtaaacagagtatcctatttccataggctcgaatgaccccttctcataataagaatgtgcacggtctggttcggtatggaatgaacttataatctgatgatcgagtcgattccatgattataagttcataaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgattatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaacagcatataagttatcatgcttgcatatccatcatttgagtctccaacaattattccaataattacatatccgatttgccctatggacgaatatgcaagcatacgtttcatgcttgtttgagtaatagcaaggagattccccaaaatcatgctaagaatagctaggatttccagaagaagatgccattcgtttgatgagaaataaaaaggaatatcgagaattcgcgtggctgaagctgaagcagctactttcgaagtaacagaaagaaaagcaacgaagtggagtagggatccttcgtagacgtcaggagtccattgatgaaaaggggctagggaaagcttaaacccaagtcctacagtgatgaatataagcgcaattgaaattcctggggagttatacatttgtgtattgataagaccgttcacaatttcttgaagctcgatctcccccccagataaaccatatagccaagagaaaccataaaccagaatagaagagcttgccccacccatgagtaaatatttcatagtagcctcattagaccgtagatctctcttggtatatccagacaataggtaggaacataaactgaaacattctagagctacaaagatagttattaaatcgttagcaccacataaaaacattccccctagagtagctgttaatacgaataacagaaactctgttatagccatttctgtacattcaatgtactctacggatagaggaatacataaagttgaacataataaaatgagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccattgaagagaagcaaatgaaacgctttcataaaaattctcgtagaatcgagaatgaagttttcattctgtacatgccagatcatgaattagtaactgcatccaatctccgaaaagtcccgattgtttcgatttttgaaatgggatatttacggaatccccatgaataggatcaaaccttattccatgctatttccataagattcttctttcttattcttaagcaagccctcgagagggcttagttgatcatgatttctgttttctctttcttttcctttttgtttgtttcgagaaagatatcgtccgattctccttctattgattcttttccgatcgagatgtacggatccatgtgtctacatacatagattctgttcatggattaacgaaaatgtgcaagagctctatttgcctctgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaatcacttatttttttggctttttgaccccatattgtagggtggatctcgaaagataggaaagatctccctccaagccgtacatacgactttcatcgaatacggctttccacagaattctatagggatctatgagatcgagtatggaattctgtttactcactttaaattgagtatccgtttccctccttttcccgctaggatcggaaatcctgtattttccatatccatacgatcgagtccttaggtttccgaaatagtgtaatggaaaaagaagtgcttcgaatcattgctatttgactcggacctgttctgaaaaagtcgaggtatttcgaattgtttgttgacacggacaaagtaagggaaaacctctgaaagaatttccatattaaccttggacatataagagttccgaatcgaatctctttagaaagaggatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggttcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtatacaccctagcacatgttcctcgacgctgagggcatcctttaagcgcggccgtttttcgagcatttcgtattggctgtcttgcgtttctaataagttgtttaaccgtcggcatgttgtatgtatatagaaaaaaatggattggtttagatccatcttaacctgatgattgctcatcatgaagtctttctattttctattaaatcgaggaaaacacgaatttagctgtgaaataactttacaagaaatccggacactaccaatccttaaacatttctggaaaccacactggatcagtatcgcagtgcttgtcaatcatttcatcccctacaatatcgacaagtccataagctttggcttcgtctgctgacataaaaacatccctttccatgtcttcggatacaacccaaaaaggcttgcctgttcttactgcataaacccttgtgatcatttcgcgaactttgtgtaactcttctacttctagtaaaaattctggtgtccttgcccgataataagcactagcaggttggtgaagcataatcctcgcgtgagggaatgctatacgcttggtgggttctcctccaagcagaatgaaggatgccatggaggcggctattccgaggcatattgtatatatatctggtgtcaccgtttgcatcgtatcaaaaatagccattcctgagattagccacccgcccggggagtttataaacaaaaaaatatcactaattccatcttctatactcagatataccatgagacctgtaatatgattcgtgatctcgcaacgaatctcttgacctaaaaaaagtgtcctttctcgatacataacattgtataagtcaacccaagtcgcttcttcatctccaggaatccggtaaggtacttttggaacaccaatgggcatattagattaatattattaaatttaagtaagaaaaccacactttaatatggaaacgtaagaatggaacagaaagaaagaatccgcagtttattgtcttaatttttattcttattctatatgaatactatagattctattaatacgtagattgaaaggttatacatataaggaatgtaagacagattgaataaagaaaaaggaatgggtgattcgaatgctaaacaaagaggggtagcgatctattcttcgttttttccaaattggccaagttacccattgcatattggcacttatcgagtatagaatagatctgcttctctttcttcttatgaacagaattggcttcttatttttaatggaatgaaataaatattcgcgctttctgacacagaatcccctagaagggttaggtacataggatatggatagtctttttcaatgcgataaaataaagcgacatcgtgtctatttttctttgctaaaggggtatttccatgggtttgccttggtatcgtgttcatactgtcgtattgaatgatccgggtcgattgcttgcggtgcatataatgcacacagctctagtttctggttgggctggctcaatggctttatacgaattagcagtttttgatccctctgatcctgttctggatccaatgtggagacaaggtatgttcgtaattcccttcatgactcgtttaggaataacggattcgtggggtggttggagtatttcaggaggaactgtaacaaatccgggtatttggagttatgaaggtgtggcaggtacgcatattgtgttttctggcttgtgtttcttggcagcgatctggcattgggtatattgggacctagaaatattctctgatgagcggacgggaaaaccctctttggatttgcccaagatctttggaattcatttatttcttgcaggggtggcttgctttggctttggggcatttcatgtaacgggtttgtatggtcctgggatatgggtatccgatccttatggactaactggaaaagtacaagctgtaaatccagcgtggggtgcagaaggttttgatccttttgttccggggggaatagcttctcatcatattgctgcgggtacattgggtatattagcgggcttattccatcttagtgtccgtccgcctcaacgtctatataaaggattacgtatgggcaatattgaaactgtactttccagtagtatcgctgctgttttttttgcagctttcgtagttgctggaactatgtggtatgggtcagcaacgaccccaatcgaattatttgggcctactcgttatcagtgggatcagggatactttcagcaagaaatatatcgaagagttagcaatggtttagccgaaaatcttagtttatcagaagcttggtctaaaattcccgaaaaattagccttttatgattatattggtaataatccggcaaaagggggattattcagagcaggctcaatggacaatggggatggaatagctgttggatggttaggacatcccgtctttagagataaagaaggacgtgagctttttgtacgccgtatgcctactttttttgaaacatttccggttgttttggtagatgaggagggaattgttagagcagacgttccttttagaagagcagaatccaaatatagtgttgaacaagtaggtgtaacggtggagttctatggtggcgaacttaatggagtaagttattctgatcctgctactgtaaaaaaatatgcgaggcgttctcaattaggggaaatttttgaattagaccgggctactttgaaatctgatggtgtttttcgcagcagtccaaggggttggttcacttttggtcatgctacctttgctttgctcttctttttcggacacatttggcatggcgctagaacattgttccgagatgtttttgctggtattgatccagatttggatgctcaagtggaatttggaacattccaaaaagtgggagatccaactacaaggaaacaggcagcctgatacacattgttatagtatctttcacctctcttttttgatttgacatgggaaacatctcccatcctttctttgactctttttctttctttatatgggaaattatcccaaatgacaaatgaataggtgtggaagttataattgtaaataaaccaggatcgaatctatggaagcattggtttatacgttccttttagtttcgactttagggataatttttttcgctatcttcttccgagaaccacctaaggttccaccaactccaactaaaagaataaaataatttcatttaagtaagaagtccccctatctgggagacttcttacttaaattagtctccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacaccaatgattaaatagaatttatggctacacaaaccgttgaagatagttctaaacctaggccaaaacgaactggtgcaggtagtttactgaaacccttgaattcggaatatgggaaagtcgccccgggttgggggactactccttttatgggggtcgcaatggctttattcgctatattcctatctatcattttagaaatttataattcttccgttttactggacggaattttaaccaattaggtttctactaactaaaactaggaagtcagagtttttccatccaaaaaagcctttctagtttaagatctacatttctagatattatggtagttcgaccgcggaatttttttgtttcggtatctctggaatatgagtgtgtgacttgttagaattgatcctattgataatacatagaaagggcctgttatctctatcaagatgattctaattcgtcagatattatttattctagtatctggaacacgaaatagatagagtggatcaaaaaaaaatggaactatgattcatactcactattaagacctcgcaaccagactgaaaaattcaagtagttcttaaataaaaataaaaaagaaattttcttccttccaattttgtttgcccaaaagacaactttttttctctcgattttgtcgagtcattacactgattcaataaatgattatcaagcggttcttattcgaagaacccttgccttttgtttagcttgagactaaatcatcgtggctctagtatgaatctaaggttttaattgaactgattcataggatctcaacaagataatttctatattatgcataaaaaacaaatcctttatagggaagagaaaagtcaagaagcctctaatgaccaacataagggaaaggaagaaagaaagacgcgccaacttgagattttttggcattatcatcacaaagaagatattccggatttttcttatttgatatcttcaaggcaaatcgacccaattcagtggctgatgaagttttgaacctttttctaatattcgttgaaaatttttgtgtttctgcttgagccgtacgagatgaaattttcatatacggctcttagagggggactcgggttagttacctatctcaataaagtatatgatttggtttgaggaacgtcttgagattcaggcaattgcagatgatataactagtaaatatgttcctccccatgtcaacatattttattgtttagggggaattacacttacttgttttctagtacaagtcgctaccggttttgctatgactttttactaccgaccaaccgttacagaggc

SEQ ID NO: 5037 - DNA, 4519 bp, Amorphophallus konjac
agttccgaaggaactgtagctacatctcttttcaatttccattcaagagttctatgtgtttccacgcccttttttgaaacctcgaaaaatgaaatggacaaattccttttcttgggaacacatacaagattcgtcactacaaaaaggataatgcccaccattaactacttcatttattaacatagtattaattcatttattaacatagtattaaatagtaatagaaatacatgtgacagaatttgtaacttgttatcctcttgcctagcaggcaagaatagacttccgtggaaagactgattcattcggatcgacatgagggtccaactacattgcattgctagaatccatgttgtatatttgaaacaggttgacctccttgcttctcttcatggtacaaccctcttcccgcggagccccctttctcctcggtccacagagaaaaaatataggactggtaccaacagttcatcacggaaggaaggactcaccgagccggggcaactaactaatactaatataatagaaaagaatagaaaagaaataatagaaaagaatagaaaagaactgtcttttctgtatactttccccggttccgttgctaccgtaccgcgggccttacgcaatggatcggatcatatggatatcccttcaacacaacataggtcatcgaaaagatctcggacgactcaccaaagcacgaaagccagaatctttcagaaaatggattcctatttgatttgaagagtgcataaccgcatggataagctcacactaacccgttaattttttttggatccaatttgggattttccttggaaggtatcgggaaagaattggaatgtaataatatcgattcatacagaacagaagaaaaggttctctattgattcaaacgctgtacctatgggatagggatagaggaagaggaaaaaaaccgaagatttcacatattacttttgatcgaaaaatcaatctgatttatttcgtacccttcgctcgatgagaaaatgggtcagattctacaggatcaaaactatgggacttaaggaatgatggaagggaataaaaaaagagagggaaagacaagaaatcgaaatgaaataaagaataaaacaaaataaaaatgaaaatcaataagtaaataaataagtataagtataagtagaagaacccagattccaaatgaacaaattcaaactcgaaaaggatctttcttattctcgaagaatgagggacaaagggattgatcgagaaagatctcttgttcttattataatataagtgatttgatccgcatatgtttggtaaaaagaataatttgattataatcaaaaatggaaagtgttcaattggaacataaaaacgtgactgaattggtgttagttactcttcgggacggagtggaagaagggaggagattctcgaacgaggaaaaggatccaattacttcgaaagaattgaacgaggagccgtatgaggtgaaaatctcatgtacggttctgtagagtgacagtaagggtgacttatctgtcaacttttccactatcacccccaaaaaaccaaactctgccttacgtaaagttgccagagtacgattaacctctggatttgaaatcactgcttatatacctggtattggccataatttacaagaacattctgtagtattagtaagaggaggaagggttaaggatttacccggtgtgagatatcacattgttcgaggaaccctagatgctgtcggagtaaaggatcgtcaacaagggcgttctaaatatggggtcaaaaagccaaaataagtgattcgtttttagcccttataaaaagatgattcttgaacctctttcacgctcatgtcacgtcgaggtactgcggaaaaaaaaactgcaaaatccgatccaatttatcgtaatcgattagttaatatgttggttaaccgtattctgaaacacggaaaaaaatcattggcttatcaaattatctatcgagccatgaaaaagattcaacaaaagacagaaacaaatccactatctgttttacgtcaagcagtacgtggagtaactcccgatatagcagtaaaagcaagacgtgtaagcggatcgactcatcaagttcctattgaaataggatctacacaaggaaaagcacttgctattcgttggttattaggagcatcccgaaaacgtccgggtcgaaatatggctttcaaattaagttccgaattagtagatgctgcaaaagggagtggcgatgccatacgcaaaaaggaagagactcataaaatggcagaggcaaatagaacttttgcacattttcgttaatccatgaacagggtctatatagacacatagatccatggatccatacatctcgatcggaaaagaatcgatagaaaaagaaagaattggaattgatcgatatctttctcgaaacaaacaaaaaggaaaagaaagatgaaatataaatcatagatcaactaagctctctcgggggcttgcttaagaataagaaagaggaagattatggaaatatcatggaataagatttgatcctattcatggggattccataaatatcccattaccaaaaaaaatatagaaagttcgaaacaattgggactttttcggcgattggatgcagttactaattcatgatctggcatgtacagaatgaagttttcattctcgattctacgagaatttttatgaaagcgtttcatttgcttctcttccatggaagtttcattttcccagaatgtattctcatttttggcctaattcttcttctgatgatcgatttaacctctgatcaaaaagatagaccttggttctatttcatctcttcaacaagtttagtaatgagcataacagccctattgttccgatggagagaagaacctatgattagcttttcgggaaatttccaaacgaacaatttcaacgaaatctttcaattttcttattttactatgttcaactttatgtattcctctatccgtagagtacattgaatgcacagaaatggctataacagagtttctgttattcgtattaacagctactctaggaggaatgtttttatgtggtgctaacgatttaataactatctttgtagctctagaatgtttcagtttatgttcctacctattatcaggatataccaagagagatgtacggtctaatgaggctactacgaaatatttactcatgggcggggcgagctcttctattctggtttatggtttctcttggctatatggtttatccgggggggagatcgagcttcaagaaatagtgaatggtcttatcaatacacaaatgtataactccccaggaatttcaattgcgcttatatccatcactgtaggaattgggttcaagctttccccagccccttttcatcaatggactcctgacgtatacgaaggatctcccactccagtcgttgcttttctttctgttacttcgaaagtagctgctttagcttcagccacgcgaattttcgatattcctttttatttctcatcaaatgaatggcatcttcttctggaaatcctagctattcttagcatgatattggggaatctcattgctattactcaaacaagcatgaaacgtatgcttgcatattcgtccatcggtcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggtcttcctccactagcaggttttttcggaaaactctatctattctggtgtggatggcaggcaggcctttatttcttggtttcaataggactccttacgagcgttgtttctatctactattatctaaaaataatcaagttattaatgactggacgaaaccaagaaataacccctcacgtgcgaaattatagaaaatcccctttaagatcaaacaattccatcgaattgagtatgactgtatgtgtgatagcatctactataccaggaatatcaatgaacccaattcttgcaattgctcaggataccctcttttagcttctagggtctatttcttagttcaagatccctcttactaactggaataaaagaattagtagatctgttctgcccaaaacgggaatgggctggcgttatgaacttataatcatggaatcaactcgatcatcagattataagttcattccataccggaccagaccggaatagggttatgtacattctcattatgagaaggggtcattcgagcgtatgcatatgtaaatagatactatgtttacatatggatccctacgtcgtgacattccatttaggattagtaatgggcgtaatccgacctgcttttgatataatctaatcgttaatttgat

SEQ ID NO: 5038 - DNA, 1536 bp, Sorghum bicolor
atgatctggcatgtacagaatgaaaacttcattctcgattctacgagaatttttatgaaagcgtttcatttgcttctcttcaatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaatggtcttatcaatacacaaatgtataactccccaggaatttcaattgcgcttatattcatcactgtaggacttgggttcaagctttccccagccccttttcatcaatggactcctgacgtctacgaaggatcccccactccagtcgttgcttttctttctgttacttcgaaagtagctgcttcagctttagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctg

SEQ ID NO: 5039 - DNA, 1533 bp, Saccharum officinarum
atgatctggcatgtacagaatgaaaacttcattctcgattctacgagaatttttatgaaagcgtttcatttgcttctcttcaatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaatggtcttatcaatacacaaatgtataactccccaggaatttcaattgcgcttatattcatcactgtaggacttgggttcaagctttccccagccccttttcatcaatggactcctgacgtctacgaaggatcccccactccagtcgttgcttttctttctgttacttcgaaagtagctgcttcagctttagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttag

SEQ ID NO: 5040 - DNA, 1533 bp, Hordeum vulgare
atgatctggcatgtacagaatgaaaacttcattctcgattctacgagaatttttatgaaagcgtttcatttgcttctcttcaatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttctcattttattatgttcaactttatgtattcctctatccgtagagtacattgaatgtacagaaatggctataacagagtttctgttattcgtattaacagctactctagggggaatgtttttatgtggtgctaacgatttaataactatctttgtagctctagaatgtttcagtttatgttcctacctattgtctggatataccaagagagatctacggtctaatgaggctactatgaaatatttactcatgggtggggcaagctcttctattctggtttatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcgaaagtagctgcttcagcttcagccacgcgaattctcgatattcctttttatttctcatcaaacgaatggcatcttcttctggaaatcctagctattcttagcatgattttggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacatgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactatactaggaatatcaatgaaccccattcttgcaattgctcaggataccctcttttag

SEQ ID NO: 5041 - DNA, 1536 bp, Oryza sativa
atgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctg

SEQ ID NO: 5042 - DNA, 3440 bp, Brachypodium distachyon
accgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctaaatatggggtcaaaaagccaaaaaaataagtgattcgtttttagcccttataaaaagaaaacggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatgg

SEQ ID NO: 5043 - DNA, 4005 bp, Oryza sativa
tagtactactaactaatactaatatatagaaatagatatctagaaatagaaacgaactaatatatagataatcgaaattgaaaagaactgtcttttctgtatactttccccgttctattgctaccgcggttcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaataagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctaaatatggggtcaaaaagccaaaaaaataagtgattcgtttttagcccttataaaaagaaaacggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatgg

SEQ ID NO: 5044 - DNA, 1640 bp, Brachypodium distachyon
atggaataaggtttgatcctattcatggggattccgtaaatatgccattccaaaaatagaaacaatcgggacttttcggagattggatgcagttactaattcatgatctggcatgtacagaatgaaaacttcattctcgattctacgagaatttttatgaaagcgcttcatttgcttctcttccatggaagtttcattttcccagaatgtatcctaatttttggcctaattcttcttctgatgatcgattcaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttctcattttattatgttcaactttatgtattcctctatccgtagagtacattgaatgtacagaaatggctataacagagtttctgttattcgtattaacagctactctagggggaatgtttttatgtggtgctaacgatttaataactatctttgtagcttcagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcgaaagtagctgcttcagcttcagccacgcgaattctcgatattcctttttatttctcatcaaacgaatggcatcttcttctggaaatcctagctattcttagcatgattttggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataataaagttattaatgactggacgaaaccaagaaataaccccttatgtgagaaattatagaagatcccctttaagatcaaacaattccatcgaattgagtatgactgtatgtgtgatagcatctactataccaggaatatcaatgaatcccattcttgcaattgctcaggataccctcttttagctgct

SEQ ID NO: 5045 - DNA, 1536 bp, Brachypodium distachyon
atgatctggcatgtacagaatgaaaacttcattctcgattctacgagaatttttatgaaagcgcttcatttgcttctcttccatggaagtttcattttcccagaatgtatcctaatttttggcctaattcttcttctgatgatcgattcaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttctcattttattatgttcaactttatgtattcctctatccgtagagtacattgaatgtacagaaatggctataacagagtttctgttattcgtattaacagctactctagggggaatgtttttatgtggtgctaacgatttaataactatctttgtagcttcagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcgaaagtagctgcttcagcttcagccacgcgaattctcgatattcctttttatttctcatcaaacgaatggcatcttcttctggaaatcctagctattcttagcatgattttggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataataaagttattaatgactggacgaaaccaagaaataaccccttatgtgagaaattatagaagatcccctttaagatcaaacaattccatcgaattgagtatgactgtatgtgtgatagcatctactataccaggaatatcaatgaatcccattcttgcaattgctcaggataccctcttttagctg

SEQ ID NO: 5046 - DNA, 1533 bp, Oryza sativa
atgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcgaaagttgctgcttcagcttcagccacgcgaattctcgatattcctttttatttctcatcaaacgaatggcatcttcttctggaaatcctagctgttcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttag

SEQ ID NO: 5047 - DNA, 1533 bp, Oryza sativa
atgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattgaaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgcgtgatagcatctactataccaggaatatcaatgaaccccattcttgcaattgctcaggataccctcttttag

SEQ ID NO: 5048 - DNA, 1813 bp, Lolium multiflorum
atgatctggcatgtacagaatgaaaacttcattctcgattctacgagaatttttatgaaagcgtttcatttgcttctcttcaatggaagtttcattttcccagaatgtatcctaatttttggcctaattcttcttctgatgatcgattcaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttctcattttattatgttccactttatgtattcctctatccgtagagtacattgaatgtaccgaaatggctataacagagtttctgttattcatattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggatcccccactccagtcgttgcttttctttctgttacttcaaaagtagctgcttcagcttcagccacgcgaattctcgatattcctttttatttctcatcaaacgaatggcatcttcttctggaaatcctagctattcttagcatgattttggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaattaccccttatgtgcgaaattatagaagatcccctttaagatcaaacaattccatcgaattgagtatgactgtatgtgtgatagcatctactttaccaggaatatcaatgaaccccattcttgcaattgctcaggataccctcttttagctgctaggtctatttctttcttagttcaagatccctcttactaactggaataaaagaattagtggatctgttccgcccaaaatgggaatgggcgctagggttatgaacttataatcatggaatcaactcgatcatcagattataagttcattccatttacatagaaatccctacgtccttacattctatttaggattaggaataggtgtaatcagattaggattaggaataggtgtaatcagacctgcttttgacatatctatcctattcttagttgggt

SEQ ID NO: 5049 - DNA, 1645 bp, Amorphophallus konjac
actttttcggtcgattggatgcagttactaattcatgatctggcatgtacagaatgaagttttcattctcgattctacgagaatttttatgaaagcgtttcatttgcttctcttccatggaagtttcattttcccagaatgtattctcatttttggcctaattcttcttctgatgatcgatttaacctctgatcaaaaagatagaccttggttctatttcatctcttcaacaagtttagtaatgagcataacagccctattgttccgatggagagaagaacctatgattagcttttcgggaaatttccaaacgaacaatttcaacgaaatctttcaatttcttattttactatgttcaactttatgtattcctctatccgtagagtacattgaatgcacagaaatggctataacagagtttctgttattcgtattaacagctactctaggaggaatgtttttatgtggtgctaacgatttaataactatctttgtagctctagaatgtttcagtttatgttcctacctattatcaggatataccaagagagatgtacggtctaatgaggctactatgaaatatttactcatgggcggggcgagctcttctattctggtttatggtttctcttggctatatggtttatccgggggggagatcgagcttcaagaaatagtgaatggtcttatcaatacacaaatgtataactccccaggaatttcaattgcgcttatattcatcactgtaggaattgggttcaagctttccctagccccttttcatcaatggactcctgacgtatacgaaggatctcccactccagtcgttgcttttctttctgttacttcgaaagtagctgctttagctttagccacgcgaattttcgatattcctttttatttctcatcaaatgaatggcatcttcttctggaaatcctagctattcttagcatgatattggggaatctcattgctattactcaaacaagcatgaaacgtatgcttgcatattcgtccatcggtcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggtcttcctccactagcaggttttttcggaaaactctatctattctggtgtggatggcaggcaggcctttatttcttggtttcaataggactccttacgagcgttgtttctatctactattatctaaaaataatcaagttattaatgactggacgaaaccaagaaataacccctcacgtgcgaaattatagaaaatcccctttaagatcaaacaattccatcgaattgagtatgactgtatgtgtgatagcatctactatactaggaatatcaatgaacccaattcttgcaattgctcaggataccctcttttagcttctagggtctatttcttagttcaagatccctcttactaactggaataaaagaattagtagatctgttctgcccaaa

SEQ ID NO: 5050 - DNA, 1747 bp, Euonymus alatus
agaaagttcgaaacaattgggatttttttggagatcggatgcagttactaattcatgatctggcatgtacagaatgaaaacttcattctcgattctacgagaatttttatgaaagcctttcatttgcttctcttacgaatggaagtttgtattttcccagaatgtatcctaatttttggcctaattcttcttctgatgatcgatttaacctctgatacaaaaagatataccttggttatatttcatctcttcaacaagtttagtaatgagcataacagccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctgttattcgtattaacagctactctaggaggaatgtttttatgcggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatggtttctcttggctctatggttcatccgggggagagatcgagcttcaagaaatagtgaatggtcttatcaatacacaaatgtataactccccaggaatttcaattgcgcttatattcatcactgtaggaattgggttcaagctttccctagtcccttctcatcaatggactcctgacgtatacgaaggatctcccactccagtcgttgcttttctttctgttacttcgaaagtcgctgcttcagcttcagccactcgaattttcgatattccttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcaagcatgataacttatatgctgttctatatctccatgaatctaggaacttttgcttgcattgtatcatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatatttcttggtttcaataggactccttacgagcgtggtttctatatactattatctaaaaataatcaagttattaatggctggacgaaaccaagaaataacccctcacgtgcgaaattatagaagatcccctttaagatcaaacaattccatcgaattgagtatgattgtatgtgtgatagcatctactataccaggaatatcaatgaacccgattatggaaattgctcaggataccctttttagcttctagaatctatttcttagttcaagatctctcttactaactggaatcaaagaattagtagatctgttctacccaaaaggggaatggactagggttatgaacttataatctgatgatcgagtcgattccatgattataggttcattccatgccggac

SEQ ID NO: 5051 - DNA, 1479 bp, Ananas comosus
  misc_feature (1446)..(1446): n is a, c, g, or t
  misc_feature (1469)..(1469): n is a, c, g, or t
atgaaagcgtttcatttgcttctcttccatggaagtttcattttcccagaatgtatcctaatttttggtctaattcttcttctgatgatcgattcaacctctgatcaaaaagatagaccttggttctatttcatctcttcaactagtttagtaataagcataacggccctattgttccgatggagagaagaacctataattagcttttcgggaaatttccaaacgaacaatttcaacgaaatctttcaatttcttattttactatgttcaactctatgtattcctctatccgtagagtacattgaatgtacagaaatggctataacagagtttctgttattcgtattaacagctactctaggaggaatgtttttatgtggtgctaacgatttaataactatctttgtagctccagaatgtttcagtttatgttcctacctattatccggatataccaagagagatgtacggtctaatgaggctactatgaaatatttactcatgggtggggcaagctcttctattctggttcatggtttctcttggctatatggttcatctgggggggagatcgagcttcaagaaatagtgaatggtcttatcaatacacaaatgtataactccccaggaatttcaattgcgcttatattcatcactgtaggaattgggttcaagctttccccagccccttttcatcaatggactcctgacgtatacgaaggatctcccactccagtcgttgcttttctttctgttacttcgaaagtagctgcttcagcttcagccacgcgaattttcgatattcctttttatttctcatcaaacgaatggcatcttcttctggaaatcctagctattcttagcatgatattggggaatctcattgctattactcaaacaagcatgaaacgtatgcttgcatattcgtccatcggtcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctcttcagccctatgtctcttatccctaggaggtcttcctccactagcaggttttttcggaaaactctatctattctggtgtggatggcaggcaggcctatatttcttggtttcaataggactccttacgagcgttgtttctatctactattatctaaaaataatcaagttattaatgactggacgaaaccaagaaataaccccttacgtgcgaaattatagaagatcccctttaagatcaaacaattccatcgaattgagtatgactgtatgtgtgatagcatctactataccaggaatatcaatgaacccnattcttgcaattgctcaggatancctcttttag

SEQ ID NO: 5052 - DNA, 1547 bp, Glycine max
atgatctgacatgtacagaatgaaaacttcattctcgattctacaagaatttttatgaaagcctttcatttgcctctcttcgatggaagttttattttcccagaatgtatcctaatttttggcctaattcttcttctgatgattgattcaacctctgatcaaaaagatatatcttggttctattttatctcttcaacaagtttagtaatgagcataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatatccctttttatttctcatcaaacgaatggcatcttcttctggaaatcctagctattcttagcatgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggttttttcggaaacttcatttattctggtgtggatggcaggcaggcttatatttcttagtttcataggactccttacgagtgttgtttctatctactattatttaaaaataatcaagttattaatgactggacgaaaccaagaaataactcctcacgtgcgaaattatcgaaggccccctttaagatcaacaattccatcgaattaagtatgattgtatgtgtgatagcatctactataccaggaatatcaatgaaccctattattgaaattgctcagatacccttttttagcttctagaatctatttct

SEQ ID NO: 5053 - DNA, 4152 bp, Gossypium hirsutum
gttcttttatgaggcacaaacaggagaatttatcctggaagcggaagaactactgaaacttcgcgaaagcctcacaagggtttatgtacaaagaacgggcaagcccctatgggttgtatccgaagacatggaaagagatgtttttatgtcagcaacagaagcccaagcttatggaattgtggatcttgtagcggttaaataagttaaataacaaatagcaatagcaacgatttaacaccaatccacaatttaattaagattgatttaatccctcttcttcctttccttcttaacttaagcctaaagcctaaggggttaatattttattaatctattaaatagaaaaagaagtaattcagaatcatctggttaggatcgatctaaaccagtctattatgtatataattcagtatgccaactattaaacaacttattagaaatgcaagacagccaattagaaatgtcacgaaatcccctgctcttgggggatgtcctcagcgccgaggaacatgtactagggtgtatactatcacccccaaaaaaccaaactctgccttacgtaaagttgccagagtacgattaacctctgggtttgaaatcactgcttatatacctggtattggccataattcacaagaacattctgtagtcttagtaagagggggaagggttaaggatttacccggtgtgagatatcacattgttcgaggaaccctagatgctgtcggagtaaaggatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactattatatgtccaaggtccaatattgaaataatttcagaggttttccctgactttgtccgtgtcaacaaacaattcgaaatgcctcgactcttttagaacaggtccgggtcaaatagcaatgattcgaagcacttctttttacactatttcggaaacccaaggactcaatcgtatggatatgtaaaatacaggatttccaatcctagcaggaaagggagggaaacggatactcaatttaaagtgagtaaacagaattccatactcgatctcatagatacatatggaattccgtggaaaaccgtattcgatgaaagtcgtatgtacggcttggagggagatctttcatatctttcgagatccaccctacaatatggggtcaaaaagccaaaataaatgattttagcccttataaaaagaaaatggattcttgaacccctttcacgctcatgtcacgtcgaggtactgcagaagaaaaaactgcaaaatccgatccaatttatcgtaatcgattagttaacatgttggttaaccgtattctgaaacacggaaaaaaatcattggcttatcaaattatctatcgagccttgaaaaagattcaacaaaagacagaaacaaatccactatctgttttacgtcaagcaatacgtggagtaactcccgatatagcagtaaaagcaagacgtgtaggcggatcgactcatcaagttcccattgaaataggatccacacaaggaaaagcacttgccattcgttggttattaggggcatcccgaaaacgtccgggtcgaaatatggctttcaaattaagttccgaattagtggatgctgccaaagggagtggcgatgccatacgcaaaaaggaagagactcatagaatggcagaggcaaatagagcttttgcacattttcgttaatccatgaacaggatcgatatagacacatagattcatggatccatacatctcgatcggaaaagaatcaatagaaaaagaaagaatcggaattgatcgatatatttctcgaaacaaacgaaaaggaaacgaaagctgaaacataaatcatggatcaactaagccctctcggggacttgcttaagaataagaaagaggaatctcatgtaaataccatggaataaggtttgatcctattcatggggattccgtaaatattcccattccaaaactagaaagttcgaaacaattgggattttttttggagattggatgcagttactaattcatgatctggcatgtacagaatgaaaacttcattctcgattctacgagaatttttatgaaagcctttcatttgcttctcttcgatggaagttttattttcccagaatgtatcctaatttttggcctaattcttcttctgatgatcgatttaacctctgatcaaaaagatataccttggttatatttcatctcttcaacaagtttagtaatgagcataacggccctattgttccgatggagagaagaacctatgattagcttttcaggaaatttccaaacgaacaatttcaacgaaatctttcaatttcttattttactatgttcaactctatgtattcctctatccgtagagtacattgaatgtacagaaatggctatagcagagtttctgttattcgtattaacagctactctaggaggaatgtttttatgcggtgctaacgatttaataactatctttgtagctctagaatgtttcagtttatgctcctacctattatctggatataccaagaaagatgtacggtctaatgaggctactatgaaatatttactcatgggtggggcaagctcttctattctggtttatggtttctcttggctatatggttcatccgggggagagatcgagcttcaagaaatagtgaatggtcttatcaatacacaaatgtataactccccaggaatttcaattgcgcttatattcatcactgtaggaattgggttcaagctttccctagccccttttcatcaatggactcctgacgtatacgaaggatctcccactccagtcgttgcttttctttctgttacttcgaaagtagctgcttcggcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattgtattatttggtctacgtaccggaactgataacattcgagattatgcaggattatacacaaaagatccttttttggctctctctttagctctatgtctcttatctctaggaggtcttcctccactagcaggttttttcggaaaactccatttattctggtgtggatggcaggcaggcctatatttcttggtttcaataggactccttacgagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaacccgattattgcaattgctcaggatacccttttttagtttagcttctagttagcttctagaatctatttcttagttcaaggtccctctttactaactggaatcaaagattagtagatctgttccgcccaaaatgggaatgggctggggttatgaacttataatctataatctgatgatcgagtcgattccatgattataagttcattccataccggaccagaccggaatagggctatatacattctcattatgagaaggggtcattcgagcgtatctaaatagatactatgtttacatatggatccctacgtcgttacattccatttaggattaggaatgggcgtaatcgggccttctttttacatatctctcgttatttgggaccctattcacctcttttcttttttcttctattgaatcgagaaataaataggtttgattgtccatctttttaatagtaatctatatatatttaatataatcttaatat

SEQ ID NO: 5054 - DNA, 2332 bp, Gossypium raimondii
aacaggatcgatatagacacatagattcatggatccatacatctcgatcggaaaagaatcaatagaaaaagaaagaatcggaattgatcgatatatttctcgaaacaaacgaaaaggaaacgaaagctgaaacataaatcatggatcaactaagccctctcggggacttgcttaagaataagaaagaggaatctcatgtaaataccatggaataaggtttgatcctattcatggggattccgtaaatattcccattccaaaactagaaagttcgaaacaattgggattttttttggagattggatgcagttactaattcatgatctggcatgtacagaatgaaaacttcattctcgattctacgagaatttttatgaaagcctttcatttgcttctcttcgatggaagttttattttcccagaatgtatcctaatttttggcctaattcttcttctgatgatcgatttaacctctgatcaaaaagatataccttggttatatttcatctcttcaacaagtttagtaatgagcataacggccctattgttccgatggagagaagaacctatgattagcttttcaggaaatttccaaacgaacaatttcaacgaaatctttcaatttcttattttactatgttcaactctatgtattcctctatccgtagagtacattgaatgtacagaaatggctatagcagagtttctgttattcgtattaacagctactctaggaggaatgtttttatgcggtgctaacgatttaataactatctttgtagctctagaatgtttcagtttatgctcctacctattatctggatataccaagaaagatgtacggtctaatgaggctactacgaaatatttactcatgggtggggcaagctcttctattctggtttatggtttctcttggctatatggtttatccgggggagagatcgagcttcaagaaatagtgaatggtcttatcaatacacaaatgtataactccccaggaatttcaattgcgcttatattcatcactgtaggaattgggttcaagctttccctagccccttctcatcaatggactcctgacgtatacgaaggatctcccactccagtcgttgcttttctttctgttacttcgaaagtagctgctttggctttagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattgtattatttggtctacgtaccggaactgataacattcgagattatgcaggattatacacaaaagatccttttttggctctctctttagctctatgtctcttatctctaggaggtcttcctccactagcaggttttttcggaaaactccatttattctggtgtggatggcaggcaggcctatatttcttggtttcaataggactccttacgagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaacccgattattgcaattgctcaggatacccttttttagtttagcttctagttagcttctagaatctatttcttagttcaaggtccctctttactaactggaatcaaagaattagtagatctgttccgcccaaaatgggaatgggctggggttatgaacttataatctataatctgatgatcgagtcgattccatgattataagttcattccataccggaccagaccggaatagggctatatacattctcattatgagaaggggtcattcgagcgtatctaaatagatactatgtttacatatggatccctacgtcgttacattccatttaggattaggaatgggcgtaatcgggccttctttttacatatctctcgttatttgggaccctattcacctcttttctttttttcttctattgaatcgagaaataaataggtttgattgtccatctttttaatctaatctatatatatttaatataatcttaatatagacatcctccggatacttcaaatc

SEQ ID NO: 5055 - DNA, 1568 bp, Eucalyptus grandis
tttttttggagattggatgcggttactaattcatgatctggcatgtacagaatgaaaacctcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttctatttcatctcttcaacaagtttagtaatgagcataacggccctattgttccgatggagagaagaacctatgattatcttttcaggaaatttccaaacgaacaatttcaacgaaatctttcaatttcttattttactatgttcaactctatgtattcctctatccgtagagtacattgaatgtacagaaatggctatcacagagtttctcttatttgtattaacagctactctaggaggaatgtttttatgcggtgctaacgatttaataactatctttgtagctccagaatgtttcagtttatgctcctacctattatctggatataccaagaaggatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaattttaattgcgcttctattcatcactgtaggaattgggttcaagctttccctagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatacttcttggtttcaataggactccttacgagcgttatttctatctactattatctaaaaataatcaagttattaatgactggacgaaaccaagaaataacacctcacgtgcgaaattatagaagatcccctttaagatcaaacaattccatcgaattgagtatgattgtatgtgtgatagcatctactataccaggaatatcaatgaacccgattattgcaattgctcaggatacccttttttagctt

SEQ ID NO: 5056 - DNA, 1758 bp, Eucalyptus grandis
tttctcgaaacaaacaaaaaagaaacgaaagatgaaacataaatcatggatcaactaagccctctcgggggcttgcttaagaataagaaagaggaatctcatgtaaataccatggaataaggtttgatcctattcatggggattccataaatattccattccaaaaatagaaagttcgaaacaattggaatttttttggagattggatgcggttactaattcatgatctggcatgtacagaatgaaaacctcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttctatttcatctcttcaacaagtttagtaatgagcataacggccctattgttccgatggagagaagaacctatgattatcttttcaggaaatttccaaacgaacaatttcaacgaaatctttcaatttcttattttactatgttcaactctatgtattcctctatccgtagagtacattgaatgtacagaaatggctatcacagagtttctcttatttgtattaacagctactctaggaggaatgtttttatgcggtgctaacgatttaataactatctttgtagctccagaatgtttcagtttatgctcctacctattatctggatataccaagaaggatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaattttaattgcgcttctattcatcactgtaggaattgggttcaagctttccctagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatacttcttggtttcaataggactccttacgagcgttatttctatctactattatctaaaaataatcaagttattaatgactggacgaaaccaagaaataacacctcacgtgcgaaattatagaagatcccctttaagatcaaacaattccatcgaattgagtatgattgtatgtgtgatagcatctactataccaggaatatcaatgaacccgattattgcaattgctcaggatacccttttttagctt

SEQ ID NO: 5057 - DNA, 1533 bp, Solanum tuberosum
atgatctggcatgtacagaatgaaaacttcattctcgattctacgagaatttttatgaaagcctttcatttgcttctcttcgatggaagtttgattttcccagaatgtatcctaatttttggcctaattcttcttctgatgatcgattcaacctctgatcaaaaagatataccttggttatatttcatctcttcaacaagtttagtactgagcataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctagggggaatgtttttatgcggtgctaacgatttaataactatctttgtagccccagaatgtttcagtttatgctcctacctattatctggatataccaagaaagatgtacggtctaatgaggctactatgaaatatttactcatgggtggggcaagctcttctattctggttcatggtttctcttggctatatggttcatccgggggagagattgagcttcaagaaatagtaaacggtcttatcaatacacaaatgtataactccccaggaatttcaattgcgctcatattcattaccgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattgggaaatctcattgctattactcaaacaagcatgaaacgtatgcttgcatattcgtccataggccaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacaaaagatccttttttggctctctctttagccctatgtctcttatccctaggaggtcttcctccactagcaggttttttcggaaaactctatttattctggtgtggatggcaggcaggcctatatttcttggttttaataggactccttacaagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaacccgattattgcaattgctcaggatagccttttttag

SEQ ID NO: 5058 - DNA, 1548 bp, Solanum phureja
ttactaattcatgatctggcatgtacagaatgaaaacttcattctcgattctacgagaatttttatgaaagcctttcatttgcttctcttcgatggaagtttgattttcccagaatgtatcctaatttttggcctaattcttcttctgatgatcgattcaacctctgatcaaaaagatataccttggttatatttcatctcttcaacaagtttagtaatgagcataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctagggggaatgtttttatgcggtgctaacgatttaataactatctttgtagccccagaatgtttcagtttatgctcctacctattatctggatataccaagaaagatgtacggtctaatgaggctactatgaaatatttactcatgggtggggcaagctcttctattctggttcatggtttctcttggctatatggttcatccgggggagagattgagcttcaagaaatagtaaacggtcttatcaatacacaaatgtataactccccaggaatttcaattgcgctcatattcattaccgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattgggaaatctcattgctattactcaaacaagcatgaaacgtatgcttgcatattcgtccataggccaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacaaaagatccttttttggctctctctttagccctatgtctcttatccctaggaggtcttcctccactagcaggttttttcggaaaactctatttattctggtgtggatggcaggcaggcctatatttcttggttttaataggactccttacaagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaacccgattattgcaattgctcaggatagccttttttagcttct

SEQ ID NO: 5059 - DNA, 1755 bp, Eucalyptus grandis
tttcttgaaacaaacaaaaaagaaacgaaagatgaaacataaatcatggatcaactaagccctctcgggggcttgcttaagaataagaaagaggaatctcatgtaaataccatggaataaggtttgatcctattcatggggattccataaatattccattccaaaaatagaaagttcgaaacaattggaatttttttggagattggatgcggttactaattcatgatctggcatgtacagaatgaaaacctcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttctatttcatctcttcaacaagtttagtaatgagcataacggccctattgttccgatggagagaagaacctatgattatcttttcaggaaatttccaaacgaacaatttcaacgaaatctttcaatttcttattttactatgttcaactctatgtattcctctatccgtagagtacattgaatgtacagaaatggctatcacagagtttctcttatttgtattaacagctactctaggaggaatgtttttatgcggtgctaacgatttaataactatctttgtagctccagaatgtttcagtttatgctcctacctattatctggatataccaagaaggatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaattttaattgcgcttctattcatcactgtaggaattgggttcaagctttccctagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatacttcttggtttcaataggactccttacgagcgttatttctatctactattatctaaaaataatcaagttattaatgactggacgaaaccaagaaataacacctcacgtgcgaaattatagaagatcccctttaagatcaaacaattccatcgaattgagtatgattgtatgtgtgatagcatctactataccaggaatatcaatgaacccgattattgcaattgctcaggatacccttttttag

SEQ ID NO: 5060 - DNA, 1622 bp, Helianthus annuus
atcctatcatggagattccataaataatcccattaccaaaaaatggaaacaattgggattttttagaaattggatgcagttactaattcatgatctggcatgtacagaatgaaaacttcattctcgattctacgagaatttttatgaaagcctttcatttgcttctcttcgatggaagtttgattttcccagaatgtatcctaatttttggcctaattcttcttctgatgatcgattcaacctctgatcaaaaagatataccttggttatatttcatctcttcaacaagtttagtaatgagcataacggccctattgttccgatggagagaggaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcatattaacagctactataggaggaatgtttttatgcggtgctaacgatttaataactatctttgtagctctagaatgtttcagtttatgctcctacctattatctggatatacgaagaaagatgtacggtctaatgaggctactatgaaatatttactcatgggtggggcaagctcttctattctggtttatggtttctcttggctatatggttcatccgggggagagatcgagcttcaagaaatagtgaatggtcttatcaatacacaaatgtataactccccaggaatttcaattgcgctcatattcatcactgtaggaattgggttcaagctttccctagccccttctcatcaatggactcctgacgtatacgaaggatctcccactccagtcgttgcttttctttctgttacttcgaaagtagctgctttagctttagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtcttatttggtctacgtaccggaactgagaacattcgagattatgcaggattatacacgaaagatccttttttggctctctctttagccctatgtctcttatcgctaggaggtcttcctccactagcaggttttttcggaaaactctatttattctggtgtggatggcaggcaggcctatatttattggttttaataggactccttacaagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaatccgattattgcaattgctcaggatacccttttttag

SEQ ID NO: 5061 - DNA, 1520 bp, Phaseolus coccineus
cagaatgaaaacttcattctcgattctacaagaatttttatgaaagcctttcatttgcttctcttcgatggaagtttgattttcccagaatgtatcctcatttttggcctaattcttcttctgatgattgatttaacctctgatcaaaaagatatatcttggttctattttatctcttcaacaagtttagtaatgagcataacggccctattgttccgatggagagaagaacctatgattgccttttcgggaaatttacaaacgaacaatttcaacgaaatctttcaatttcttattttactatgttcaactctatgtattcctctatccgtagagtacattgaatgtacagaaatggctatcacagagtttctcttattcatattaacaactactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatgtacggccgggggagagatcgagcttcaagagatagtgaatggtcttatcaatacacaaatgtataactccccaggaattttaattgcacttttattcatcactgtagtaattgggttcaagctttccccagccccttctcatcaatggactcctgacgtatacgaaggatctcccactccagtcgttgcttttctttctgttacttcgaaagtagctgcttcagcttcagccactcgaattttcgatatccctttttatttctcatcaaacgaatggcatcttcttctggaaatcctagctattcttagcatgatattggggaatctgattgctattacccaaacaagcatgaaacgtatgcttgcgtattcgtccataggtcaaatcggatatgtaattattggaataattgttggagactccaatggtggatatgcaagcatgataacttatatgctgttctatatctcgatgaatctaggaacttttgcttgcattgtattatttggtctacgtaccggaactgataacattcgagattatgcaggattatacacgaaagatccttatttggctctctctttagccctatgtctcttatccttaggaggtcttcctccactagcaggttttttcggaaaacttcatttattctggtgtggatggcaggcaggcttatatttcttggtttcaataggactccttacaagtgttgtttctatctactattatctaaaaataatcaagttattaatgactggacgaaaccaagaaataactcctcacgtgcgaaattatagaaggtcccctttcagatcaaacaattccatcgaattcagtatgattgtatgtgtgatagcatctactataccaggaatatcaatgaaccctattattgaaattgctcaggatacccttttttagctt

SEQ ID NO: 5062 - DNA, 2351 bp, Gossypium raimondii
gaatggcagaggcaaatagagcttttgcacattttcgttaatccatgaacaggatcgatatagacacatagattcatggatccatacatctcgatcggaaaagaatcaatagaaaaagaaagaatcggaattgatcgatatatttctcgaaacaaacgaaaaggaaacgaaagctgaaacataaatcatggatcaactaagccctctcggggacttgcttaagaataagaaagaggaatctcatgtaaataccatggaataaggtttgatcctattcatggggattccgtaaatattcccattccaaaactagaaagttcgaaacaattgggattttttttggagattggatgcagttactaattcatgatctggcatgtacagaatgaaaacttcattctcgattctacgagaatttttatgaaagcctttcatttgcttctcttcgatggaagttttattttcccagaatgtatcctaatttttggcctaattcttcttctgatgatcgatttaacctctgatcaaaaagatataccttggttatatttcatctcttcaacaagtttagtaatgagcataacggccctattgttccgatggagagaagaacctatgattagcttttcaggaaatttccaaacgaacaatttcaacgaaatctttcaatttcttattttactatgttcaactctatgtattcctctatccgtagagtacattgaatgtacagaaatggctatagcagagtttctgttattcgtattaacagctactctaggaggaatgtttttatgcggtgctaacgatttaataactatctttgtagctctagaatgtttcagtttatgctcctacctattatctggatataccaagaaagatgtacggtctaatgaggctactatgaaatatttactcatgggtggggcaagctcttctattctggtttatggtttctcttggctatatggtttatccgggggagagatcgagcttcaagaaatagtgaatggtcttatcaatacacaaatgtataactccccaggaatttcaattgcgcttatattcatcactgtaggaattgggttcaagctttccctagccccttttcatcaatggactcctgacgtatacgaaggatctcccactccagtcggtacttttctttttgttacttcgaaagtagctgcttcggcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattgtattatttggtctacgtaccggaactgataacattcgagattatgcaggattatacacaaaagatccttttttggctctctctttagctctatgtctcttatctctaggaggtcttcctccactagcaggttttttcggaaaactccatttattctggtgtggatggcaggcaggcctatatttcttggtttcaataggactccttacgagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaacccgattattgcaattgctcaggatacccttttttagtttagcttctagttagcttctagaatctatttcttagttcaaggtccctctttactaactggaatcaaagaattagtagatctgttccgcccaaaatgggaatgggctggggttatgaacttataatctataatctgatgatcgagtcgattccatgattataagttcattccataccggaccagaccggaatagggctatatacattctcattatgagaaggggtcattcgagcgtatctaaatagatactatgtttacatatggatccctacgtcgttacattccatttaggattaggaatgggcgtaatcgggccttctttttacatatctctcgttatttgggaccctattcacctcttttctttttttcttctattgaatcgagaaataaataggtttgattgtccatctttttaatctaatctatatatatttaatataatcttaa

SEQ ID NO: 5063 - DNA, 2710 bp, Medicago truncatula
atggataaatcagaactaaggcaagatgagatggatgaacccttctttcttgtgccaacgatcttaccatttgcgaagttgacctccttgcttttaggatggtacaatcctcttgctgcctttctcctcggcccacagcgacaaaatggaagactggtgccaacagttcatcacgagtggagattctcgaacgaggaaaaggatccaattacttcgaaagaattgaacgaggataaggatgacttatctgtcaacttttccactattacccctaaaaaaccaaactctgccttacgtaaagttgccagagtacgcttaacctctggatttgaaatcactgcttatatacccggtattggccataatttacaagaacattctgtagtcttagtaagagggggaagggttaaggatttacctggtgtgagatatcacattgttcgaggaaccctagatgctgtcggagtaaaggatcgccaacaaggtactgcagaaaaaaaaaccgcaaaatccgatccaatttatcgtaatcgattagttaacatgttggttaaccgtattatgaaacacggaaaaaaatcattggcttatcaaattatctatcgagctatgaaaaggattcaacaaaagacaaaaacaaatccactatatgttttacgtcaagcaatacgtggcgtaactcccgatatagcagtaaaaacaaaaacaagacgcgtaagcggatcgaataaaaaagttcccgttgaaataggatccacacaaggaaaagcacttgccattcgttggttattaggcgcatcccgaaaacgtccgggtcgaaatatggctttcaaattaagttccgaattagtggatgctgccaaagggagtggcgatgccatacgcaaaaagcaagagactcatagaatggcagaggcaaatagagcttttgcacattttcgttaatccatgagcaggatctatatacacacatagacctatgtatggatccatacataattataattggaaaagaatcaatagaaaaagaatcggaattaatcgatatatctatcgaaacgaaagacgaaatagaaatgatggctcaactaagcacttttggggacttgcttaagaataaataaagaggaatatttggtatttttttggagattcgatgcaattactaattcatgatttgacatgtacagaatgaaaatctcattctcgagtctacgagaatttttatgaaagcctttcatttgcttcttttcgatggaagttttatttttccggaattgatcctaatttttggtctaattcttcttctgatgattgatttaacctctgatcaaaaagatctatcttggttctattttatctcttcaacaagtttagtaatgagcataacggcgctgttgttccgatggagagaagaacccatgattagtttttcgggaaattttcaaacgaacaatttcaacgaaatctttcaatttcttattttactatcttcaactctatgtattcctctatccgtagagtacattgaatgtacagaaatggctataacagagtttctgttattcatattaaccgctactctaggaggaatgtttttatgcagcgctaatgatttaataactatctttgtagctctagaatgtttcagtttatgctcctatctactatctggatataccaagaaagatgtacggtctaatgaggctactatgaaatatttactcatgggtggggcaagctcttctattctggtttatggtttctcttggctatatggttcgtccgggggagagatagagcttcaagaaatagtgaatggtcttatcaatacacaaatgtataactcccctggaatttcaattgcgcttatattcatcactgtaggaattgggttcaagctttccctagccccttttcatcaatggactcctgacgtatatgaaggatctccgactccagtcgttgcttttctttctgttacttcgaaagtagctgctttagctttagccactcgaattttcgatattcctttttatttctcatcaaacgaatggcatcttcttctagaaatcctagctattcttagcatgctattagggaatcttattgctattacccaaacaagcatgaaacgtatgcttgcttattcgtccataggtcaaattggatatgtaattattggaataattgttggagactcaaatggtggatatgcaagcatgataacttatatgttgttctatatctccatgaatctaggaacttttgcttgcattgtgttatttggtctacgtactggaactgataacattcgagattatgcaggattatacacaaaagatccttttttggctctctctttagccctatgtctattatccttaggaggtcttcctccactagcaggttttttcggaaaactttatttattctggtgtggatggcaagcaggcctatatttcttggtttcaataggacttattacaagcgttgtttctatctactattatctaaaaataattaagttattaatgactggacgaaaccaagaaataactcctcacgtgcgaaattatagaaggtctcctgtaagatcaaacaattccatcgaattgagtatgattatatgtgtgatagcatctactatactaggaatatcaatgaaccccattattgaaattgctcaggatacccttttttagcttct

SEQ ID NO: 5064 - DNA, 1533 bp, Olea europaea
atgatctggcatgtacagaatgaaaacttcattctcgattctacgagaatttttatgaaagcctttcatttgcttctcttcgatggaagtttgattttcccagaatgtatcctaatttttggcctaattcttcttctgatgatcgattcaacctctgatcaaaaagatataccttggttatatttcatctcttcaacaagtttagtaatgagcataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaatttcaattgcgctcatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattgggaaatatcattgctattactcaaacaagcatgaaacgtatgcttgcatattcgtccataggtcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggtcttcctccactagcaggttttttcggaaaactctatttattctggtgtggatggcaggcaggcctatattccttggttttaataggactccttacaagcgttgtttctatctactattatctaaaaataatcaagttattaatgactggacgaaaccaagaaatcacccctcacgtgcgaaattatagaagatctcctttaagatcaaacaattccatcgaattgagtatgattgtatgtgtgatagcatctactatacctggaatatcaatgaacccgattattgcaattgctcaggatacccttttttag

SEQ ID NO: 5065 - DNA, 1533 bp, Panax ginseng
atgatctggcatgtacagaatgaaaacttcattctcgattctacgagaatttttatgaaagcctttcatttgcttctcttcgatggaagtttgattttcccagaatgtatcctaatttttggcctaattcttcttctgatgatcgattcaacctctgatcaaaaagatataccttggttatatttcatctcttcaacaagtttagtaatgagcataacggccctcttgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaatttcaattgcgctcatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggtcttcctccactagcaggttttttcggaaaactctatttattctggtgtggatggcaggcaggcctatatttcttggttttaataggactccttacaagcgttgtttctatctactattatctaaaaataatcaagttattaatgattggacgaaaccaagaaataacccctcacgtgcgaaattatagaagatctcctttcagatcaaacaattccatcgaattgagtatgattgtatgtgtgatagcatctactataccaggaatatcaatgaacccgattattgcaattgctcaggatacccttttttag

SEQ ID NO: 5066 - DNA, 1533 bp, Prunus persica
atgatctggcatgtacagaatgaaaacttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttagtaatgagcataacggccctattgttccgatggagagaagaacctacgattagcttttcgggaaatttccaaacgaacaatttcaacgaaatctttcaatttcttattttactatgttcaactctatgtattcctctatccgtagagtacattgaatgtacagaaatggctataacagagtttctgttattcgtattaacagctactctaggaggaatgtttttatgcggtgctaacgatttaataactatctttgtagctccagaatgtttcagtttatgctcctacctattatctggatataccaagaaagatgtacggtctaatgaggctactacgaagtatttactcatgggtggggcaagctcttctattctggttcacggtttctcttggctatatggttcatccgggggagagatcgagcttcaagaaatagtgaatggtcttatcaatacacaaatgtataactccccaggaatttcaattgcgcttatattcatcactgtaggaattgggttcaagctttccccagccccttctcatcaatggactcctgacgtatacgaaggatctcccactccagttgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcgtattcgtccataggtcaaattggatatgtaattattggaataattgttggagactcaaatggtggatatgcaagcatgataacttatatgctgttctatatctccatgaatctaggaacttttgcttgcattgtattatttggtctacgtaccggaactgataacattcgagattatgcaggattatacacaaaagatccttttttggctctctctttagccctatgtctcttatccttaggaggtcttcctccactagcaggttttttcggaaaacttcatttattctggtgtggatggcaggcaggcctatatttcttggtttcaataggactccttacgagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaacccgattattgaaattgctcaggatacccttttttag

SEQ ID NO: 5067 - DNA, 1533 bp, Guizotia abyssinica
atgatctggcatgtacagaatgaaaacttcattctcgattctacgagaatttttatgaaagcctttcatttgcttttcttcgatggaagtttgattttcccagaatgtatcctaatttttggcctaattcttcttctgatgatcgattcaacctctgatcaaaaagatataccttggttatatttcatttcttcaacaagtttagtaatgagcataacggccctattgttccgatggagagaggaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactataggaggaatgtttttatgcggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaatttcaattgcgctcatattcatcactgtaggaattgggttcaagctttccctagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtcttatttggtctacgtaccggaactgagaacattcgagattatgcaggattatacacgaaagatccttttttggctctctctttagccctatgtctcttatccctaggaggtcttcctccactagcaggttttttcggaaaactctatttattctggtgtggatggcaggcaggcctatatttcttggttttaataggactccttacaagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaatccgattattgcaattgctcaggatacccttttttag

SEQ ID NO: 5068 - DNA, 2346 bp, Amborella trichopoda
tccatgaaaaggaatctatatagacacatagatccatggatccatacatctcgatcggaaaagaatcgatagaaaaagaaagaatcggaattgatcgatatgtttctcgaaacaaacgaaaaagaaaaaaaaagatgaaacatcaatcatggatcaactaagccctctcgggggcttgcttaagaataagaaagaggaatctcatggaaataccatggaataaggtttgatcctattcatggggattccgtaaatatcccattccaaaaatagaaagttcgaaacaattgggactttttcggagattgggtgcagttactaattcatgatctggcatgtacagaatgaaaacttcattctcgattctacgagaatttttatgaaagcctttcatttgcttctcttccatggaagtttcattttcccagaatgtatcctaatttttggcctaattcttcttctaatgatcgattcaacctctgatcaaaaagatagaccttggttctatttcatctcttcaacaagtttagtaatgagcataacggccctattgttccgatggagagaagaacctatgattagcttttcggggaatttccaaacgaacaatttcaacgaaatctttcaatttcttattttactatgttcaactctatgtattcctctatcagtagagtacattgaatgtacagaaatggctataacagagtttctgttattcgtattaacagctactctaggaggaatgtttttatgtggtgctaacgatttaataactatctttgtagctccagaatgtttcagtttatgctcctacctattatctggatataccaagagagatgtacggtctaatgaggctactacgaaatatttactcatgggtggggcaagctcttctattctggttcatggtttctcttggctatacggctcatccgggggagagatcgagcttcaagaaatagtgaatggtcttatcaatacacaaatgtataactccccgggaatttcgattgcgcttctatccatcactgtaggaattgggttcaagctttccccagccccttttcatcaatggactcctgacgtatacgaaggatctcccactccagtcgttgcttttctttctgttacttcgaaagtagctgcttcagctttagccactcgaattttcgatattcctttctatttctcatcgaacgaatggcatcttcttcttgaaatcctagctattcttagcatgatattggggaatctcattgctattactcaaacaagcatgaaacgtatgcttgcatattcgtccataggtcaaatcggatatgtaattattggaataattgttggagactcaaatgatggatatgcaagcatgataacttatatgctgttctatatctccatgaatctaggaacttttgctcgcattgtatcatttggtccacgtaccggaactgataacattcgggattatgcaggattatacacgaaagatccttttttggctctctcttcagccctatgtctcctatccctaggaggtattcctccattagcaggttttttcggaaaactccatctattctggtgtggatggcaggcgggcctatatttcttggtttcgataggactccttacgagcgttgtttctatctactattatctaaaaataatcaagttattaatgactggacgaaacaaagaaataacccctcacgtgcgaaattatagaagatctcctttaagatcaaacaattccatcgaattgagtatgattgtatgtgtaatagcatctactataccaggaatatcaatgaacccaattattgcaattgctcaggataccttcttttaacttctagggtctatttcttagttcaagatccctcttactaactggaataaaagaattagtagatcttttccgcccaaaatgggaatgggctggggttatgaacttataatcatggaatcaactcgatcatcagattataagttcattccataccggaccaggccggaaggaatagggttatgtacattctcgttatgagaagggtcgaacatatgtaaatagatactatggatccctacgtcgttacattccatttaggttaggaataggcgtaatcggacctgctttttacatatctatcgttttgggtaccatattcacttcgtttgggcttctattgaatcgagaaataggtttgattgtacatcttttataaggcatcctccggataattcaaatccaagcaatttgatgtccgactcgggcctatatgacatgaccgatcgatagaaatactccaaaactccatctttgtcatatattccata

SEQ ID NO: 5069 - DNA, 2245 bp, Vitis vinifera
atagatccatggatccaatccatacatctcgatcggaaaagaatcaatagaaaaagaaagaatcggaattgatcgatatatttctcgaaacaaacgaaaaggaaacgaaagatgaaacataaatcatggatccactaagtcctctcggggacttgcttaagaataagaaagaggaatctcatgtaaataccatggaataaggtttgatcctattcatggcgattccgtaaatattccattccaaaaatagaaacaattgggatttttttggagattggatgcagttactaattcatgatctggcatatacagaatgaaaacttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttagtaatgagcataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttaataactatctttgtagctccagaatgtttcagtttatgctcctacctattatctggatataccaagaaagatgtacggtctaatgaggctactacgaaatatttactcatgggtggggcaagttcttctattctggttcatggtttctcttggctatatggttcatccgggggagagatcgagcttcaagaaatagtgaatggtcttatcaatacacaaatgtataactccccaggaatttcaattgcgcttatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcaagcatgataacttatatgctgttctatatctccatgaatctaggaacttttgcttgcattgtatcatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatatttcttggtttcaataggactccttacgagcgttgtttctatctactattatctaaaaataatcaagttattaatgactggacgaaaccaagaaataacccctcacgtgcgaaattatataagatctcctttaagatcaaacaattccatcgaattgagtatgattgtatgtgtgatagcatctactataccaggaatatcaatgaacccgattattgcaattgctcaggatacccttttttagcttctaggatctatttcttagttcaagatccctcttactaactggaatcaaagaattactagatctgttccgcccaaaatgggaatgggctagggttatgaacttataatctataatctgatgatcgagtcgattccatgattataagttcattccataccggaccagaccggaatagggttatatacattctcattatgagaaggggtcattcgagcgtatctaaatagatactatgtttacatatgaatccctacgtcgttacattccatttaggattaggaataggcgtaatcggacctgctttttacatatctctcgttatttgggaccctattcacccctttgggcttctattgaatcgagaaataggtttgattgtccatctttttgatataatatatataaggcatcctcc

SEQ ID NO: 5070 - DNA, 1536 bp, Vitis vinifera
atgatctggcatatacagaatgaaaacttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttagtaatgagcataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttaataactatctttgtagctccagaatgtttcagtttatgctcctacctattatctggatataccaagaaagatgtacggtctaatgaggctactacgaaatatttactcatgggtggggcaagttcttctattctggttcatggtttctcttggctatatggttcatccgggggagagatcgagcttcaagaaatagtgaatggtcttatcaatacacaaatgtataactccccaggaatttcaattgcgcttatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcaagcatgataacttatatgctgttctatatctccatgaatctaggaacttttgcttgcattgtatcatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatatttcttggtttcaataggactccttacgagcgttgtttctatctactattatctaaaaataatcaagttattaatgactggacgaaaccaagaaataacccctcacgtgcgaaattatataagatctcctttaagatcaaacaattccatcgaattgagtatgattgtatgtgtgatagcatctactataccaggaatatcaatgaacccgattattgcaattgctcaggatacccttttttagctt

SEQ ID NO: 5071 - DNA, 1533 bp, Lactuca sativa
atgatctggcatgtacagaatgaaaacttcattctcgattctacgagaatttttatgaaagcctttcatttgcttctcttcgatggaagtttgattttcccagaatgtatcctaatttttggcctaattcttcttctgatgatcgattcaacctctgatcaaaaagatataccttggttatatttcatctcttcaacaagtttagtaatgagcataacgtccctattgttccgatggagagaggaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactataggaggaatgtttttatgtggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaatttcaattgcgctcatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatgatggatatgcaagcatgataacttatatgttgttctatatctccatgaatctaggaacttttgcttgcattgtcttatttggtctacgtaccggaactgagaacattcgagattatgcaggattatacacgaaagatccttttttggctctctctttagccctatgtctcttatccctaggaggtcttcctccactagcaggttttttcggaaaactctatttattctggtgtggatggcaggcaggcctatatttcttggttttaataggactccttacaagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaatccgattattgcaattgctcaggatacccttttttag

SEQ ID NO: 5072 - DNA, 1553 bp, Brassica rapa
gcagttactaattcatgatctggcatgtacagaatgaaaatttcattctcgattctacgagaatttttatgaaagcctttcatttgcttctcttcgatggaagttttattttcccagaatgtatcctaatttttggcctaatccttcttctgatgatcgattcaacctctgatcaaaaagatataccttggttatatttcatctcgtcaacaagtttcgtaatgagcataacggccctattgttccgatggagagaagaacctatgattagcttttcaggaaatttccaaacgaacaatttcaacgaaatctttcaatttcttattttactatgttcaactctctgtattcctctatccgtagagtacattgaatgtacagaaatggctataacagagtttctgttattcgtattaacagctactctaggaggaatgtttttatgtggtgctaacgatttaataactatctttgtagctccagaatgtttcagtttatgctcctacctattatctggatataccaagaaagatgtacgatctaatgaagctactatgaaatatttactcatgggtggggcaagctcttctattctggttcatggtttctcttggctatatggttcatccgggggagagattgagcttcaagaaatagtgaatggtcttatcaatacacaaatgtataactccccaggaatttcaattgcgcttatattcatcactgtaggaattgggttcaagctttccctagccccttctcatcaatggactcctgacgtatacgaaggatctcccactccagtcgttgcttttctttctgttacttcgaaagtagctgcttcagctttagccactcgaattttcgatattcctttttatttctcatcaaatgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattatattatttggtctacgtaccggaactgataacattcgagattatgcaggattatacacaaaagatccttttttggctctctctttagctctatgtctcttatccctaggaggtcttcctccactagcaggtttttttggaaaactccatttattctggtgtggatggcgggcaggcctatatttcttggtttcaataggactccttacgagcgttctttctatctactattatctaaaaataatcaagttattaatgactggacgaaaccaagaaataacccctcacgtgcgaaattatagaatatcccctttaagatcaaccaattccatcgaattgagtatgattgtatgtgtgatagcatctactataccaggaatatcaatgaacccgattattgcgattgctcaggataccctttttagcttctag

SEQ ID NO: 5073 - DNA, 1533 bp, Fagopyrum esculentum
atgatctggcatgtacagaatgaaaacttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttctatttcatctcttcaacaagtttagtaatgagcataacggccctgttgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctattattcgtattaacagctactctaggaggaatgtttttatgcggtgctaacgatttaataactatctttgtagctccagaatgtttcagtttatgctcctacctattatctggatataccaagaaagatgtacggtctaatgaggctactacgaaatatttactcatgggtggggcaagctcctctattctggttcatggtttctcttggctatatggttcatccgggggagagatcgagcttcaagaaatagtgaatggtcttatcaatacacaaatgtataactccccgggaatctcaattgcgcttatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcgtcttcttctggaaatcctagctattcttagcatgatagtggggaatctcattgctattactcaaacaagcatgaaacgtatgcttgcatattcgtccataggtcaaatcggatatgtaattattggaataattgttggagactcaaatgatggatatgcaagcatgataacttatatgctgttctatatcgccatgaatctaggaacttttgcttgcattgtatcatttggtctacgtaccggaactgataacattcgagattatgcaggattatacacgaaagatccccctttggctctctctttagcactatgtctcttatccctaggaggtcttcctccactagcaggttttttcggaaaactccatttattctggtgtggatggcaggcaggcctatatttcttggtttcaataggactccttacgagcgttgtttctatatactattatctaaaaataatcaagttattaatgactggacgaaaccaagaaataacccctcacgtgcgaaattatagaagatctcctttaagatcaaagaattccatcgaattgagtatgattgtatgtgtgatagcatctactatactgggaatatcaatgaaccctattattgcaattgctcaggatacccttttttag

SEQ ID NO: 5074 - DNA, 1533 bp, Helianthus annuus
atgatctggcatgtacagaatgaaaacttcattctcgattctacgagaatttttatgaaagcctttcatttgcttctcttcgatggaagtttgattttcccagaatgtatcctaatttttggcctaattcttcttctgatgatcgattcaacctctgatcaaaaagatataccttggttatatttcatctcttcaacaagtttagtaatgagcataacggccctattgttccgatggagagaggaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcatattaacagctactataggaggaatgtttttatgcggtgctaacgatttaataactatctttgtagctccagaatgtttcagtttatgctcctacctattatctggatatacgaagaaagatgtacggtctaatgaggctactatgaaatatttactcatgggtggggcaagctcttctattctggttcatggtttctcttggctatatggttcatccgggggagagatcgagcttcaagaaatagtgaatggtcttatcaatacacaaatgtataactccccaggaatttcaattgcgctcatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtcttatttggtctacgtaccggaactgagaacattcgagattatgcaggattatacacgaaagatccttttttggctctctctttagccctatgtctcttatcgctaggaggtcttcctccactagcaggttttttcggaaaactctatttattctggtgtggatggcaggcaggcctatatttattggttttaataggactccttacaagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaatccgattattgcaattgctcaggatacccttttttag

SEQ ID NO: 5075 - DNA, 1681 bp, Arabidopsis lyrata
tggagattggatgcagttactaattcatgatctggcatgtacagaatgaaaatttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttcgtaatgagcataacggccctattgttccgatggagagaagaacctatgattagcttttcaggaaatttccaaacgaacaatttcaacgaaatctttcaatttcttattttactatgttcaactctctgtattcctctatccgtagagtacattgaatgtacagaaatggctataacagagtttctgttattcatattaacagctactctaggaggaatgtttttatgtggtgctaacgatttaataactatctttgtagctccagaatgtttcagtttatgctcctacctattatctggatataccaagaaagatgtacgatctaatgaggctactatgaaatatttactcatgggtggggcaagctcttctattctggttcatggtttctcttggctatatggttcatccgggggagagattgagcttcaagaaatagtgaatggtcttatcaatacacaaatgtataactccccaggaatttcaattgcgcttatattcatcactgtaggaattgggttcaagctttccctagccccttctcatcaatggactcctgacgtatacgaaggatctcccactccagtcgttgcttttctttctgttacttcgaaagtagctgcttcagcttcagccactcgaattttcgatattcctttttatttctcatcaaatgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatcgccatgaatctaggaacttttgcttgcattatattatttggtctacgtaccggaactgataacattcgagattatgcaggattatacacaaaagatccttttttggctctctctttagctctatgtctcttatccctaggaggtcttcctccactagcaggtttttttggaaaactccatttattctggtgtggatggcaggcaggcctatatttcttggtttcaataggactccttacgagcgttctttctatctactattatctaaaaataatcaagttattaatgactggacgaaaccaagaaataacccctcacgtgcgaaattatagaatatcccctttaagatcaaacaattccatcgaattgagtatgattgtatgtgtgatagcatctactataccaggaatatcaatgaacccgattattgcgattgctcaggataccctttttagcttctagaatctatttcttagttcaagatccctcttactaatactaactggaatcaaagaattagtagatcggttccgcccaaaatgggaatggactaaggttatgaacttataatctataat

SEQ ID NO: 5076 - DNA, 1536 bp, Ricinus communis
atgatctggcatgtacagaatgaaaacttcattctcgattctacgagaatttttatgaaagcctttcatttgcttctcttcgatggaagttttattttcccagaatgtatcctaatttttggcctaattcttcttctgatgatcgattcaatctctgatcaaaaagatataccttggttatatttcatctcttcaacaagtttagtaatgagtataacggccctattgttccgatggggagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatgctttctcttggctatatggttcgtccgggggagagatcgagcttcaagaaatagtgaatggccttatcaatacacaaatgtataactccccaggaatttcaattgcgcttatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattctgagcatgatagtggggaatctcattgctattactcaaacaagcatgaaacgtatgcttgcatattcgtccataggtcaaatcggatatgtaattattggaataattgttggagactcaaatggtggatatgcaagcatgataacttatatgctcttctatatctccatgaatctaggaacttttgcttgtattgtattatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatatttcttggttttaataggactccttacgagcgttgtttctatctactattatctaaaaataatcaaattattaatgactggacgaaaccaagaaataacccctcacgtgcgaaattatagaagatcccctttaagatcaaacaattccatcgaattgagtatgattgtatgtgtgatagcatctactataccaggaatatcaatgaacccaattattgaaattgctcaagatacccttttttagctt

SEQ ID NO: 5077 - DNA, 2994 bp, Arabidopsis thaliana
aaattcaaacttgaaaaagtctctttctgattctcgaagaatgaggggcaaagagattgattgagaaagatctcttgttcttattataagatcgtgtgattggacccgcagatgtttggtaaaaagaataatcttatcctttgagaataatcaaaaatagaaagtgttcagttggaacatgaaaacgtgaccgagtttgtcctagttactcttcgggacggagtggaagaagggaggagattcgcgaacgaggaaagggacccaatgacttcgaaagaattgaacgaggagccgtatgaggtgaaaatctcatgtacggttctgtagagtggcagtaagggtgacttatctgtcaacttttccactatcacccccaaaaaaccaaactctgctttacgtaaagttgccagagtacgattaacctcgggatttgaaatcactgcttatatacctggtattggccataatttacaagaacattctgtagtcttagtaagagggggaagggttaaggatttacccggtgtgagatatcacattgttcgaggaaccctagatgctgtcggagtaaaggatcgtcaacaagggcgttctaaatatggggtcaaaaagccaaaataaaagatttgagcccttataaaaagaaaacagattcttgaacccctttcacgctcatgtcacgccgaggtactgcagaagaaaaaactgcaaaatccgatccaatttatcgtaatcgattagttaacatgttggttaaccgtattctgaaacacggaaaaaaatcattggcttatcaaattatctatcgagccttgaaaaagattcaacaaaagacagaaacaaatccactatctgttttacgtcaagcaatacgtggagtaactcccgatatagcagtaaaagcaagacgtgtaggcgggtcaactcatcaagttcccattgaaataggatccacgcaaggaaaagcacttgccattcgttggttattaggggcatcccgaaaacgtccgggtcgaaatatggctttcaaattaagttccgaattagtggatgctgccaaagggagtggcgatgccatacgcaaaaaggaagagactcatagaatggcagaggcaaatagagcttttgcacattttcgttaatccaggaacaggatctatatagacacatagatccatggatccatacatctcgatccgaaaagaatcaatagaaaaagaaaaaatcggaattgatcgatctctttctcgaaacaaacgaaaaggaaagaaaagacgaaacagaaatcatggatcaactaagccctctcggggacttgcttaagaataagaaagagcaatctcatgtaaataccatggaataaggttttatcctattcatggggattccgtaaatattccattccaaaaatcaaaaattggtttttttttggagattggatgcagttactaattcatgatctggcatgtacagaatgaaaatttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttcgtaatgagcataacggccctattgttccgatggagagaagaacctatgattagcttttcaggaaatttccaaacgaacaatttcaacgaaatctttcaatttcttattttactatgttcaactctctgtattcctctatccgtagagtacattgaatgtacagaaatggctataacagagtttctgttattcatattaacagctactctaggaggaatgtttttatgtggtgctaacgatttaataactatctttgtagctccagaatgtttcagtttatgctcctacctattatctggatataccaagaaagatatacgatctaatgaggctactatgaaatatttactcatgggtggggcaagctcttctattctggttcatggtttctcttggctatatggttcatccgggggagagattgagcttcaagaaatagtgaatggtcttatcaatacacaaatgtataactccccaggaatttcaattgcgcttatattcatcactgtaggaattgggttcaagctttccctagccccttctcatcaatggactcctgacgtatacgaaggatctcccactccagtcgttgcttttctttctgttacttcgaaagtagctgcttcagcttcagccactcgaattttcgatattcctttttatttctcatcaaatgaatggcatcttcttctggaaatcctagctattcttagcatgatattcgggaatctcattgctattactcaaacaagcatgaaacgtatgcttgcatattcgtccataggtcaaatcggatatgtaattattggaataattgttggagactcaaatggtggatatgcgagcatgataacttatatgctgttctatatcgccatgaatctaggaacttttgcttgcattatattatttggtctacgtaccggaactgataacattcgagattatgcaggattatacacaaaagatccttttttggctctctctttagctctatgtctcttatccctaggaggtcttcctccactagcaggtttttttggaaaactccatttattctggtgtggatggcaggcaggcctatatttcttggtttcaataggactccttacgagcgttctttctatctactattatctaaaaataatcaagttattaatgactggacgaaaccaagaaataacccctcacatgcgaaattatagaatatcccctttaagatcaaacaattccatcgaattgagtatgattgtatgtgtgatagcatctactataccaggaatatcaatgaacccgattattgcgattgctcaggataccctttttagcttctag

SEQ ID NO: 5078 - DNA, 2102 bp, Brassica napus
cggagattggatgcagttactaattcatgatctggcatgtacagaatgaaaatttcattctcgattctacgagaatttttatgaaagcctttcatttgcttctcttcgatggaagttttattttcccagaatgtatcctaatttttggcctaatccttcttctgatgatcgattcaacctctgatcaaaaagatataccttggttatatttcatctcgtcaacaagtttcgtaatgagcataacggccctattgttccgatggagagaagaacctatgattagcttttcaggaaatttccaaacgaacaatttcaacgaaatctttcaatttcttattttactatgttcaactctctgtattcctctatccgtagagtacattgaatgtacagaaatggctataacagagtttctgttattcgtattaacagctactctaggaggaatgtttttatgtggtgctaacgatttaataactatctttgtagctccagaatgtttcagtttatgctcctacctattatctggatataccaagaaagatgtacgatctaatgaagctactatgaaatatttactcatgggtgggacaagctcttctattccggttcatggtttctcttggctatatggttcatccgggggagagattgagcatcaagaaatagtgaatggtcttatcaatatacaaatgtataactctccaggaatttcaattgcgcttatattcatcactgtaggaattgggttcaagctttccctagccccttctcatcaatggactcctgacgtatacgaaggatctcccactccagtcgttgcttttctttctgttacttcgaaagtagctgcttcagctttagccactcgaattttcgatattcctttttatttctcatcaaatgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatggtggatatgcgagcatgataacttatatgctgttctatatctccatgaatctaggaacttttgcttgcattatattatttggtctacgtaccggaactgataacattcgagattatgcaggattatacacaaaagatccttttttggctctctctttagctctatgtctcttatccctaggaggtcttcctccactagcaggtttttttggaaaactccatttattctggtgtggatggcgggcaggcctatatttcttggtttcaataggactccttacgagcgttctttctatctactattatctaaaaataatcaagttattaatgactggacgaaaccaagaaataacccctcacgtgcgaaattatagaatatcccctttaagatcaaccaattccatcgaattgagtatgattgtatgtgtgatagcatctactataccaggaatatcaatgaacccgattattgcgattgctcaggataccctttttagcttctagaatctatttcttagttcaagatccctcttactaactggaatcaaagaattagtagatcggttccgcccaaaatgggaatggactaaggttatgaacttataatctataatctgatgatcgagtcgattccatgattataagttcattccataccggaccagaccggaataaggttatatacattctcattatgagaaggggtcattcgagcgtatctaaatagatactatgtttacgtagggatccctacgtcgttacattccatttaggattaggaataggcgaaatctgacctactttttacatatctctcgttatttgggaccctattcacctctttggttggacttctattgaatcgagaaataggtttgattgtccatctttttgatataatattaatatatatataaggcatcctccggataaggataattcaaatctaagcaattagatgtccgactcgggcctatatgacatgaccgatcaatagaaatacttcaacactccacctttgtcatatatccgatacaccgt

SEQ ID NO: 5079 - DNA, 1533 bp, Cicer arietinum
atgatttgacatgtacagaatgaaaatatcattctcgagtctacgagattttttatgaaagcctttcatttgcttctcttcgatggaagttttattttcccggaattcatcctaatttttggcctaattcttcttctgatgatcgattcaacctctgatcaaaaaaatatatcttcgttctattttatctcttcaacaagtttagtaatgagcataacggccctgttgttccgatggcgagaagaacccatgattagtttttcgggaaatttccaaacgaacaatttcaacgaaatctttcaatttcttattttactatcttcaactctatgtattcctctatccgtagagtacattgaatgtacagaaatggctataccagagtttctgttattcatattaacagctactctaggaggaatgtttttatgcagcgctaacgatttaataactatctttgtagctctagaatgtttcagtttatgctcctatctactatctggatataccaagaaagatgtacgatctaatgaggctactatgaaatatttactcatgggtggggcaagctcttctattctggttcatggtttctcttggctatatggttcatccgggggagagatagaacttcaagaaatagtgaatggtcttatcaatacacaaatgtataactccccaggaatttcaattgcgcttatattcattaccgtaggaattgggttcaagctttccctagccccttctcatcaatggactcctgacgtatacgaaggatctcccactccagtcgttgcttttctttctgttacttcgaaagtagccgctttagcttcagccactcgaattttggatattcctctttatttctcatcaaacgaatggcatcttcttctagaaatcctagctattcttagcatgatattagggaatttcattgctattacccaaacaagcatgaaacgtatgcttgcctattcgtccataggtcaaataggatatgtaattattggaataattgttggagactcaaatggtggatatgcaagcatgataacttatatgcttttctatatcgctatgaatttaggaacttttgcttgcattgtgtcatttggtctacgtaccggaactgataacattcgagattatgcaggattatacacgaaagatccttttttggctgtctctttagccctatgtctcttatccttaggaggtcttcctccactagcaggttttttcggaaaactttatttattctggtgtgggtggcaagcaggtctatatttcttggtttcaataggacttcttacaagcgttgtttctatctactattatctaaaaataattaagttagtaatgactggacgaaaccaagaaataactacttacgtgcgaaattatagaaggtctcctgtaagatccaacaattccatcgaattgagtatgattatatgtgtgatagcatctactataccaggaatatcaatgaaccccataattgaaattgctcaggatacccttttttag

SEQ ID NO: 5080 - DNA, 1527 bp, Jatropha curcas
atgatctggcatgtacagaatgaaaacttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttagtaatgagtataacggccctattgttccgatggagagaagaacctatgattagcttttcgggaaatttccaaacgaacaatttcaacgaaatctttcaatttcttattttactatgttccactctatgtattcctctatccgtagagtacattgaatgtacagaaatggctataacagagtttctcttattcctattaacagctactctaggaggaatgtttttatgcggtgctaacgatttaataactatctttgtagctccagaatgtttcagtttatgctcctacctattatctggatataccaagaaagatgtacggtctaatgaggctactacgaaatatttactcatgggtggggcaagctcttctattctggttcatgctttctcttggctatatggttcgtccgggggagagatcgagcttcaagaaatagtgaatggccttatcaatacacaaatgtataactccccaggaatttcaattgcgcttatattcatcactgtaggaatcgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagcttttctgagcatgatagtggggaatctcattgctattactcaaacaagcatgaaacgtatgcttgcatattcgtccataggtcaaatcggatatgtaattattggaataattgttggagactcaaatggtggatatgcaagcatgataacttatatgctcttctatatctccatgaatctaggaacttttgcttgtattgtattatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatatttcttggttttaataggactccttacgagcgttgtttctatctactattatctaaaaataatcaagttattaatgactggacgaaaccaagaaagaacctctcacgtgcgaaattatagaactttaagatcaaacaattccatcgaattgagtatgattgtatgtgtgatagcatctactataccgggaatatcaatgaacccgattattgaaattgctcaagatacccttttttag

SEQ ID NO: 5081 - DNA, 1480 bp, Pisum sativum
atgaaagcctttcatttgcttattttcgatggaagttttctttttccggaattgatcctaattttgggcctaattcttcttctgatgatcgattcaactttggatcaaaaagagatatcttggttctattttatctcttcaacaagtttcgtaatgagcataacggcgctgttgttccgatggagagaagaacccatgattagtttttcgggaaatttccaaacaaacaatttcaacgaaatctttcaatttcttattttactatcttcaactctatgtattcctctatccgtagagtacattgaatgtacagaaatggctataacagagtttctattattcatattaaccgctactctaggaggaatggttttatgcagcgctaacgatttaataacgatctttgtagctctagaatgtttcagtttatgctcctatctactatctggatataccaagaaagatgtacggtctaatgaggctactatgaaatatttactcatgagtggcgcaagctcttctattctggttcatggtttctcttggctatatggttcatccgggggagagatagagcttcaagaaatagtgaatggtcttatcaatacacaaatgtataactctccgggaatttcaattgcgcttatattcatcactgtaggaattgggttcaagctttccccagccccttctcatcaatggactcctgacgtatatgaaggatctcccactccagtcgttgcttttctttctgttacttcgaaagtagctgcttcagcttcagccactcgaattttggatattcctttttatttctcatcaaacgaatggcatcttcttctggaaatcctagctattcttagcatgatattagggaatctcattgctattacccaaacaagcatgaaacgtatgcttgcctattcgtccataggtcaaattggatatgtcattattggaataattgttggagactcaaatggtggatatgcaagcatgataacttatatgctgttctatatctccatgaatctaggaacttttgcttgcattgtgttatttggtctacgtaccggaactgataacattcgagattatgcaggattatacacgaaagatccttttttggctctctctttagccctatgtctcttatccttaggaggtcttcctccactagctggttttttcggaaaactttctttattctggtgtggatggcaagcaggccgatatttcttggtttcaataggacttcttacaagcgttgtttctatctactattatctaaaaataatgaagttattaatgactggacgaaaccaagaaataactcctcacgtgcgaaattatagaagatttcctgtaagatcaaacaattccatcgaattgagtatgattatatgtgtgatagcatctactatactaggaatatccatgaaccccattattgaaattgctcaggaatacccttttttag

SEQ ID NO: 5082 - DNA, 1457 bp, Liriodendron tulipifera
atgatctggcatgtacagaatgaaaacttcattctcgattctacgagaatttttatgaaagcgtttcatttgcttctcttccatggaagtttcattttcccagaatgtatcctaatttttggcctaattcttcttctgatgatcgattcaacctctgatcaaaaagatataccttggttatatttcatctcttcaacaagtttagtaatgagcataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctgttattcgtattaacagctactctaggaggaatgtttttatgtggtgctaacgattcaataactatctttgtagctccagaatgtttcagtttatgctcctacctattatctggatataccaagagagatgtacggtctaatgaggctactacgaaatatttactcatgggtggggcaagctcttctattctggttcatggtttctcttggctatatggttcatccgggggagagatcgagcttcaagaaatagtgaatggtcttatcaagacacaaatgtataactccccaggaatttcaattgcgcttatattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatattcctttttatttctcatcaaacgaatggcatcttcttctggaaatcctagctattcttagcatgatattggggaatctcattgctattactcaaacaagcatgaaacgtatgcttgcatattcgtccataggtcaaatcggatatgtaattattggaataattgttggagactcaaatgatggatatgcaagcatgataacttatatgctgttctatatctccatgaatctaggaacttttgctcgcattgtctcatttggtctacgtaccggaactgataacattcgagattatgcaggattatacacgaaagatccttttttggctctctcttcagccctatgtctcttatccctaggaggtcttcctccactagcaggttttttcggaaaactccatctattctggtgtggatggcaggcaggcctatatttcttggtttcaataggactccttacgagcgttgtttctatctactattatctaaaaataatcaagttattaatgactggacgaaaccaagaaataacccctcacgtgcgaaattatagaagatctcctttaagatcaaacaattccatcgaattgagtatgattgt

SEQ ID NO: 5083 - DNA, 4155 bp, Phaseolus coccineus
gttacaatcctcttgccgccgagctccctttctcctcggtccacagagacaaaatgtaagactggcgccaacagttcatcacgaaagaaaggactagctgagccgagatcactaactaaaacgaattgaatactaatagaaaatactaatcgaatagaaatagaactgtcttttcatatagatatcccttcaacacaacataggtcatcgaaaggatctcgaagacccaccaacgcacgaaagctgggatctttcagaaaatagattcctattcgaagggtgcataaccgcatggataagctcacactaacccgtcaatttgggattcaattcggttccgaggtatcgggaaggaattggaatgtaatcatatcgattcatccagatacagaagaaagagttctctattgattcaaacgctctacctacgagatagggatagagaaagaggaaaaaaccgaggatttcacatagtacttttgatcgaaaaatcgatctgatttttttcgtacttttcgctcaatgatgaaatgggtcagattctacaggaccaaaccttgtgggagttaaggaatgatgaaagaaaagaaaaaaagaaagtaaatcaaaatgcagtagaagagtcctgattccaaacgaaaaaattcaaacttgattgaaaaggatctttctgattattgaagaatggggcaaaaggattgatcgcgaaagatttcttgttcttattagaagatcgtgattggatccacatatgtttggtaaaaagaaagaaaaaatcttcttcttttagaataataaaaaggaaagtgttcaattggaacatgaaaacgtgactgaattggtcctagttactcttcggaacggaatagaagaaggggagagattctcgaaccgaactaggaaacggatccaatgacttcaaaaaaaattgaacgaggagccatatgaagtgaaaatctcatgtacggttctgtagagtggcagtaagggtgacttatctgtcaacttttccactattacacccaaaaaaccaaactctgccttacgtaaagttgccagagtacgtttaacctctggatttgaaattactgcttatatacccggtattggccataatttacaagaacattctgtagtcctagtaagaggggggagggttaaagatttacccggtgtgagatatcacattgttcgaggaaccctagatgctgtcggagtaaaggatcgtcaacaagggcgttctaaatatggtgccaaaaagccaaaataaatgattttagcccttataaaagttctaaaaaaacggattcctcctttcacgctcatgtcacggcgaggtactgcagaagaaaaaaccgcaaaatccgatccaatttatcgtaatcgattagttaacatgttggttaaccgtattctgaaacacggaaaaaaatcattggcttatcaaattctctatcgagctatgaaaaatattcaacaaaagacagaaacaaatccactatctgttttacgtcaagcaatacgtggagtaactcccgatatagcagtaaaagcaagacgcgtaggcggatcaactcatcaagttcccgttgaaataggatccgcacaaggaaaagcacttgccattcgttggttattgggggcatcccgaaaacgtccgggtcgaaatatggctttcaaattaagttccgaattagtggatgctgccaaaggtagtggcgatgccatacgcaaaaaggaagagactcatagaatggcagaggcaaatagagcttttgcacattttcgttaatccatgaacaggatctatatagacacgtagacccatgaatccatacatctcgatcgaaaaagaatcgaaattgatgaatatatctctcgaaacaaacgaaaaacaaaacataaatcatggatcaattaagccctctcggggacttgcttaagaatgagaaagaggaatcttatgtaaataccacagaataaggtttggtcctattcatggggattctgtaactattccattccaaaaagataaaaaaattcgaaacaattgggattttttggagattggatgcagttactaattcatgatctgacatgtacagaatgaaaacttcattctcgattctacaagaacttttacgaaagcctttcatttgcttcttttcaatggaagttttattttcccagaatatatcctattttttggcctaattcttcttctgatgattgattcaacctctgatcaaaaagatatatcttggttctattttatctcttcaacaagtttagtaatgagcataacggccctattgttccgatggagagaagaacctatgattgccttttcgggaaatttacaaacgaacaatttcaacgaaatctttcaatttcttattttactatgctcaactctatgtattcctctatccgtagagtacattgaatgtacagaaatggctatcacagagtttctcttattcatattaacaactactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaatggtcttatcaatacacaaatgtataactccccaggaattttaattgcacttttattcatcactgtaggaattgggttcaagctttccccagccccttctcatcaatggactcctgacgtatacgaaggatctcccactccagtcgttgcttttctttctgttacttcgaaagtagctgcttcagcttcagccactcgaattttcgatatccctttttatttctcatcaaacgaatggcatcttcttctggaaatcctagctattcttagcatgatattggggaatctgattgctattacccaaacaagcatgaaacgtatgcttgcgtattcgtccataggtcaaatcggatatgtaattattggaataattgttggagactccaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactagcaggttttttcggaaaacttcatttattctggtgtggatggcaggcaggcttatatttcttggtttcaataggactccttacaagtgttgtttctatctactattatctaaaaataatcaagttattaatgactggacgaaaccaagaaataactcctcacgtgcgaaattatagaaggtcccctttcagatcaaacaattccatcgaattcagtatgattgtatgtgtgatagcatctactataccaggaatatcaatgaaccctattattgaaattgctcaggatacccttttttagcttctagaatctatttcttagttcaactcttaccttactaactggaatcaaagaattagtagatatgctccgcccaaaatggcaatgggctagggttatgaacttagaatcgaaaatctgatgatcgagtcgattccatgattctaagttcattctataccggacccaaccgaaatggggttatatacattctcattatgagaaggggtcattcgagcgtatctaaatagatactatgtttacatatagatctctgcgtccattctatttaggattaggaataggtgtaatcgaacctgtttttcacatatctctcattctttaggaccctattcaattcatctctttgggcttctattgaatcgataaataggttgaattagtccattttttttttttgatagaatatctatctatatctatctatatagatagataagatatcctctggataattcaaatcgaaccaattggatgtccgactcggacctatatgacatgaccaatcaataaaagactctaacactctaccttt

SEQ ID NO: 5084 - DNA, 2333 bp, Zamia vazquezii
  misc_feature (606)..(606): n is a, c, g, or t
ggcgggaatctcctattccaagaatagaaagttcaaaagattgatacttttcggagattgaatgaagttactaattcatgatctgacatgtacgaaatgaaaacttcattttcaattagaccctgagatcatttttatgaaagagtttcatttgcttctcttccatgggggttctattctcccagaatgtatcctaattctcggcctaattcttcttctgatgatcgatctaacctctgatcaaaaagatacgccttggctctatttcatctctttaacaagtttagtaatgagcataacggtcttattatttcgatggagagaagagcctacgattagctttttgggtaatttccaaacgagcaatttcaacaaaatctttcgatttctcattttactatgctcaactctatgcattcctctatccgtggagtacatcaaatgtgcagaaatggctataacagagttcctgttattcctattaacggctgctctaggaggaatggttttatgtggtgctaatgatttagtcactatcttcgtagctctggaatgtttcagcttatgttcttatctattatctggatataccaagagagatgtacngtctaacgaggctactatgaaatatttacttatgggtggggcaagctcttctattctggtttatgggttttcttggctatacggtctatccgggggagagattgagcttcaagaggtagtaaatggtctcataaatacacaaatgtataactccccaggaattttgattgcgctcatatccataactgtaggaattggattcaagctttctctagtcccttttcatcaatggacccctgacgtatatgaaggatctcccaccccagtcgttgcttttctttctgttacttcgaaagtagctgcttcagctttagccactcgaattttcgatattattttctacttttcatcgaacgaatggcatcttcttttggaaatcttagctattcttagcatgatattaggcaatttaattgctattactcaaacgagcatgaaacgtatgcttgcatattcgtccatgggtcaaattggatatatcattattggaataattgctggagactcaaagaatggatatgcaagcatgataacttatatgctgttctatattttcatgaatttaggaacttttgcttgcattgtattatttggtctacgcacaggaactgataacattcgagattatgcaggattgtatacgaaagatcctttttcggctttctctttagctttatgtttactatctttagggggtattcctccattagcaggtttttttggaaaactttatctattctggtgcggatggcaggcaggcttatatttattggtttcgataggaccctttatgagcgttatctctatatactattatctaaaaataatcaagttattaatgactgaacgaaacaaagaaataactcctcacgtgcaaaattatagaggatctccatcttctttcatatcaaagaattctatcgagttgagtatgattgtatgtgtaacagcatctactacactgggaatagcaatgaacccaattattgcaattgctcaggataccttattttaaggcctatttattcgttcaatatttctcttactaaccggaagaattagtcgatttgtcccgatatccccaaaatgggaataggccgagattctgagatgaacttctaattatgggatcaacttgatcatcgaattagaagttcattctagactagaatagggttattaatagggctgtgtacattttcattatgggaaagggtcattcaaacgcatgtaaatagatagatatctacgtcgttccattccatttaggaatcgatatatgcgtacatatgatcgaacctgcttttgacatatcgttatttgggtaccatatttgcttctctaggcttctattgaatcgaaaaaaaagatgttcgatcatacatattttgggtgcatatgaaagatccttcggataatgaaaatcgaaataatttgatgatatattagacttggacctatataaccgatcgatataaatactccaatactctatctttgccatagattctacattccatctataatgatagatgatcacaatatagatatcatattcatggaatatgattcactttcgggatgccttgatggtggaatggtagacacgcgagactcaaaatctcgtgctaaagagcgtggaggttcgagtcctcttcaaggcataatattgagaatgcttattgaatgagcaattcaacaacaaatatcggatctaattgattctc

SEQ ID NO: 5085 - DNA, 1479 bp, Pinus taeda
atgaaagaatatcatttgcttcttttctatggaagttccattttcccagaatgcatccttattttcggcctatttcttcttctagtaatcgatgtcatttttgataagaaaaagacaacttggttctatttcatctctttaacaagtttagtgctaagcatagcttttttgttatttcaatggagagaagaacccacgatcattttttttggcaatttacaaacaaacaattttaataaagtatttcggtttctcattttattatgttctactttatgtattcctctatccgtggaatacattcaatgtacagaaatggctgtaacagagtttttgttattcatattaacagctactctaggaggaatgtttttatgtggtgctaatgatttaacaactatcttcgtatctttagaatgtttaagtctatgttcttatctattatctgggtataccaaaagagatattcggtctaatgaggctattatgaaatatttacttatgggtggaacaagttcttccattcttgcttatggtctttcttggctatatggtctctctggaggtgagattgaaattcaagaaatagccaatggtcttataaatacacaaatgtataactctccaggaatttggattgcacttctatctgtaacggtaggaattgcattcaaactttctttagttccttttcatcaatggacccccgatgtatatgaaggatcccccactccagtcgttgcttttatttctgttatttcaaaagtagctgcttcagctttagtcactagaatttttgatattattttttatttctcattgaacgaatggcatcttcttctggaaatcctagctattctgagcatgatagtggggaatctcattgctattactcaaacaagcatgaaacgtatgcttgcatattcgtccataggtcaaattggatatgtaattattggaataattgttggagactcaaatggtggatatgcaagcatgataacttatatgctcttctatatctccatgaatctaggaacttttgcttgcattgtattatttggtctacgcaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatatttcttggtttcaataggactccttacgagcgttctttctatctactattatctaaaaataatcaagttattaatgactggacaaaaccaagaaataacccctcacgtgcgaaattatagaggatcccctttaagatcaaacaattccatcgaattgagtatgattgtatgtgtgatagcatctactataccgggaatatcaatgagcccgattattgaaattgctcaagatacccttttttag
